United States Patent 7,745,391 (HUMAN THROMBOSPONDIN POLYPEPTIDE) - sequence listing, part 217

SEQ ID NO: 547891 - DNA, 11972 bp, Homo sapiens
ctggctccgcgtcggccggtcggtttggtcggttgtagtggcctcgccgcccggtccgctgtcgcagcgctcatccgcgccgggagcccttggctgcgtcgcccggcagccgcgggagcatttcctgaagacgtagtcatgcagcacgtcagcagctcccagagcagccagcgccatgtccagtggcctggggcctgccccggcgcgggcgaggagcagccagcgtgctcccagccgtccctgcccctcacactgccatcccccagccaccaactacagcagctgatggtccagacccagagtcccacgcagcccagtccggggccggggcaggccttgcagaatgtgcgtgcaggtgcccctggccctgggctgggcctctgcagcagcagccctacaggggacttcgtggatgccagcgtgctggtgaggcagatcagcttgagcccctccagtggtggacactttgtgtttcaggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacgcccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcattaccaggagatgcaggctctgaaggaggtcttcaaggagtatttgattgaactgtttttcttgcaacactttcaagggaacatgatggatttcttagctttcaaggagagactgtatggaccattacaagcatatcttaggcagaatgatttggacattgaagaagaggaggaggaggaggaagaggaggaagaaaaatctgaggttatcaatgacgagcagcaagccctcgcagggagcctggtagcaggggccggaagcacagtagagacggacctgtttaagaggcagcaggcgatgccctccacaggtatggcaggaggaatgccccccacgccgcaggccgcgcagctcgctggacagaggcagagtcagcagcagtatgacccctccacggggcctcccgtgcagaacgctgccagcttgcacaccccactgccgcagctgcccgggaggctgcccccagccggtgttcccactgcagccctctcctctgcgctgcagtttgcacagcagccgcaagtggtagaggcccagacacagctccaaatcccggtgaagactcagcagcccaatgttcccatccctgcaccgcccagcagccaactccccatccctccctcgcagcctgcacagctggccctccacgttcccacacctggaaaggtgcaggtgcaggcctctcagctttcctccctgccacagatggtagcatcgacaaggctccctgtggaccctgccccgccctgcccacggcctctgcccacctcttctacctcgtccctcgcgcctgtgagtggctccggcccaggaccctcccctgctcgatcctctccagtaaatagaccttcctcagccaccaataaggcactatctccagtcacttcccggaccccaggggtggtggcatctgcccccaccaaaccacagagtcctgctcagaatgccacctcgtcccaagacagttctcaggatacgctgacagaacaaataactctggagaaccaggtgcatcagcgcattgcggagctgaggaaagcaggtctgtggtcccagaggcgtctgccaaagctgcaggaggccccacgccccaagtcccactgggactatctgctggaggagatgcagtggatggccacagactttgcccaggagaggaggtggaaggtggctgctgcgaagaagctcgttagaactgtggtgcgccatcacgaggagaagcagctccgtgaagaaagggggaagaaggaagagcagagcagactgaggcggatagccgcctccacggcccgggagatagagtgcttttggtcgaatattgaacaggttgtggaaataaaactacgagtagaattagaagaaaaaaggaagaaggccttaaatttacagaaagtttccaggagagggaaagaattgagacctaaaggatttgacgcattacaggaaagttctctggattcaggaatgtctggaagaaaaagaaaagctagcatatctttgactgatgacgaagtggacgatgaagaggaaacaattgaagaggaggaagcaaatgaaggcgttgtggaccaccaaacagaactttctaatttagccaaggaagctgagctgcccctcctggacctgatgaagctgtacgaaggcgccttcctgccgagttctcagtggccccggccgaagcctgatggggaggacacaagcggagaggaagatgcagatgactgtccaggcgacagggagagtcgcaaggacttggttctcatcgactcgcttttcatcatggatcagttcaaagctgccgagaggatgaatatcgggaagccaaacgccaaggacattgcggacgtcactgcggtggctgaagccatcctgccgaagggcagtgctcgggtcacaacctcggtcaagtttaatgctccatctttgttgtatggggctctcagagattatcagaagattggcctggactggctggccaaactttacaggaagaatctcaatggcatattggcagatgaagctgggctgggtaaaacagtgcagatcattgctttttttgcccacctagcttgtaacgaaggtaattggggcccccatcttgttgttgtgagaagttgtaacatactcaagtgggagcttgaattgaaacgttggtgtcccggactcaaaatcctctcatatattggcagccacagagaactcaaagcaaagagacaggagtgggccgaacccaacagcttccacgtctgcatcacgtcctacactcagttcttccggggcctcaccgccttcacacgagtgcgctggaagtgcctggtcattgatgagatgcagcgcgtgaagggcatgaccgagaggcactgggaagcggttttcaccctgcagagccaacaacgtctgcttctgatcgactcgccgctgcacaataccttcctggagctctggaccatggtgcacttcctggtcccagggatctccaggccctacctgagctcccctctgagggcccccagtgaagagagccaggattactaccataaagtggtcataaggttacacagggtgacacagccatttattttgaggagaactaagagagatgtggaaaagcaactaacaaagaaatatgagcatgttttgaagtgtcgcctttctaaccgacaaaaagccttatacgaggacgttatcctgcaacctggcactcaggaggccttgaagagcgggcactttgtcaacgtcctgagcatccttgtgcggctgcagcgcatctgcaaccaccctgggctcgtcgagccccggcacccaggctcttcctacgtggcggggccactggagtatccgtccgcatctctaatcctgaaggcactggagagagatttctggaaggaagcagatctttctatgtttgatctcatcggcttagaaaataaaatcactcgtcacgaggcagagttgctgtctaagaaaaagataccgcggaaactcatggaggaaatctccacttcagcagccccagcagcccgaccagcagcagcaaagctgaaggccagcaggttgtttcagcctgtgcagtatggccagaagcccgagggtcgcaccgtggctttccccagcactcacccgccccggacggcagcccccaccacggcctctgctgctccacagggcccgcttcgaggacggccgcccatcgccacgttctctgccaatccggaggcaaaagcagcagcagccccgtttcagacctctcaggcttccgccagtgctccacgacaccagcccgcctcggcctccagcacagccgctagcccggcccatcctgcgaaactgcgggcccagaccacagcacaggccttcaccccaggccagcccccgccccagccccaggccccctcgcacgcggccgggcagagcgcgctgcctcagaggctggtgctcccctcgcaggcccaggcccgcttgcccagtggagaggtagtgaaaatagctcagctggcatccatcacaggaccacagagccgcgtggctcagccagagacgccggtgacactgcagttccagggcagcaagttcaccctgtcacacagccagctccggcagctcacagcgggccagccgctgcagctgcaaggcagcgtcctccagatcgtgtccgcccccgggcagccctaccttcgagcccctggccctgtggtgatgcagaccgtgtctcaggcgggcgctgtgcacggcgccctgggaagcaagcccccggccggcggtcccagccctgcacccttgaccccacaagttggcgttccgggccgcgtggcggtgaatgccttggctgtaggagaacccggaacggcctccaaaccagcttctcccattggagggccgacccaggaggaaaagaccagactcttgaaagagcgcctggatcagatttatttagtcaacgagcggcgctgttctcaagctccagtctatggcagagacttgctaaggatttgtgccctgcctagccatggaagggtacagtggcgtgggtccctggatggccgtcgtgggaaggaggccgggccagcgcacagttacacttcatcctcagaaagtccaagtgagctgatgttgacgctttgtcggtgtggagagtctctgcaggatgttattgacagggtggcctttgtgattcctccggtggtggcagcacccccgtccctacgggtgccgcggccgccacccctgtacagccacagaatgaggatcttgaggcagggcctgagagagcacgctgcgccgtacttccagcagctgcggcagaccacggctccacgcctgctgcagttccctgagctgaggctggtgcagttcgactcagggaagttggaagctttagctatcttgcttcagaaattgaaatctgaaggacgtcgggtgctgattttatcacagatgattcttatgttggacattttagagatgttcttgaacttccattacctcacctatgtaagaatcgatgaaaatgccagcagtgagcaacggcaggaactgatgaggagtttcaacagagacaggcggattttttgtgccattctctccactcacagccgtaccacaggtataaaccttgtagaggcggacaccgtcgtgttttatgacaatgacctgaatccagtgatggatgccaaagctcaggagtggtgcgataggatcgggagatgcaaagacatccacatatacaggcttgtgagtggcaattccattgaagagaaattgttgaaaaatggaactaaagatctgatccgagaagtggctgctcagggaaatgactactccatggctttcttaactcagcgaaccatccaggagctgtttgaagtttattctcccatggatgatgctggcttcccggtcaaagctgaggagtttgtggtgctttctcaggaaccttctgtcacggaaaccattgcacccaaaattgcaagacctttcatagaggccctcaagagtattgagtatctggaggaggatgcccagaagtccgcacaggagggggtgctgggaccacacactgatgctctgtcatcagactctgagaacatgccgtgtgatgaagaaccatcccaattagaggagctagctgacttcatggagcagcttacaccaattgaaaaatatgctttaaattacctggaattattccatacttctattgagcaagaaaaggagagaaacagtgaggacgcagtgatgactgcagtgagggcatgggagttctggaacctgaagaccctgcaggagagggaggcccggctgcggctggagcaggaggaggcggagctcctgacctacacgcgagaggatgcctacagcatggagtatgtctacgaagatgtcgatgggcagacagaagtcatgccgctctggaccccacccaccccgccgcaggacgacagcgacatctacctcgactcggtcatgtgtctcatgtatgaagccactcccatcccagaggctaagctgccccctgtgtacgtgaggaaggagcggaagcgacacaaaacagacccctcagctgcaggcaggaagaagaagcagcgtcacggggaggcggtcgtccctcctcggtccctgtttgaccgcgcaacaccaggacttctgaaaattcgcagagagggcaaggagcagaagaagaatattctgctgaagcagcaggtgccattcgccaagcccctgccaacttttgccaaacccacagctgagcctggtcaagacaaccccgagtggctcatcagtgaggactgggcgctgctgcaggctgtaaagcagttactggagctgcctttgaacctcacaatcgtgtcacctgctcacacacctaattgggatcttgtcagtgacgttgttaactcctgtagccgaatctaccgctcttccaaacagtgccggaatcgctacgagaatgtcatcattccacgagaggaggggaagagtaaaaacaaccgtcctctccgtacgagccagatctatgcccaggatgagaatgccacacacacccagctgtacacgagccactttgacttaatgaaaatgactgctggcaagaggagtcccccaatcaaacctctgcttggcatgaatccctttcagaagaaccccaagcacgcgtctgtgttggcagaaagtggaatcaactatgacaagccgctgcctcccatccaggtggcatctctccgtgcagagcgaatcgcaaaagagaaaaaggctctggctgatcagcagaaggcacagcagccggccgtggcccagccacccccgccccagccgcagcccccaccacccccgcagcagccaccgccaccgctgccacaaccacaggcagcgggcagccagccgccagcagggccaccagctgtccagccccaaccccagccacagccccagacccagccacagcctgtgcaggccccagcgaaggcgcagcccgcaatcacgacggggggcagtgcagccgtactggcaggaaccattaaaacatcagttactgggacgagcatgcccactggtgccgtgagtggaaatgtgatcgtgaacaccatcgcaggggtcccagctgccaccttccagtccatcaacaagcgcctggcgtcgccagtggctcctggggccttgactacgccgggaggctctgctcccgcccaggtggtgcacacccagcccccgccacgggcagtcggctccccagccacggcgacccctgacctggtgtccatggcaacgactcagggtgttcgagcggtcacttctgtgacagcctcggccgtggtcactaccaacctgaccccagtgcagaccccggcacggtctttggtgccccaagtgtcccaagccacaggagttcagctccctggaaaaaccatcacacctgcacatttccagcttctcaggcagcagcagcagcagcagcagcaacagcagcagcagcagcagcagcagcagcagcagcagcagcagcagcaacagcagcagcagcaacagacgacgacgacctctcaggtgcaagttccacagatccagggccaggcccagtccccagcacagatcaaagctgtgggcaagctgacgccggaacacctcatcaaaatgcagaagcagaaactgcagatgcccccgcagcccccaccgccacaggcccagtctgcgcccccgcagccagcagcccaagtgcaagtgcagacctcgcagccgccgcagcagcagagcccccagctcacgacggtcacggccccaaggcctggtgccctgctgacgggcaccaccgtggccaacctccaggtggcccggctcacccgggttcccacttctcaactgcagtcgcaagggcagatgcagacccaggcaccccagccagcccaggtgcccttggcgaagcctccggtggtgtccgtcccggcagctgtggtctcctcaccgggagtcaccaccctgcccatgaacgtcgcggggatcagcgtggcgatcggtcagccacagaaggcagcaggacagaccgtggtggcccagcccgtgcacatgcagcagctgctgaagctgaagcagcaggccgtccagcagcagaaggccatccagccccaggctgcacagggcccggcagccgtccagcagaagatcaccgcacagcagatcaccacccctggcgcgcagcagaaggttgcctacgccgcgcagccggcccttaagacccagtttcttaccacacccatctcccaggcccagaaactggccggggcccagcaagtgcagacccagatccaggttgcaaaacttcctcaagttgttcaacagcaaacacccgtggccagcatccagcaagttgcctctgcttcccagcaggcttctccacagactgtggcgctcacgcaggcgacggcggccgggcagcaggtgcagatgatccctgcagtgaccgcgactgcccaggtggttcagcagaaactcattcagcagcaggtggtgaccacggcgtcggccccgctccagactccaggcgctcccaacccagcccaggtgcccgccagctccgacagcccaagccagcagcccaagttacagatgagggtccctgctgtcaggctaaagacacctactaagcctccgtgccagtagtcagggcagcagggctgcctctcatctaaagcaaaactaccttcctcacagaaaacgctttattagtgaaccttgggaccatgtcacgcaagagattcagcactgggaaagatataattgaaacaaaatagtgtaatcattttattaaaatgcatcccacactgcaggacaaatggtccttatggagtgccgcgttctctgtactacgtggctcatggaaaaagtgacaacatggcttcctctaaatcatttcacctttcagtccccacccgcacccgtcccctagagccatagtactgtgttctgaaagccatttagaatttctttgtgagcatgtagtgctttgcacgccacagaagccgtctgccgtgtgtgaggagcatacaatggactttctaaagataaggcgtgggcttccacagtgtctgccagagtttagttctttataccttactgaaaaatgcctcgtggtcttcgcagaggggaaggcctgtctaaagtcaatcatccgagatgggttttccattccaaagaaaggcaatatggttccttccttccctcctaaaatatgacttaacttttaagagaaatgttctgacacccacctaaacacacaaggcacgttcctggcctgtgttcaagggaaatgatcagtcattgcattgttattccaaagagcagccaacagtggcctcccccaggccctaccctgcaatgggattcgctttcatttaatggaaacttctgggactgatgcccaactcagtgcactcaagacgcatctccagttttcgggggaagctggtatttgacatagtgtgttaaacagctcctgagaacctttgggacactctgccatggctggcgtgaggcccagaggaccacgcagaggcaatggtagtacagatgtcacagctgagggtacgatgaggcctgggctcagtgagccaggacgaatgtgacagacaccccttgctgccacagtcagccctttgacgaaggtgggctggtgattctggaagtattggctatagcggtgggcccagtcaactcttccttgtggacttacgacagcagattttctctaggataagcttgtgtggttctgccagtgaagcagagaaccacctgtgctgttgtggaaggcgtgccgttgagggggaaaacgaagcccagtatttgctactgtttttcctttttttactatgacaggaaaataaatgcaattttagtggaattgattgacagtgtctccttactttgaagttttcaccaaagcaaaaaggtccatatccaatagtatcctttgtgctgtggcttgattttggcctattttacattatttggtccaggaaattaggttatattaggttttttgtatactaaaaatcagttatggcacaataaagattttctgtttttaaattgtatttcatctgcttcctccccattctctcactttaagtgacattgaggaaggtattctgtcccacaggtttctgtggacagcgatacagcaggagtcagtgaaatcaactggggagctcacttgagctcttgataagaaatgtggagaaaagtaaaaaccaagctttgaagaaacagaagaaattaatcttttagttagttgaacataccaaagcagaggactggaatctgtttgttctaaccaacccgttctccctggcttggcacgtgccgtgagagcgcagcttgccggagggagggccgctgtgtgcgcctcacatctggctcccagtggaaacttttactcctcctcatccgcagatgtgatagaactgaagtatctaggaattctgcctttgtcatttgttttaatttgtgtgccctgttcattttttttgtctttcccaaatcttggtagtctccttatagttgaagataaaatgttgagtgcacttattttagaatatcctagacataactgtctaagtaaaagcgctctattaatctaaaacactacaagagaatttaacaccatctctcaaatgcttttttggagagcttaatgggattctgaatatttgcaatgtggagtttccgccccgatctcacgtcagtgagggtctcctgtctctcaagtgtgtttcctttggctgttccctaatacaaaacacggacatatttttactcgtagcactcaatttagtaacttctagatgctaccgttgacctgagttaaattcatttagtcgtgtacgtaaaaactctccttttagtgtgttattttcttggccttcccttttaaaggttaaagtttctaacctaagaattaagtacgcgttcaggaagctgttgtctaggccttccccttgtgaatctgggttcattccaatacggcaagtaagagttggaaactttgagaacacagactataaaggcagcagcccgaacactgtcagactctaattggcgaccctgggaaacagttgccctgctattctttaaagaaagacgtttattctgatgataaaaacagttagccagactgtttttaaagcacctggcgggaagcagaaggttggatccaagcccttgttcagatttggtgcctgataagacaggggtttctctttttgtgacctttattattattattttgttaactgttgtaaccagttagctgttgtgttttaagatagaaaggaacaagactaaaattgtaaatactttgtaaacatcagcatttgtacttgaatagtaggattttaaagggcattgatagcataccaaacaaaaggcaaaataaagtgacctttttataaaaaaaaaaagaaaaagtcgac

SEQ ID NO: 547892 - DNA, 12339 bp, Homo sapiens
ctggctccgcgtcggccggtcggtttggtcggttgtagtggcctcgccgcccggtccgctgtcgcagcgctcatccgcgccgggagcccttggctgcgtcgcccggcagccgcgcctcgcgagaccgctgtctacggcgctgacgccgcctctgcctcttgaccccttggccccgctgtcctgatccctgaggtcggggcctggtctgcactccaggaaagacgagtgcgcttagtgtgcgctgcacgtgagcagtgaagttgattccacgcgctgcgctgctcggcagctgtcccagaactgaccacggacccctccgcgggtcctgctcctgacaagggccttccggcactgggagttttgtgttagtggaaaggaagaatctaataataccaccacctttacagtaaagacgctgcgaattgacgccttttataataaagacacttatcttgcccaagagctgggctggagtgtagtggcgcaatcttggatcaccacaacctccgtctcccaggttcaagcgattctcccgcctcagcctcctgagtagcaattacagggagcatttcctgaagacgtagtcatgcagcacgtcagcagctcccagagcagccagcgccatgtccagtggcctggggcctgccccggcgcgggcgaggagcagccagcgtgctcccagccgtccctgcccctcacactgccatcccccagccaccaactacagcagctgatggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacgcccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcattaccaggagatgcaggctctgaaggaggtcttcaaggagtatttgattgaactgtttttcttgcaacactttcaagggaacatgatggatttcttagctttcaaggagagactgtatggaccattacaagcatatcttaggcagaatgatttggacattgaagaagaggaggaggaggaggaagaggaggaagaaaaatctgaggttatcaatgacgaggtaaaggttgtgacaggaaaggatgggcagactgggactcccgttgctatagcaacccagcttccgccaaaggtttctgctgctttttcatcccagcagcaaccatttcagcaagccctcgcagggagcctggtagcaggggccggaagcacagtagagacggacctgtttaagaggcagcaggcgatgccctccacaggtatggcaggaggaatgccccccacgccgcaggccgcgcagctcgctggacagaggcagagtcagcagcagtatgacccctccacggggcctcccgtgcagaacgctgccagcttgcacaccccactgccgcagctgcccgggaggctgcccccagccggtgttcccactgcagccctctcctctgcgctgcagtttgcacagcagccgcaagtggtagaggcccagacacagctccaaatcccggtgaagactcagcagcccaatgttcccatccctgcaccgcccagcagccaactccccatccctccctcgcagcctgcacagctggccctccacgttcccacacctggaaaggtgcaggtgcaggcctctcagctttcctccctgccacagatggtagcatcgacaaggctccctgtggaccctgccccgccctgcccacggcctctgcccacctcttctacctcgtccctcgcgcctgtgagtggctccggcccaggaccctcccctgctcgatcctctccagtaaatagaccttcctcagccaccaataaggcactatctccagtcacttcccggaccccaggggtggtggcatctgcccccaccaaaccacagagtcctgctcagaatgccacctcgtcccaagacagttctcaggatacgctgacagaacaaataactctggagaaccaggtgcatcagcgcattgcggagctgaggaaagcaggtctgtggtcccagaggcgtctgccaaagctgcaggaggccccacgccccaagtcccactgggactatctgctggaggagatgcagtggatggccacagactttgcccaggagaggaggtggaaggtggctgctgcgaagaagctcgttagaactgtggtgcgccatcacgaggagaagcagctccgtgaagaaagggggaagaaggaagagcagagcagactgaggcggatagccgcctccacggcccgggagatagagtgcttttggtcgaatattgaacaggttgtggaaataaaactacgagtagaattagaagaaaaaaggaagaaggccttaaatttacagaaagtttccaggagagggaaagaattgagacctaaaggatttgacgcattacaggaaagttctctggattcaggaatgtctggaagaaaaagaaaagctagcatatctttgactgatgacgaagtggacgatgaagaggaaacaattgaagaggaggaagcaaatgaaggcgttgtggaccaccaaacagaactttctaatttagccaaggaagctgagctgcccctcctggacctgatgaagctgtacgaaggcgccttcctgccgagttctcagtggccccggccgaagcctgatggggaggacacaagcggagaggaagatgcagatgactgtccaggcgacagggagagtcgcaaggacttggttctcatcgactcgcttttcatcatggatcagttcaaagctgccgagaggatgaatatcgggaagccaaacgccaaggacattgcggacgtcactgcggtggctgaagccatcctgccgaagggcagtgctcgggtcacaacctcggtcaagtttaatgctccatctttgttgtatggggctctcagagattatcagaagattggcctggactggctggccaaactttacaggaagaatctcaatggcatattggcagatgaagctgggctgggtaaaacagtgcagatcattgctttttttgcccacctagcttgtaacgaaggtaattggggcccccatcttgttgttgtgagaagttgtaacatactcaagtgggagcttgaattgaaacgttggtgtcccggactcaaaatcctctcatatattggcagccacagagaactcaaagcaaagagacaggagtgggccgaacccaacagcttccacgtctgcatcacgtcctacactcagttcttccggggcctcaccgccttcacacgagtgcgctggaagtgcctggtcattgatgagatgcagcgcgtgaagggcatgaccgagaggcactgggaagcggttttcaccctgcagagccaacaacgtctgcttctgatcgactcgccgctgcacaataccttcctggagctctggaccatggtgcacttcctggtcccagggatctccaggccctacctgagctcccctctgagggcccccagtgaagagagccaggattactaccataaagtggtcataaggttacacagggtgacacagccatttattttgaggagaactaagagagatgtggaaaagcaactaacaaagaaatatgagcatgttttgaagtgtcgcctttctaaccgacaaaaagccttatacgaggacgttatcctgcaacctggcactcaggaggccttgaagagcgggcactttgtcaacgtcctgagcatccttgtgcggctgcagcgcatctgcaaccaccctgggctcgtcgagccccggcacccaggctcttcctacgtggcggggccactggagtatccgtccgcatctctaatcctgaaggcactggagagagatttctggaaggaagcagatctttctatgtttgatctcatcggcttagaaaataaaatcactcgtcacgaggcagagttgctgtctaagaaaaagataccgcggaaactcatggaggaaatctccacttcagcagccccagcagcccgaccagcagcagcaaagctgaaggccagcaggttgtttcagcctgtgcagtatggccagaagcccgagggtcgcaccgtggctttccccagcactcacccgccccggacggcagcccccaccacggcctctgctgctccacagggcccgcttcgaggacggccgcccatcgccacgttctctgccaatccggaggcaaaagcagcagcagccccgtttcagacctctcaggcttccgccagtgctccacgacaccagcccgcctcggcctccagcacagccgctagcccggcccatcctgcgaaactgcgggcccagaccacagcacaggccttcaccccaggccagcccccgccccagccccaggccccctcgcacgcggccgggcagagcgcgctgcctcagaggctggtgctcccctcgcaggcccaggcccgcttgcccagtggagaggtagtgaaaatagctcagctggcatccatcacaggaccacagagccgcgtggctcagccagagacgccggtgacactgcagttccagggcagcaagttcaccctgtcacacagccagctccggcagctcacagcgggccagccgctgcagctgcaaggcagcgtcctccagatcgtgtccgcccccgggcagccctaccttcgagcccctggccctgtggtgatgcagaccgtgtctcaggcgggcgctgtgcacggcgccctgggaagcaagcccccggccggcggtcccagccctgcacccttgaccccacaagttggcgttccgggccgcgtggcggtgaatgccttggctgtaggagaacccggaacggcctccaaaccagcttctcccattggagggccgacccaggaggaaaagaccagactcttgaaagagcgcctggatcagatttatttagtcaacgagcggcgctgttctcaagctccagtctatggcagagacttgctaaggatttgtgccctgcctagccatggaagggtacagtggcgtgggtccctggatggccgtcgtgggaaggaggccgggccagcgcacagttacacttcatcctcagaaagtccaagtgagctgatgttgacgctttgtcggtgtggagagtctctgcaggatgttattgacagggtggcctttgtgattcctccggtggtggcagcacccccgtccctacgggtgccgcggccgccacccctgtacagccacagaatgaggatcttgaggcagggcctgagagagcacgctgcgccgtacttccagcagctgcggcagaccacggctccacgcctgctgcagttccctgagctgaggctggtgcagttcgactcagggaagttggaagctttagctatcttgcttcagaaattgaaatctgaaggacgtcgggtgctgattttatcacagatgattcttatgttggacattttagagatgttcttgaacttccattacctcacctatgtaagaatcgatgaaaatgccagcagtgagcaacggcaggaactgatgaggagtttcaacagagacaggcggattttttgtgccattctctccactcacagccgtaccacaggtataaaccttgtagaggcggacaccgtcgtgttttatgacaatgacctgaatccagtgatggatgccaaagctcaggagtggtgcgataggatcgggagatgcaaagacatccacatatacaggcttgtgagtggcaattccattgaagagaaattgttgaaaaatggaactaaagatctgatccgagaagtggctgctcagggaaatgactactccatggctttcttaactcagcgaaccatccaggagctgtttgaagtttattctcccatggatgatgctggcttcccggtcaaagctgaggagtttgtggtgctttctcaggaaccttctgtcacggaaaccattgcacccaaaattgcaagacctttcatagaggccctcaagagtattgagtatctggaggaggatgcccagaagtccgcacaggagggggtgctgggaccacacactgatgctctgtcatcagactctgagaacatgccgtgtgatgaagaaccatcccaattagaggagctagctgacttcatggagcagcttacaccaattgaaaaatatgctttaaattacctggaattattccatacttctattgagcaagaaaaggagagaaacagtgaggacgcagtgatgactgcagtgagggcatgggagttctggaacctgaagaccctgcaggagagggaggcccggctgcggctggagcaggaggaggcggagctcctgacctacacgcgagaggatgcctacagcatggagtatgtctacgaagatgtcgatgggcagacagaagtcatgccgctctggaccccacccaccccgccgcaggacgacagcgacatctacctcgactcggtcatgtgtctcatgtatgaagccactcccatcccagaggctaagctgccccctgtgtacgtgaggaaggagcggaagcgacacaaaacagacccctcagctgcaggcaggaagaagaagcagcgtcacggggaggcggtcgtccctcctcggtccctgtttgaccgcgcaacaccaggacttctgaaaattcgcagagagggcaaggagcagaagaagaatattctgctgaagcagcaggtgccattcgccaagcccctgccaacttttgccaaacccacagctgagcctggtcaagacaaccccgagtggctcatcagtgaggactgggcgctgctgcaggctgtaaagcagttactggagctgcctttgaacctcacaatcgtgtcacctgctcacacacctaattgggatcttgtcagtgacgttgttaactcctgtagccgaatctaccgctcttccaaacagtgccggaatcgctacgagaatgtcatcattccacgagaggaggggaagagtaaaaacaaccgtcctctccgtacgagccagatctatgcccaggatgagaatgccacacacacccagctgtacacgagccactttgacttaatgaaaatgactgctggcaagaggagtcccccaatcaaacctctgcttggcatgaatccctttcagaagaaccccaagcacgcgtctgtgttggcagaaagtggaatcaactatgacaagccgctgcctcccatccaggtggcatctctccgtgcagagcgaatcgcaaaagagaaaaaggctctggctgatcagcagaaggcacagcagccggccgtggcccagccacccccgccccagccgcagcccccaccacccccgcagcagccaccgccaccgctgccacaaccacaggcagcgggcagccagccgccagcagggccaccagctgtccagccccaaccccagccacagccccagacccagccacagcctgtgcaggccccagcgaaggcgcagcccgcaatcacgacggggggcagtgcagccgtactggcaggaaccattaaaacatcagttactgggacgagcatgcccactggtgccgtgagtggaaatgtgatcgtgaacaccatcgcaggggtcccagctgccaccttccagtccatcaacaagcgcctggcgtcgccagtggctcctggggccttgactacgccgggaggctctgctcccgcccaggtggtgcacacccagcccccgccacgggcagtcggctccccagccacggcgacccctgacctggtgtccatggcaacgactcagggtgttcgagcggtcacttctgtgacagcctcggccgtggtcactaccaacctgaccccagtgcagaccccggcacggtctttggtgccccaagtgtcccaagccacaggagttcagctccctggaaaaaccatcacacctgcacatttccagcttctcaggcagcagcagcagcagcagcagcaacagcagcagcagcagcagcagcagcagcagcagcagcagcagcagcaacagcagcagcagcaacagacgacgacgacctctcaggtgcaagttccacagatccagggccaggcccagtccccagcacagatcaaagctgtgggcaagctgacgccggaacacctcatcaaaatgcagaagcagaaactgcagatgcccccgcagcccccaccgccacaggcccagtctgcgcccccgcagccagcagcccaagtgcaagtgcagacctcgcagccgccgcagcagcagagcccccagctcacgacggtcacggccccaaggcctggtgccctgctgacgggcaccaccgtggccaacctccaggtggcccggctcacccgggttcccacttctcaactgcagtcgcaagggcagatgcagacccaggcaccccagccagcccaggtgcccttggcgaagcctccggtggtgtccgtcccggcagctgtggtctcctcaccgggagtcaccaccctgcccatgaacgtcgcggggatcagcgtggcgatcggtcagccacagaaggcagcaggacagaccgtggtggcccagcccgtgcacatgcagcagctgctgaagctgaagcagcaggccgtccagcagcagaaggccatccagccccaggctgcacagggcccggcagccgtccagcagaagatcaccgcacagcagatcaccacccctggcgcgcagcagaaggttgcctacgccgcgcagccggcccttaagacccagtttcttaccacacccatctcccaggcccagaaactggccggggcccagcaagtgcagacccagatccaggttgcaaaacttcctcaagttgttcaacagcaaacacccgtggccagcatccagcaagttgcctctgcttcccagcaggcttctccacagactgtggcgctcacgcaggcgacggcggccgggcagcaggtgcagatgatccctgcagtgaccgcgactgcccaggtggttcagcagaaactcattcagcagcaggtggtgaccacggcgtcggccccgctccagactccaggcgctcccaacccagcccaggtgcccgccagctccgacagcccaagccagcagcccaagttacagatgagggtccctgctgtcaggctaaagacacctactaagcctccgtgccagtagtcagggcagcagggctgcctctcatctaaagcaaaactaccttcctcacagaaaacgctttattagtgaaccttgggaccatgtcacgcaagagattcagcactgggaaagatataattgaaacaaaatagtgtaatcattttattaaaatgcatcccacactgcaggacaaatggtccttatggagtgccgcgttctctgtactacgtggctcatggaaaaagtgacaacatggcttcctctaaatcatttcacctttcagtccccacccgcacccgtcccctagagccatagtactgtgttctgaaagccatttagaatttctttgtgagcatgtagtgctttgcacgccacagaagccgtctgccgtgtgtgaggagcatacaatggactttctaaagataaggcgtgggcttccacagtgtctgccagagtttagttctttataccttactgaaaaatgcctcgtggtcttcgcagaggggaaggcctgtctaaagtcaatcatccgagatgggttttccattccaaagaaaggcaatatggttccttccttccctcctaaaatatgacttaacttttaagagaaatgttctgacacccacctaaacacacaaggcacgttcctggcctgtgttcaagggaaatgatcagtcattgcattgttattccaaagagcagccaacagtggcctcccccaggccctaccctgcaatgggattcgctttcatttaatggaaacttctgggactgatgcccaactcagtgcactcaagacgcatctccagttttcgggggaagctggtatttgacatagtgtgttaaacagctcctgagaacctttgggacactctgccatggctggcgtgaggcccagaggaccacgcagaggcaatggtagtacagatgtcacagctgagggtacgatgaggcctgggctcagtgagccaggacgaatgtgacagacaccccttgctgccacagtcagccctttgacgaaggtgggctggtgattctggaagtattggctatagcggtgggcccagtcaactcttccttgtggacttacgacagcagattttctctaggataagcttgtgtggttctgccagtgaagcagagaaccacctgtgctgttgtggaaggcgtgccgttgagggggaaaacgaagcccagtatttgctactgtttttcctttttttactatgacaggaaaataaatgcaattttagtggaattgattgacagtgtctccttactttgaagttttcaccaaagcaaaaaggtccatatccaatagtatcctttgtgctgtggcttgattttggcctattttacattatttggtccaggaaattaggttatattaggttttttgtatactaaaaatcagttatggcacaataaagattttctgtttttaaattgtatttcatctgcttcctccccattctctcactttaagtgacattgaggaaggtattctgtcccacaggtttctgtggacagcgatacagcaggagtcagtgaaatcaactggggagctcacttgagctcttgataagaaatgtggagaaaagtaaaaaccaagctttgaagaaacagaagaaattaatcttttagttagttgaacataccaaagcagaggactggaatctgtttgttctaaccaacccgttctccctggcttggcacgtgccgtgagagcgcagcttgccggagggagggccgctgtgtgcgcctcacatctggctcccagtggaaacttttactcctcctcatccgcagatgtgatagaactgaagtatctaggaattctgcctttgtcatttgttttaatttgtgtgccctgttcattttttttgtctttcccaaatcttggtagtctccttatagttgaagataaaatgttgagtgcacttattttagaatatcctagacataactgtctaagtaaaagcgctctattaatctaaaacactacaagagaatttaacaccatctctcaaatgcttttttggagagcttaatgggattctgaatatttgcaatgtggagtttccgccccgatctcacgtcagtgagggtctcctgtctctcaagtgtgtttcctttggctgttccctaatacaaaacacggacatatttttactcgtagcactcaatttagtaacttctagatgctaccgttgacctgagttaaattcatttagtcgtgtacgtaaaaactctccttttagtgtgttattttcttggccttcccttttaaaggttaaagtttctaacctaagaattaagtacgcgttcaggaagctgttgtctaggccttccccttgtgaatctgggttcattccaatacggcaagtaagagttggaaactttgagaacacagactataaaggcagcagcccgaacactgtcagactctaattggcgaccctgggaaacagttgccctgctattctttaaagaaagacgtttattctgatgataaaaacagttagccagactgtttttaaagcacctggcgggaagcagaaggttggatccaagcccttgttcagatttggtgcctgataagacaggggtttctctttttgtgacctttattattattattttgttaactgttgtaaccagttagctgttgtgttttaagatagaaaggaacaagactaaaattgtaaatactttgtaaacatcagcatttgtacttgaatagtaggattttaaagggcattgatagcataccaaacaaaaggcaaaataaagtgacctttttataaaaaaaaaaagaaaaagtcgac

SEQ ID NO: 547893 - DNA, 10723 bp, Homo sapiens
agcggggcggcggcgcggcttccatcctcccgccctcctgacgcggccggagcgcagccctgaggcccagggagaacgacacattggatacagaagggaggtgatcatgcaccatggcactggcccccagaacgtccagcatcagctgcagaggtccagggcctgccctggcagcgagggtgaggagcagccggcccaccccaacccacccccgtcccccgcagctcccttcgctccctcagcaagcccgtcggcaccccagtctcccagttatcaaatacagcagctgatgaataggagccctgcaaccgggcagaacgtgaacatcaccctgcagagcgtgggccctgtcgtcgggggaaaccagcagatcacactggccccactgccgctccccagccccacctctccaggcttccagttcagcgctcagcctcggcggtttgagcatgggtctccatcatacattcaggtcacgtcccccttgtcccagcaggtccagacccagagtcccacgcagcccagtccggggccggggcaggccttgcagaatgtgcgtgcaggtgcccctggccctgggctgggcctctgcagcagcagccctacaggggacttcgtggatgccagcgtgctggtgaggcagatcagcttgagcccctccagtggtggacactttgtgtttcaggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacgcccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcattaccaggagatgcaggctctgaaggaggtcttcaaggagtatttgattgaactgtttttcttgcaacactttcaagggaacatgatggatttcttagctttcaaggagagactgtatggaccattacaagcatatcttaggcagaatgatttggacattgaagaagaggaggaggaggaggaagaggaggaagaaaaatctgaggttatcaatgacgagcagcaagccctcgcagggagcctggtagcaggggccggaagcacagtagagacggacctgtttaagaggcagcaggcgatgccctccacaggtatggcagagcagtctaagaggcctcgccttgaagtgggtcaccaaggggtagttttccagcacccaggggcggacgcaggcgttcctctccagcaactaatgccgaccgcacaaggaggaatgccccccacgccgcaggccgcgcagctcgctggacagaggcagagtcagcagcagtatgacccctccacggggcctcccgtgcagaacgctgccagcttgcacaccccactgccgcagctgcccgggaggctgcccccagccggtgttcccactgcagccctctcctctgcgctgcagtttgcacagcagccgcaagtggtagaggcccagacacagctccaaatcccggtgaagactcagcagcccaatgttcccatccctgcaccgcccagcagccaactccccatccctccctcgcagcctgcacagctggccctccacgttcccacacctggaaaggtgcaggtgcaggcctctcagctttcctccctgccacagatggtagcatcgacaaggctccctgtggaccctgccccgccctgcccacggcctctgcccacctcttctacctcgtccctcgcgcctgtgagtggctccggcccaggaccctcccctgctcgatcctctccagtaaatagaccttcctcagccaccaataaggcactatctccagtcacttcccggaccccaggggtggtggcatctgcccccaccaaaccacagagtcctgctcagaatgccacctcgtcccaagacagttctcaggatacgctgacagaacaaataactctggagaaccaggtgcatcagcgcattgcggagctgaggaaagcaggtctgtggtcccagaggcgtctgccaaagctgcaggaggccccacgccccaagtcccactgggactatctgctggaggagatgcagtggatggccacagactttgcccaggagaggaggtggaaggtggctgctgcgaagaagctcgttagaactgtggtgcgccatcacgaggagaagcagctccgtgaagaaagggggaagaaggaagagcagagcagactgaggcggatagccgcctccacggcccgggagatagagtgcttttggtcgaatattgaacaggttgtggaaataaaactacgagtagaattagaagaaaaaaggaagaaggccttaaatttacagaaagtttccaggagagggaaagaattgagacctaaaggatttgacgcattacaggaaagttctctggattcaggaatgtctggaagaaaaagaaaagctagcatatctttgactgatgacgaagtggacgatgaagaggaaacaattgaagaggaggaagcaaatgaaggcgttgtggaccaccaaacagaactttctaatttagccaaggaagctgagctgcccctcctggacctgatgaagctgtacgaaggcgccttcctgccgagttctcagtggccccggccgaagcctgatggggaggacacaagcggagaggaagatgcagatgactgtccaggcgacagggagagtcgcaaggacttggttctcatcgactcgcttttcatcatggatcagttcaaagctgccgagaggatgaatatcgggaagccaaacgccaaggacattgcggacgtcactgcggtggctgaagccatcctgccgaagggcagtgctcgggtcacaacctcggtcaagtttaatgctccatctttgttgtatggggctctcagagattatcagaagattggcctggactggctggccaaactttacaggaagaatctcaatggcatattggcagatgaagctgggctgggtaaaacagtgcagatcattgctttttttgcccacctagcttgtaacgaaggtaattggggcccccatcttgttgttgtgagaagttgtaacatactcaagtgggagcttgaattgaaacgttggtgtcccggactcaaaatcctctcatatattggcagccacagagaactcaaagcaaagagacaggagtgggccgaacccaacagcttccacgtctgcatcacgtcctacactcagttcttccggggcctcaccgccttcacacgagtgcgctggaagtgcctggtcattgatgagatgcagcgcgtgaagggcatgaccgagaggcactgggaagcggttttcaccctgcagagccaacaacgtctgcttctgatcgactcgccgctgcacaataccttcctggagctctggaccatggtgcacttcctggtcccagggatctccaggccctacctgagctcccctctgagggcccccagtgaagagagccaggattactaccataaagtggtcataaggttacacagggtgacacagccatttattttgaggagaactaagagagatgtggaaaagcaactaacaaagaaatatgagcatgttttgaagtgtcgcctttctaaccgacaaaaagccttatacgaggacgttatcctgcaacctggcactcaggaggccttgaagagcgggcactttgtcaacgtcctgagcatccttgtgcggctgcagcgcatctgcaaccaccctgggctcgtcgagccccggcacccaggctcttcctacgtggcggggccactggagtatccgtccgcatctctaatcctgaaggcactggagagagatttctggaaggaagcagatctttctatgtttgatctcatcggcttagaaaataaaatcactcgtcacgaggcagagttgctgtctaagaaaaagataccgcggaaactcatggaggaaatctccacttcagcagccccagcagcccgaccagcagcagcaaagctgaaggccagcaggttgtttcagcctgtgcagtatggccagaagcccgagggtcgcaccgtggctttccccagcactcacccgccccggacggcagcccccaccacggcctctgctgctccacagggcccgcttcgaggacggccgcccatcgccacgttctctgccaatccggaggcaaaagcagcagcagccccgtttcagacctctcaggcttccgccagtgctccacgacaccagcccgcctcggcctccagcacagccgctagcccggcccatcctgcgaaactgcgggcccagaccacagcacaggccttcaccccaggccagcccccgccccagccccaggccccctcgcacgcggccgggcagagcgcgctgcctcagaggctggtgctcccctcgcaggcccaggcccgcttgcccagtggagaggtagtgaaaatagctcagctggcatccatcacaggaccacagagccgcgtggctcagccagagacgccggtgacactgcagttccagggcagcaagttcaccctgtcacacagccagctccggcagctcacagcgggccagccgctgcagctgcaaggcagcgtcctccagatcgtgtccgcccccgggcagccctaccttcgagcccctggccctgtggtgatgcagaccgtgtctcaggcgggcgctgtgcacggcgccctgggaagcaagcccccggccggcggtcccagccctgcacccttgaccccacaagttggcgttccgggccgcgtggcggtgaatgccttggctgtaggagaacccggaacggcctccaaaccagcttctcccattggagggccgacccaggaggaaaagaccagactcttgaaagagcgcctggatcagatttatttagtcaacgagcggcgctgttctcaagctccagtctatggcagagacttgctaaggatttgtgccctgcctagccatggaagggtacagtggcgtgggtccctggatggccgtcgtgggaaggaggccgggccagcgcacagttacacttcatcctcagaaagtccaagtgagctgatgttgacgctttgtcggtgtggagagtctctgcaggatgttattgacagggtggcctttgtgattcctccggtggtggcagcacccccgtccctacgggtgccgcggccgccacccctgtacagccacagaatgaggatcttgaggcagggcctgagagagcacgctgcgccgtacttccagcagctgcggcagaccacggctccacgcctgctgcagttccctgagctgaggctggtgcagttcgactcagggaagttggaagctttagctatcttgcttcagaaattgaaatctgaaggacgtcgggtgctgattttatcacagatgattcttatgttggacattttagagatgttcttgaacttccattacctcacctatgtaagaatcgatgaaaatgccagcagtgagcaacggcaggaactgatgaggagtttcaacagagacaggcggattttttgtgccattctctccactcacagccgtaccacaggtataaaccttgtagaggcggacaccgtcgtgttttatgacaatgacctgaatccagtgatggatgccaaagctcaggagtggtgcgataggatcgggagatgcaaagacatccacatatacaggcttgtgagtggcaattccattgaagagaaattgttgaaaaatggaactaaagatctgatccgagaagtggctgctcagggaaatgactactccatggctttcttaactcagcgaaccatccaggagctgtttgaagtttattctcccatggatgatgctggcttcccggtcaaagctgaggagtttgtggtgctttctcaggaaccttctgtcacggaaaccattgcacccaaaattgcaagacctttcatagaggccctcaagagtattgagtatctggaggaggatgcccagaagtccgcacaggagggggtgctgggaccacacactgatgctctgtcatcagactctgagaacatgccgtgtgatgaagaaccatcccaattagaggagctagctgacttcatggagcagcttacaccaattgaaaaatatgctttaaattacctggaattattccatacttctattgagcaagaaaaggagagaaacagtgaggacgcagtgatgactgcagtgagggcatgggagttctggaacctgaagaccctgcaggagagggaggcccggctgcggctggagcaggaggaggcggagctcctgacctacacgcgagaggatgcctacagcatggagtatgtctacgaagatgtcgatgggcagacagaagtcatgccgctctggaccccacccaccccgccgcaggacgacagcgacatctacctcgactcggtcatgtgtctcatgtatgaagccactcccatcccagaggctaagctgccccctgtgtacgtgaggaaggagcggaagcgacacaaaacagacccctcagctgcaggcaggaagaagaagcagcgtcacggggaggcggtcgtccctcctcggtccctgtttgaccgcgcaacaccaggacttctgaaaattcgcagagagggcaaggagcagaagaagaatattctgctgaagcagcaggtgccattcgccaagcccctgccaacttttgccaaacccacagctgagcctggtcaagacaaccccgagtggctcatcagtgaggactgggcgctgctgcaggctgtaaagcagttactggagctgcctttgaacctcacaatcgtgtcacctgctcacacacctaattgggatcttgtcagtgacgttgttaactcctgtagccgaatctaccgctcttccaaacagtgccggaatcgctacgagaatgtcatcattccacgagaggaggggaagagtaaaaacaaccgtcctctccgtacgagccagatctatgcccaggatgagaatgccacacacacccagctgtacacgagccactttgacttaatgaaaatgactgctggcaagaggagtcccccaatcaaacctctgcttggcatgaatccctttcagaagaaccccaagcacgcgtctgtgttggcagaaagtggaatcaactatgacaagccgctgcctcccatccaggtggcatctctccgtgcagagcgaatcgcaaaagagaaaaaggctctggctgatcagcagaaggcacagcagccggccgtggcccagccacccccgccccagccgcagcccccaccacccccgcagcagccaccgccaccgctgccacaaccacaggcagcgggcagccagccgccagcagggccaccagctgtccagccccaaccccagccacagccccagacccagccacagcctgtgcaggccccagcgaaggcgcagcccgcaatcacgacggggggcagtgcagccgtactggcaggaaccattaaaacatcagttactgggacgagcatgcccactggtgccgtgagtggaaatgtgatcgtgaacaccatcgcaggggtcccagctgccaccttccagtccatcaacaagcgcctggcgtcgccagtggctcctggggccttgactacgccgggaggctctgctcccgcccaggtggtgcacacccagcccccgccacgggcagtcggctccccagccacggcgacccctgacctggtgtccatggcaacgactcagggtgttcgagcggtcacttctgtgacagcctcggccgtggtcactaccaacctgaccccagtgcagaccccggcacggtctttggtgccccaagtgtcccaagccacaggagttcagctccctggaaaaaccatcacacctgcacatttccagcttctcaggcagcagcagcagcagcagcagcaacagcagcagcagcagcagcagcagcagcagcagcagcagcagcagcaacagcagcagcagcaacagacgacgacgacctctcaggtgcaagttccacagatccagggccaggcccagtccccagcacagatcaaagctgtgggcaagctgacgccggaacacctcatcaaaatgcagaagcagaaactgcagatgcccccgcagcccccaccgccacaggcccagtctgcgcccccgcagccagcagcccaagtgcaagtgcagacctcgcagccgccgcagcagcagagcccccagctcacgacggtcacggccccaaggcctggtgccctgctgacgggcaccaccgtggccaacctccaggtggcccggctcacccgggttcccacttctcaactgcagtcgcaagggcagatgcagacccaggcaccccagccagcccaggtgcccttggcgaagcctccggtggtgtccgtcccggcagctgtggtctcctcaccgggagtcaccaccctgcccatgaacgtcgcggggatcagcgtggcgatcggtcagccacagaaggcagcaggacagaccgtggtggcccagcccgtgcacatgcagcagctgctgaagctgaagcagcaggccgtccagcagcagaaggccatccagccccaggctgcacagggcccggcagccgtccagcagaagatcaccgcacagcagatcaccacccctggcgcgcagcagaaggttgcctacgccgcgcagccggcccttaagacccagtttcttaccacacccatctcccaggcccagaaactggccggggcccagcaagtgcagacccagatccaggttgcaaaacttcctcaagttgttcaacagcaaacacccgtggccagcatccagcaagttgcctctgcttcccagcaggcttctccacagactgtggcgctcacgcaggcgacggcggccgggcagcaggtgcagatgatccctgcagtgaccgcgactgcccaggtggttcagcagaaactcattcagcagcaggtggtgaccacggcgtcggccccgctccagactccaggcgctcccaacccagcccaggtgcccgccagctccgacagcccaagccagcagcccaagttacagatgagggtccctgctgtcaggctaaagacacctactaagcctccgtgccagtagtcagggcagcagggctgcctctcatctaaagcaaaactaccttcctcacagaaaacgctttattagtgaaccttgggaccatgtcacgcaagagattcagcactgggaaagatataattgaaacaaaatagtgtaatcattttattaaaatgcatcccacactgcaggacaaatggtccttatggagtgccgcgttctctgtactacgtggctcatggaaaaagtgacaacatggcttcctctaaatcatttcacctttcagtccccacccgcacccgtcccctagagccatagtactgtgttctgaaagccatttagaatttctttgtgagcatgtagtgctttgcacgccacagaagccgtctgccgtgtgtgaggagcatacaatggactttctaaagataaggcgtgggcttccacagtgtctgccagagtttagttctttataccttactgaaaaatgcctcgtggtcttcgcagaggggaaggcctgtctaaagtcaatcatccgagatgggttttccattccaaagaaaggcaatatggttccttccttccctcctaaaatatgacttaacttttaagagaaatgttctgacacccacctaaacacacaaggcacgttcctggcctgtgttcaagggaaatgatcagtcattgcattgttattccaaagagcagccaacagtggcctcccccaggccctaccctgcaatgggattcgctttcatttaatggaaacttctgggactgatgcccaactcagtgcactcaagacgcatctccagttttcgggggaagctggtatttgacatagtgtgttaaacagctcctgagaacctttgggacactctgccatggctggcgtgaggcccagaggaccacgcagaggcaatggtagtacagatgtcacagctgagggtacgatgaggcctgggctcagtgagccaggacgaatgtgacagacaccccttgctgccacagtcagccctttgacgaaggtgggctggtgattctggaagtattggctatagcggtgggcccagtcaactcttccttgtggacttacgacagcagattttctctaggataagcttgtgtggttctgccagtgaagcagagaaccacctgtgctgttgtggaaggcgtgccgttgagggggaaaacgaagcccagtatttgctactgtttttcctttttttactatgacaggaaaataaatgcaattttagtggaattgat

SEQ ID NO: 547894 - DNA, 311 bp, Homo sapiens
tatagatggaacgcgcaccccagagatacagctgatatcgggagggttgtttccaccatggaggaatggcacgtgctacaactcaggactttcttgctgtgccatagccagttgctgataacatttaccagcacactcaccgaacttaaggagtggctccttccagtcttatcatccacatcttgcttcttcctgggggacaatgtttgccagaaatgggagagagagggccagaaagtatgttacaccaacagcacgcccccgaaaatggactggaggttcttcatggaaacaaagaatggagatagagg

SEQ ID NO: 547895 - DNA, 12301 bp, Homo sapiens
ctggctccgcgtcggccggtcggtttggtcggttgtagtggcctcgccgcccggtccgctgtcgcagcgctcatccgcgccgggagcccttggctgcgtcgcccggcagccgcctggagtgtagtggcgcaatcttggatcaccacaacctccgtctcccaggttcaagcgattctcccgcctcagcctcctgagtagcaattacaattacaggccgagtctcactctgtcgcccaggatggagtgcagtggcgcaatgtcggcttactgcaacctctgcctcccaggttcaagcgattctcctgcctcagcctccagagtacctgggattacagggagcatttcctgaagacgtagtcatgcagcacgtcagcagctcccagagcagccagcgccatgtccagtggcctggggcctgccccggcgcgggcgaggagcagccagcgtgctcccagccgtccctgcccctcacactgccatcccccagccaccaactacagcagctgatggtccagacccagagtcccacgcagcccagtccggggccggggcaggccttgcagaatgtgcgtgcaggtgcccctggccctgggctgggcctctgcagcagcagccctacaggggacttcgtggatgccagcgtgctggtgaggcagatcagcttgagcccctccagtggtggacactttgtgtttcaggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacgcccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcattaccaggagatgcaggctctgaaggaggtcttcaaggagtatttgattgaactgtttttcttgcaacactttcaagggaacatgatggatttcttagctttcaaggagagactgtatggaccattacaagcatatcttaggcagaatgatttggacattgaagaagaggaggaggaggaggaagaggaggaagaaaaatctgaggttatcaatgacgaggtaaaggttgtgacaggaaaggatgggcagactgggactcccgttgctatagcaacccagcttccgccaaaggtttctgctgctttttcatcccagcagcaaccatttcagcaagccctcgcagggagcctggtagcaggggccggaagcacagtagagacggacctgtttaagaggcagcaggcgatgccctccacaggtatggcaggaggaatgccccccacgccgcaggccgcgcagctcgctggacagaggcagagtcagcagcagtatgacccctccacggggcctcccgtgcagaacgctgccagcttgcacaccccactgccgcagctgcccgggaggctgcccccagccggtgttcccactgcagccctctcctctgcgctgcagtttgcacagcagccgcaagtggtagaggcccagacacagctccaaatcccggtgaagactcagcagcccaatgttcccatccctgcaccgcccagcagccaactccccatccctccctcgcagcctgcacagctggccctccacgttcccacacctggaaaggtgcaggtgcaggcctctcagctttcctccctgccacagatggtagcatcgacaaggctccctgtggaccctgccccgccctgcccacggcctctgcccacctcttctacctcgtccctcgcgcctgtgagtggctccggcccaggaccctcccctgctcgatcctctccagtaaatagaccttcctcagccaccaataaggcactatctccagtcacttcccggaccccaggggtggtggcatctgcccccaccaaaccacagagtcctgctcagaatgccacctcgtcccaagacagttctcaggatacgctgacagaacaaataactctggagaaccaggtgcatcagcgcattgcggagctgaggaaagcaggtctgtggtcccagaggcgtctgccaaagctgcaggaggccccacgccccaagtcccactgggactatctgctggaggagatgcagtggatggccacagactttgcccaggagaggaggtggaaggtggctgctgcgaagaagctcgttagaactgtggtgcgccatcacgaggagaagcagctccgtgaagaaagggggaagaaggaagagcagagcagactgaggcggatagccgcctccacggcccgggagatagagtgcttttggtcgaatattgaacaggttgtggaaataaaactacgagtagaattagaagaaaaaaggaagaaggccttaaatttacagaaagtttccaggagagggaaagaattgagacctaaaggatttgacgcattacaggaaagttctctggattcaggaatgtctggaagaaaaagaaaagctagcatatctttgactgatgacgaagtggacgatgaagaggaaacaattgaagaggaggaagcaaatgaaggcgttgtggaccaccaaacagaactttctaatttagccaaggaagctgagctgcccctcctggacctgatgaagctgtacgaaggcgccttcctgccgagttctcagtggccccggccgaagcctgatggggaggacacaagcggagaggaagatgcagatgactgtccaggcgacagggagagtcgcaaggacttggttctcatcgactcgcttttcatcatggatcagttcaaagctgccgagaggatgaatatcgggaagccaaacgccaaggacattgcggacgtcactgcggtggctgaagccatcctgccgaagggcagtgctcgggtcacaacctcggtcaagtttaatgctccatctttgttgtatggggctctcagagattatcagaagattggcctggactggctggccaaactttacaggaagaatctcaatggcatattggcagatgaagctgggctgggtaaaacagtgcagatcattgctttttttgcccacctagcttgtaacgaaggtaattggggcccccatcttgttgttgtgagaagttgtaacatactcaagtgggagcttgaattgaaacgttggtgtcccggactcaaaatcctctcatatattggcagccacagagaactcaaagcaaagagacaggagtgggccgaacccaacagcttccacgtctgcatcacgtcctacactcagttcttccggggcctcaccgccttcacacgagtgcgctggaagtgcctggtcattgatgagatgcagcgcgtgaagggcatgaccgagaggcactgggaagcggttttcaccctgcagagccaacaacgtctgcttctgatcgactcgccgctgcacaataccttcctggagctctggaccatggtgcacttcctggtcccagggatctccaggccctacctgagctcccctctgagggcccccagtgaagagagccaggattactaccataaagtggtcataaggttacacagggtgacacagccatttattttgaggagaactaagagagatgtggaaaagcaactaacaaagaaatatgagcatgttttgaagtgtcgcctttctaaccgacaaaaagccttatacgaggacgttatcctgcaacctggcactcaggaggccttgaagagcgggcactttgtcaacgtcctgagcatccttgtgcggctgcagcgcatctgcaaccaccctgggctcgtcgagccccggcacccaggctcttcctacgtggcggggccactggagtatccgtccgcatctctaatcctgaaggcactggagagagatttctggaaggaagcagatctttctatgtttgatctcatcggcttagaaaataaaatcactcgtcacgaggcagagttgctgtctaagaaaaagataccgcggaaactcatggaggaaatctccacttcagcagccccagcagcccgaccagcagcagcaaagctgaaggccagcaggttgtttcagcctgtgcagtatggccagaagcccgagggtcgcaccgtggctttccccagcactcacccgccccggacggcagcccccaccacggcctctgctgctccacagggcccgcttcgaggacggccgcccatcgccacgttctctgccaatccggaggcaaaagcagcagcagccccgtttcagacctctcaggcttccgccagtgctccacgacaccagcccgcctcggcctccagcacagccgctagcccggcccatcctgcgaaactgcgggcccagaccacagcacaggccttcaccccaggccagcccccgccccagccccaggccccctcgcacgcggccgggcagagcgcgctgcctcagaggctggtgctcccctcgcaggcccaggcccgcttgcccagtggagaggtagtgaaaatagctcagctggcatccatcacaggaccacagagccgcgtggctcagccagagacgccggtgacactgcagttccagggcagcaagttcaccctgtcacacagccagctccggcagctcacagcgggccagccgctgcagctgcaaggcagcgtcctccagatcgtgtccgcccccgggcagccctaccttcgagcccctggccctgtggtgatgcagaccgtgtctcaggcgggcgctgtgcacggcgccctgggaagcaagcccccggccggcggtcccagccctgcacccttgaccccacaagttggcgttccgggccgcgtggcggtgaatgccttggctgtaggagaacccggaacggcctccaaaccagcttctcccattggagggccgacccaggaggaaaagaccagactcttgaaagagcgcctggatcagatttatttagtcaacgagcggcgctgttctcaagctccagtctatggcagagacttgctaaggatttgtgccctgcctagccatggaagggtacagtggcgtgggtccctggatggccgtcgtgggaaggaggccgggccagcgcacagttacacttcatcctcagaaagtccaagtgagctgatgttgacgctttgtcggtgtggagagtctctgcaggatgttattgacagggtggcctttgtgattcctccggtggtggcagcacccccgtccctacgggtgccgcggccgccacccctgtacagccacagaatgaggatcttgaggcagggcctgagagagcacgctgcgccgtacttccagcagctgcggcagaccacggctccacgcctgctgcagttccctgagctgaggctggtgcagttcgactcagggaagttggaagctttagctatcttgcttcagaaattgaaatctgaaggacgtcgggtgctgattttatcacagatgattcttatgttggacattttagagatgttcttgaacttccattacctcacctatgtaagaatcgatgaaaatgccagcagtgagcaacggcaggaactgatgaggagtttcaacagagacaggcggattttttgtgccattctctccactcacagccgtaccacaggtataaaccttgtagaggcggacaccgtcgtgttttatgacaatgacctgaatccagtgatggatgccaaagctcaggagtggtgcgataggatcgggagatgcaaagacatccacatatacaggcttgtgagtggcaattccattgaagagaaattgttgaaaaatggaactaaagatctgatccgagaagtggctgctcagggaaatgactactccatggctttcttaactcagcgaaccatccaggagctgtttgaagtttattctcccatggatgatgctggcttcccggtcaaagctgaggagtttgtggtgctttctcaggaaccttctgtcacggaaaccattgcacccaaaattgcaagacctttcatagaggccctcaagagtattgagtatctggaggaggatgcccagaagtccgcacaggagggggtgctgggaccacacactgatgctctgtcatcagactctgagaacatgccgtgtgatgaagaaccatcccaattagaggagctagctgacttcatggagcagcttacaccaattgaaaaatatgctttaaattacctggaattattccatacttctattgagcaagaaaaggagagaaacagtgaggacgcagtgatgactgcagtgagggcatgggagttctggaacctgaagaccctgcaggagagggaggcccggctgcggctggagcaggaggaggcggagctcctgacctacacgcgagaggatgcctacagcatggagtatgtctacgaagatgtcgatgggcagacagaagtcatgccgctctggaccccacccaccccgccgcaggacgacagcgacatctacctcgactcggtcatgtgtctcatgtatgaagccactcccatcccagaggctaagctgccccctgtgtacgtgaggaaggagcggaagcgacacaaaacagacccctcagctgcaggcaggaagaagaagcagcgtcacggggaggcggtcgtccctcctcggtccctgtttgaccgcgcaacaccaggacttctgaaaattcgcagagagggcaaggagcagaagaagaatattctgctgaagcagcaggtgccattcgccaagcccctgccaacttttgccaaacccacagctgagcctggtcaagacaaccccgagtggctcatcagtgaggactgggcgctgctgcaggctgtaaagcagttactggagctgcctttgaacctcacaatcgtgtcacctgctcacacacctaattgggatcttgtcagtgacgttgttaactcctgtagccgaatctaccgctcttccaaacagtgccggaatcgctacgagaatgtcatcattccacgagaggaggggaagagtaaaaacaaccgtcctctccgtacgagccagatctatgcccaggatgagaatgccacacacacccagctgtacacgagccactttgacttaatgaaaatgactgctggcaagaggagtcccccaatcaaacctctgcttggcatgaatccctttcagaagaaccccaagcacgcgtctgtgttggcagaaagtggaatcaactatgacaagccgctgcctcccatccaggtggcatctctccgtgcagagcgaatcgcaaaagagaaaaaggctctggctgatcagcagaaggcacagcagccggccgtggcccagccacccccgccccagccgcagcccccaccacccccgcagcagccaccgccaccgctgccacaaccacaggcagcgggcagccagccgccagcagggccaccagctgtccagccccaaccccagccacagccccagacccagccacagcctgtgcaggccccagcgaaggcgcagcccgcaatcacgacggggggcagtgcagccgtactggcaggaaccattaaaacatcagttactgggacgagcatgcccactggtgccgtgagtggaaatgtgatcgtgaacaccatcgcaggggtcccagctgccaccttccagtccatcaacaagcgcctggcgtcgccagtggctcctggggccttgactacgccgggaggctctgctcccgcccaggtggtgcacacccagcccccgccacgggcagtcggctccccagccacggcgacccctgacctggtgtccatggcaacgactcagggtgttcgagcggtcacttctgtgacagcctcggccgtggtcactaccaacctgaccccagtgcagaccccggcacggtctttggtgccccaagtgtcccaagccacaggagttcagctccctggaaaaaccatcacacctgcacatttccagcttctcaggcagcagcagcagcagcagcagcaacagcagcagcagcagcagcagcagcagcagcagcagcagcagcagcaacagcagcagcagcaacagacgacgacgacctctcaggtgcaagttccacagatccagggccaggcccagtccccagcacagatcaaagctgtgggcaagctgacgccggaacacctcatcaaaatgcagaagcagaaactgcagatgcccccgcagcccccaccgccacaggcccagtctgcgcccccgcagccagcagcccaagtgcaagtgcagacctcgcagccgccgcagcagcagagcccccagctcacgacggtcacggccccaaggcctggtgccctgctgacgggcaccaccgtggccaacctccaggtggcccggctcacccgggttcccacttctcaactgcagtcgcaagggcagatgcagacccaggcaccccagccagcccaggtgcccttggcgaagcctccggtggtgtccgtcccggcagctgtggtctcctcaccgggagtcaccaccctgcccatgaacgtcgcggggatcagcgtggcgatcggtcagccacagaaggcagcaggacagaccgtggtggcccagcccgtgcacatgcagcagctgctgaagctgaagcagcaggccgtccagcagcagaaggccatccagccccaggctgcacagggcccggcagccgtccagcagaagatcaccgcacagcagatcaccacccctggcgcgcagcagaaggttgcctacgccgcgcagccggcccttaagacccagtttcttaccacacccatctcccaggcccagaaactggccggggcccagcaagtgcagacccagatccaggttgcaaaacttcctcaagttgttcaacagcaaacacccgtggccagcatccagcaagttgcctctgcttcccagcaggcttctccacagactgtggcgctcacgcaggcgacggcggccgggcagcaggtgcagatgatccctgcagtgaccgcgactgcccaggtggttcagcagaaactcattcagcagcaggtggtgaccacggcgtcggccccgctccagactccaggcgctcccaacccagcccaggtgcccgccagctccgacagcccaagccagcagcccaagttacagatgagggtccctgctgtcaggctaaagacacctactaagcctccgtgccagtagtcagggcagcagggctgcctctcatctaaagcaaaactaccttcctcacagaaaacgctttattagtgaaccttgggaccatgtcacgcaagagattcagcactgggaaagatataattgaaacaaaatagtgtaatcattttattaaaatgcatcccacactgcaggacaaatggtccttatggagtgccgcgttctctgtactacgtggctcatggaaaaagtgacaacatggcttcctctaaatcatttcacctttcagtccccacccgcacccgtcccctagagccatagtactgtgttctgaaagccatttagaatttctttgtgagcatgtagtgctttgcacgccacagaagccgtctgccgtgtgtgaggagcatacaatggactttctaaagataaggcgtgggcttccacagtgtctgccagagtttagttctttataccttactgaaaaatgcctcgtggtcttcgcagaggggaaggcctgtctaaagtcaatcatccgagatgggttttccattccaaagaaaggcaatatggttccttccttccctcctaaaatatgacttaacttttaagagaaatgttctgacacccacctaaacacacaaggcacgttcctggcctgtgttcaagggaaatgatcagtcattgcattgttattccaaagagcagccaacagtggcctcccccaggccctaccctgcaatgggattcgctttcatttaatggaaacttctgggactgatgcccaactcagtgcactcaagacgcatctccagttttcgggggaagctggtatttgacatagtgtgttaaacagctcctgagaacctttgggacactctgccatggctggcgtgaggcccagaggaccacgcagaggcaatggtagtacagatgtcacagctgagggtacgatgaggcctgggctcagtgagccaggacgaatgtgacagacaccccttgctgccacagtcagccctttgacgaaggtgggctggtgattctggaagtattggctatagcggtgggcccagtcaactcttccttgtggacttacgacagcagattttctctaggataagcttgtgtggttctgccagtgaagcagagaaccacctgtgctgttgtggaaggcgtgccgttgagggggaaaacgaagcccagtatttgctactgtttttcctttttttactatgacaggaaaataaatgcaattttagtggaattgattgacagtgtctccttactttgaagttttcaccaaagcaaaaaggtccatatccaatagtatcctttgtgctgtggcttgattttggcctattttacattatttggtccaggaaattaggttatattaggttttttgtatactaaaaatcagttatggcacaataaagattttctgtttttaaattgtatttcatctgcttcctccccattctctcactttaagtgacattgaggaaggtattctgtcccacaggtttctgtggacagcgatacagcaggagtcagtgaaatcaactggggagctcacttgagctcttgataagaaatgtggagaaaagtaaaaaccaagctttgaagaaacagaagaaattaatcttttagttagttgaacataccaaagcagaggactggaatctgtttgttctaaccaacccgttctccctggcttggcacgtgccgtgagagcgcagcttgccggagggagggccgctgtgtgcgcctcacatctggctcccagtggaaacttttactcctcctcatccgcagatgtgatagaactgaagtatctaggaattctgcctttgtcatttgttttaatttgtgtgccctgttcattttttttgtctttcccaaatcttggtagtctccttatagttgaagataaaatgttgagtgcacttattttagaatatcctagacataactgtctaagtaaaagcgctctattaatctaaaacactacaagagaatttaacaccatctctcaaatgcttttttggagagcttaatgggattctgaatatttgcaatgtggagtttccgccccgatctcacgtcagtgagggtctcctgtctctcaagtgtgtttcctttggctgttccctaatacaaaacacggacatatttttactcgtagcactcaatttagtaacttctagatgctaccgttgacctgagttaaattcatttagtcgtgtacgtaaaaactctccttttagtgtgttattttcttggccttcccttttaaaggttaaagtttctaacctaagaattaagtacgcgttcaggaagctgttgtctaggccttccccttgtgaatctgggttcattccaatacggcaagtaagagttggaaactttgagaacacagactataaaggcagcagcccgaacactgtcagactctaattggcgaccctgggaaacagttgccctgctattctttaaagaaagacgtttattctgatgataaaaacagttagccagactgtttttaaagcacctggcgggaagcagaaggttggatccaagcccttgttcagatttggtgcctgataagacaggggtttctctttttgtgacctttattattattattttgttaactgttgtaaccagttagctgttgtgttttaagatagaaaggaacaagactaaaattgtaaatactttgtaaacatcagcatttgtacttgaatagtaggattttaaagggcattgatagcataccaaacaaaaggcaaaataaagtgacctttttataaaaaaaaaaagaaaaagtcgac

SEQ ID NO: 547896 - DNA, 12248 bp, Homo sapiens
ctggctccgcgtcggccggtcggtttggtcggttgtagtggcctcgccgcccggtccgctgtcgcagcgctcatccgcgccgggagcccttggctgcgtcgcccggcagccgccaccacctttacagtaaagacgctgcgaattgacgccttttataataaagacacttatcttgcccaagagctgggctggagtgtagtggcgcaatcttggatcaccacaacctccgtctcccaggttcaagcgattctcccgcctcagcctcctgagtagcaattacagggagcatttcctgaagacgtagtcatgcagcacgtcagcagctcccagagcagccagcgccatgtccagtggcctggggcctgccccggcgcgggcgaggagcagccagcgtgctcccagccgtccctgcccctcacactgccatcccccagccaccaactacagcagctgatggtccagacccagagtcccacgcagcccagtccggggccggggcaggccttgcagaatgtgcgtgcaggtgcccctggccctgggctgggcctctgcagcagcagccctacaggggacttcgtggatgccagcgtgctggtgaggcagatcagcttgagcccctccagtggtggacactttgtgtttcaggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacgcccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcattaccaggagatgcaggctctgaaggaggtcttcaaggagtatttgattgaactgtttttcttgcaacactttcaagggaacatgatggatttcttagctttcaaggagagactgtatggaccattacaagcatatcttaggcagaatgatttggacattgaagaagaggaggaggaggaggaagaggaggaagaaaaatctgaggttatcaatgacgaggtaaaggttgtgacaggaaaggatgggcagactgggactcccgttgctatagcaacccagcttccgccaaaggtttctgctgctttttcatcccagcagcaaccatttcagcaagccctcgcagggagcctggtagcaggggccggaagcacagtagagacggacctgtttaagaggcagcaggcgatgccctccacaggtatggcaggaggaatgccccccacgccgcaggccgcgcagctcgctggacagaggcagagtcagcagcagtatgacccctccacggggcctcccgtgcagaacgctgccagcttgcacaccccactgccgcagctgcccgggaggctgcccccagccggtgttcccactgcagccctctcctctgcgctgcagtttgcacagcagccgcaagtggtagaggcccagacacagctccaaatcccggtgaagactcagcagcccaatgttcccatccctgcaccgcccagcagccaactccccatccctccctcgcagcctgcacagctggccctccacgttcccacacctggaaaggtgcaggtgcaggcctctcagctttcctccctgccacagatggtagcatcgacaaggctccctgtggaccctgccccgccctgcccacggcctctgcccacctcttctacctcgtccctcgcgcctgtgagtggctccggcccaggaccctcccctgctcgatcctctccagtaaatagaccttcctcagccaccaataaggcactatctccagtcacttcccggaccccaggggtggtggcatctgcccccaccaaaccacagagtcctgctcagaatgccacctcgtcccaagacagttctcaggatacgctgacagaacaaataactctggagaaccaggtgcatcagcgcattgcggagctgaggaaagcaggtctgtggtcccagaggcgtctgccaaagctgcaggaggccccacgccccaagtcccactgggactatctgctggaggagatgcagtggatggccacagactttgcccaggagaggaggtggaaggtggctgctgcgaagaagctcgttagaactgtggtgcgccatcacgaggagaagcagctccgtgaagaaagggggaagaaggaagagcagagcagactgaggcggatagccgcctccacggcccgggagatagagtgcttttggtcgaatattgaacaggttgtggaaataaaactacgagtagaattagaagaaaaaaggaagaaggccttaaatttacagaaagtttccaggagagggaaagaattgagacctaaaggatttgacgcattacaggaaagttctctggattcaggaatgtctggaagaaaaagaaaagctagcatatctttgactgatgacgaagtggacgatgaagaggaaacaattgaagaggaggaagcaaatgaaggcgttgtggaccaccaaacagaactttctaatttagccaaggaagctgagctgcccctcctggacctgatgaagctgtacgaaggcgccttcctgccgagttctcagtggccccggccgaagcctgatggggaggacacaagcggagaggaagatgcagatgactgtccaggcgacagggagagtcgcaaggacttggttctcatcgactcgcttttcatcatggatcagttcaaagctgccgagaggatgaatatcgggaagccaaacgccaaggacattgcggacgtcactgcggtggctgaagccatcctgccgaagggcagtgctcgggtcacaacctcggtcaagtttaatgctccatctttgttgtatggggctctcagagattatcagaagattggcctggactggctggccaaactttacaggaagaatctcaatggcatattggcagatgaagctgggctgggtaaaacagtgcagatcattgctttttttgcccacctagcttgtaacgaaggtaattggggcccccatcttgttgttgtgagaagttgtaacatactcaagtgggagcttgaattgaaacgttggtgtcccggactcaaaatcctctcatatattggcagccacagagaactcaaagcaaagagacaggagtgggccgaacccaacagcttccacgtctgcatcacgtcctacactcagttcttccggggcctcaccgccttcacacgagtgcgctggaagtgcctggtcattgatgagatgcagcgcgtgaagggcatgaccgagaggcactgggaagcggttttcaccctgcagagccaacaacgtctgcttctgatcgactcgccgctgcacaataccttcctggagctctggaccatggtgcacttcctggtcccagggatctccaggccctacctgagctcccctctgagggcccccagtgaagagagccaggattactaccataaagtggtcataaggttacacagggtgacacagccatttattttgaggagaactaagagagatgtggaaaagcaactaacaaagaaatatgagcatgttttgaagtgtcgcctttctaaccgacaaaaagccttatacgaggacgttatcctgcaacctggcactcaggaggccttgaagagcgggcactttgtcaacgtcctgagcatccttgtgcggctgcagcgcatctgcaaccaccctgggctcgtcgagccccggcacccaggctcttcctacgtggcggggccactggagtatccgtccgcatctctaatcctgaaggcactggagagagatttctggaaggaagcagatctttctatgtttgatctcatcggcttagaaaataaaatcactcgtcacgaggcagagttgctgtctaagaaaaagataccgcggaaactcatggaggaaatctccacttcagcagccccagcagcccgaccagcagcagcaaagctgaaggccagcaggttgtttcagcctgtgcagtatggccagaagcccgagggtcgcaccgtggctttccccagcactcacccgccccggacggcagcccccaccacggcctctgctgctccacagggcccgcttcgaggacggccgcccatcgccacgttctctgccaatccggaggcaaaagcagcagcagccccgtttcagacctctcaggcttccgccagtgctccacgacaccagcccgcctcggcctccagcacagccgctagcccggcccatcctgcgaaactgcgggcccagaccacagcacaggccttcaccccaggccagcccccgccccagccccaggccccctcgcacgcggccgggcagagcgcgctgcctcagaggctggtgctcccctcgcaggcccaggcccgcttgcccagtggagaggtagtgaaaatagctcagctggcatccatcacaggaccacagagccgcgtggctcagccagagacgccggtgacactgcagttccagggcagcaagttcaccctgtcacacagccagctccggcagctcacagcgggccagccgctgcagctgcaaggcagcgtcctccagatcgtgtccgcccccgggcagccctaccttcgagcccctggccctgtggtgatgcagaccgtgtctcaggcgggcgctgtgcacggcgccctgggaagcaagcccccggccggcggtcccagccctgcacccttgaccccacaagttggcgttccgggccgcgtggcggtgaatgccttggctgtaggagaacccggaacggcctccaaaccagcttctcccattggagggccgacccaggaggaaaagaccagactcttgaaagagcgcctggatcagatttatttagtcaacgagcggcgctgttctcaagctccagtctatggcagagacttgctaaggatttgtgccctgcctagccatggaagggtacagtggcgtgggtccctggatggccgtcgtgggaaggaggccgggccagcgcacagttacacttcatcctcagaaagtccaagtgagctgatgttgacgctttgtcggtgtggagagtctctgcaggatgttattgacagggtggcctttgtgattcctccggtggtggcagcacccccgtccctacgggtgccgcggccgccacccctgtacagccacagaatgaggatcttgaggcagggcctgagagagcacgctgcgccgtacttccagcagctgcggcagaccacggctccacgcctgctgcagttccctgagctgaggctggtgcagttcgactcagggaagttggaagctttagctatcttgcttcagaaattgaaatctgaaggacgtcgggtgctgattttatcacagatgattcttatgttggacattttagagatgttcttgaacttccattacctcacctatgtaagaatcgatgaaaatgccagcagtgagcaacggcaggaactgatgaggagtttcaacagagacaggcggattttttgtgccattctctccactcacagccgtaccacaggtataaaccttgtagaggcggacaccgtcgtgttttatgacaatgacctgaatccagtgatggatgccaaagctcaggagtggtgcgataggatcgggagatgcaaagacatccacatatacaggcttgtgagtggcaattccattgaagagaaattgttgaaaaatggaactaaagatctgatccgagaagtggctgctcagggaaatgactactccatggctttcttaactcagcgaaccatccaggagctgtttgaagtttattctcccatggatgatgctggcttcccggtcaaagctgaggagtttgtggtgctttctcaggaaccttctgtcacggaaaccattgcacccaaaattgcaagacctttcatagaggccctcaagagtattgagtatctggaggaggatgcccagaagtccgcacaggagggggtgctgggaccacacactgatgctctgtcatcagactctgagaacatgccgtgtgatgaagaaccatcccaattagaggagctagctgacttcatggagcagcttacaccaattgaaaaatatgctttaaattacctggaattattccatacttctattgagcaagaaaaggagagaaacagtgaggacgcagtgatgactgcagtgagggcatgggagttctggaacctgaagaccctgcaggagagggaggcccggctgcggctggagcaggaggaggcggagctcctgacctacacgcgagaggatgcctacagcatggagtatgtctacgaagatgtcgatgggcagacagaagtcatgccgctctggaccccacccaccccgccgcaggacgacagcgacatctacctcgactcggtcatgtgtctcatgtatgaagccactcccatcccagaggctaagctgccccctgtgtacgtgaggaaggagcggaagcgacacaaaacagacccctcagctgcaggcaggaagaagaagcagcgtcacggggaggcggtcgtccctcctcggtccctgtttgaccgcgcaacaccaggacttctgaaaattcgcagagagggcaaggagcagaagaagaatattctgctgaagcagcaggtgccattcgccaagcccctgccaacttttgccaaacccacagctgagcctggtcaagacaaccccgagtggctcatcagtgaggactgggcgctgctgcaggctgtaaagcagttactggagctgcctttgaacctcacaatcgtgtcacctgctcacacacctaattgggatcttgtcagtgacgttgttaactcctgtagccgaatctaccgctcttccaaacagtgccggaatcgctacgagaatgtcatcattccacgagaggaggggaagagtaaaaacaaccgtcctctccgtacgagccagatctatgcccaggatgagaatgccacacacacccagctgtacacgagccactttgacttaatgaaaatgactgctggcaagaggagtcccccaatcaaacctctgcttggcatgaatccctttcagaagaaccccaagcacgcgtctgtgttggcagaaagtggaatcaactatgacaagccgctgcctcccatccaggtggcatctctccgtgcagagcgaatcgcaaaagagaaaaaggctctggctgatcagcagaaggcacagcagccggccgtggcccagccacccccgccccagccgcagcccccaccacccccgcagcagccaccgccaccgctgccacaaccacaggcagcgggcagccagccgccagcagggccaccagctgtccagccccaaccccagccacagccccagacccagccacagcctgtgcaggccccagcgaaggcgcagcccgcaatcacgacggggggcagtgcagccgtactggcaggaaccattaaaacatcagttactgggacgagcatgcccactggtgccgtgagtggaaatgtgatcgtgaacaccatcgcaggggtcccagctgccaccttccagtccatcaacaagcgcctggcgtcgccagtggctcctggggccttgactacgccgggaggctctgctcccgcccaggtggtgcacacccagcccccgccacgggcagtcggctccccagccacggcgacccctgacctggtgtccatggcaacgactcagggtgttcgagcggtcacttctgtgacagcctcggccgtggtcactaccaacctgaccccagtgcagaccccggcacggtctttggtgccccaagtgtcccaagccacaggagttcagctccctggaaaaaccatcacacctgcacatttccagcttctcaggcagcagcagcagcagcagcagcaacagcagcagcagcagcagcagcagcagcagcagcagcagcagcagcaacagcagcagcagcaacagacgacgacgacctctcaggtgcaagttccacagatccagggccaggcccagtccccagcacagatcaaagctgtgggcaagctgacgccggaacacctcatcaaaatgcagaagcagaaactgcagatgcccccgcagcccccaccgccacaggcccagtctgcgcccccgcagccagcagcccaagtgcaagtgcagacctcgcagccgccgcagcagcagagcccccagctcacgacggtcacggccccaaggcctggtgccctgctgacgggcaccaccgtggccaacctccaggtggcccggctcacccgggttcccacttctcaactgcagtcgcaagggcagatgcagacccaggcaccccagccagcccaggtgcccttggcgaagcctccggtggtgtccgtcccggcagctgtggtctcctcaccgggagtcaccaccctgcccatgaacgtcgcggggatcagcgtggcgatcggtcagccacagaaggcagcaggacagaccgtggtggcccagcccgtgcacatgcagcagctgctgaagctgaagcagcaggccgtccagcagcagaaggccatccagccccaggctgcacagggcccggcagccgtccagcagaagatcaccgcacagcagatcaccacccctggcgcgcagcagaaggttgcctacgccgcgcagccggcccttaagacccagtttcttaccacacccatctcccaggcccagaaactggccggggcccagcaagtgcagacccagatccaggttgcaaaacttcctcaagttgttcaacagcaaacacccgtggccagcatccagcaagttgcctctgcttcccagcaggcttctccacagactgtggcgctcacgcaggcgacggcggccgggcagcaggtgcagatgatccctgcagtgaccgcgactgcccaggtggttcagcagaaactcattcagcagcaggtggtgaccacggcgtcggccccgctccagactccaggcgctcccaacccagcccaggtgcccgccagctccgacagcccaagccagcagcccaagttacagatgagggtccctgctgtcaggctaaagacacctactaagcctccgtgccagtagtcagggcagcagggctgcctctcatctaaagcaaaactaccttcctcacagaaaacgctttattagtgaaccttgggaccatgtcacgcaagagattcagcactgggaaagatataattgaaacaaaatagtgtaatcattttattaaaatgcatcccacactgcaggacaaatggtccttatggagtgccgcgttctctgtactacgtggctcatggaaaaagtgacaacatggcttcctctaaatcatttcacctttcagtccccacccgcacccgtcccctagagccatagtactgtgttctgaaagccatttagaatttctttgtgagcatgtagtgctttgcacgccacagaagccgtctgccgtgtgtgaggagcatacaatggactttctaaagataaggcgtgggcttccacagtgtctgccagagtttagttctttataccttactgaaaaatgcctcgtggtcttcgcagaggggaaggcctgtctaaagtcaatcatccgagatgggttttccattccaaagaaaggcaatatggttccttccttccctcctaaaatatgacttaacttttaagagaaatgttctgacacccacctaaacacacaaggcacgttcctggcctgtgttcaagggaaatgatcagtcattgcattgttattccaaagagcagccaacagtggcctcccccaggccctaccctgcaatgggattcgctttcatttaatggaaacttctgggactgatgcccaactcagtgcactcaagacgcatctccagttttcgggggaagctggtatttgacatagtgtgttaaacagctcctgagaacctttgggacactctgccatggctggcgtgaggcccagaggaccacgcagaggcaatggtagtacagatgtcacagctgagggtacgatgaggcctgggctcagtgagccaggacgaatgtgacagacaccccttgctgccacagtcagccctttgacgaaggtgggctggtgattctggaagtattggctatagcggtgggcccagtcaactcttccttgtggacttacgacagcagattttctctaggataagcttgtgtggttctgccagtgaagcagagaaccacctgtgctgttgtggaaggcgtgccgttgagggggaaaacgaagcccagtatttgctactgtttttcctttttttactatgacaggaaaataaatgcaattttagtggaattgattgacagtgtctccttactttgaagttttcaccaaagcaaaaaggtccatatccaatagtatcctttgtgctgtggcttgattttggcctattttacattatttggtccaggaaattaggttatattaggttttttgtatactaaaaatcagttatggcacaataaagattttctgtttttaaattgtatttcatctgcttcctccccattctctcactttaagtgacattgaggaaggtattctgtcccacaggtttctgtggacagcgatacagcaggagtcagtgaaatcaactggggagctcacttgagctcttgataagaaatgtggagaaaagtaaaaaccaagctttgaagaaacagaagaaattaatcttttagttagttgaacataccaaagcagaggactggaatctgtttgttctaaccaacccgttctccctggcttggcacgtgccgtgagagcgcagcttgccggagggagggccgctgtgtgcgcctcacatctggctcccagtggaaacttttactcctcctcatccgcagatgtgatagaactgaagtatctaggaattctgcctttgtcatttgttttaatttgtgtgccctgttcattttttttgtctttcccaaatcttggtagtctccttatagttgaagataaaatgttgagtgcacttattttagaatatcctagacataactgtctaagtaaaagcgctctattaatctaaaacactacaagagaatttaacaccatctctcaaatgcttttttggagagcttaatgggattctgaatatttgcaatgtggagtttccgccccgatctcacgtcagtgagggtctcctgtctctcaagtgtgtttcctttggctgttccctaatacaaaacacggacatatttttactcgtagcactcaatttagtaacttctagatgctaccgttgacctgagttaaattcatttagtcgtgtacgtaaaaactctccttttagtgtgttattttcttggccttcccttttaaaggttaaagtttctaacctaagaattaagtacgcgttcaggaagctgttgtctaggccttccccttgtgaatctgggttcattccaatacggcaagtaagagttggaaactttgagaacacagactataaaggcagcagcccgaacactgtcagactctaattggcgaccctgggaaacagttgccctgctattctttaaagaaagacgtttattctgatgataaaaacagttagccagactgtttttaaagcacctggcgggaagcagaaggttggatccaagcccttgttcagatttggtgcctgataagacaggggtttctctttttgtgacctttattattattattttgttaactgttgtaaccagttagctgttgtgttttaagatagaaaggaacaagactaaaattgtaaatactttgtaaacatcagcatttgtacttgaatagtaggattttaaagggcattgatagcataccaaacaaaaggcaaaataaagtgacctttttataaaaaaaaaaagaaaaagtcgac

SEQ ID NO: 547897 - DNA, 11373 bp, Homo sapiens
ctggctccgcgtcggccggtcggtttggtcggttgtagtggcctcgccgcccggtccgctgtcgcagcgctcatccgcgccgggagcccttggctgcgtcgcccggcagccgcgggagcatttcctgaagacgtagtcatgcagcacgtcagcagctcccagagcagccagcgccatgtccagtggcctggggcctgccccggcgcgggcgaggagcagccagcgtgctcccagccgtccctgcccctcacactgccatcccccagccaccaactacagcagctgatggtccagacccagagtcccacgcagcccagtccggggccggggcaggccttgcagaatgtgcgtgcaggtgcccctggccctgggctgggcctctgcagcagcagccctacaggggacttcgtggatgccagcgtgctggtgaggcagatcagcttgagcccctccagtggtggacactttgtgtttcaggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacgcccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcattaccaggagatgcaggctctgaaggaggtcttcaaggagtatttgattgaactgtttttcttgcaacactttcaagggaacatgatggatttcttagctttcaaggagagactgtatggaccattacaagcatatcttaggcagaatgatttggacattgaagaagaggaagaggagcactttgaagtcattaatgatgaggtaaaggttgtggccagaaagcacgggcagcctgggactcctgttgccatagcaacccagctaccgccgaggacttctgcggcttttccagcccagcagcagccgctccagcaaatacatatggtgactccagtacctggagatgtgaatgccataaaaatggaagcatctaagaggcagtgaacactggcgcccacaggagaaccaggtgcatcagcgcattgcggagctgaggaaagcaggtctgtggtcccagaggcgtctgccaaagctgcaggaggccccacgccccaagtcccactgggactatctgctggaggagatgcagtggatggccacagactttgcccaggagaggaggtggaaggtggctgctgcgaagaagctcgttagaactgtggtgcgccatcacgaggagaagcagctccgtgaagaaagggggaagaaggaagagcagagcagactgaggcggatagccgcctccacggcccgggagatagagtgcttttggtcgaatattgaacaggttgtggaaataaaactacgagtagaattagaagaaaaaaggaagaaggccttaaatttacagaaagtttccaggagagggaaagaattgagacctaaaggatttgacgcattacaggaaagttctctggattcaggaatgtctggaagaaaaagaaaagctagcatatctttgactgatgacgaagtggacgatgaagaggaaacaattgaagaggaggaagcaaatgaaggcgttgtggaccaccaaacagaactttctaatttagccaaggaagctgagctgcccctcctggacctgatgaagctgtacgaaggcgccttcctgccgagttctcagtggccccggccgaagcctgatggggaggacacaagcggagaggaagatgcagatgactgtccaggcgacagggagagtcgcaaggacttggttctcatcgactcgcttttcatcatggatcagttcaaagctgccgagaggatgaatatcgggaagccaaacgccaaggacattgcggacgtcactgcggtggctgaagccatcctgccgaagggcagtgctcgggtcacaacctcggtcaagtttaatgctccatctttgttgtatggggctctcagagattatcagaagattggcctggactggctggccaaactttacaggaagaatctcaatggcatattggcagatgaagctgggctgggtaaaacagtgcagatcattgctttttttgcccacctagcttgtaacgaaggtaattggggcccccatcttgttgttgtgagaagttgtaacatactcaagtgggagcttgaattgaaacgttggtgtcccggactcaaaatcctctcatatattggcagccacagagaactcaaagcaaagagacaggagtgggccgaacccaacagcttccacgtctgcatcacgtcctacactcagttcttccggggcctcaccgccttcacacgagtgcgctggaagtgcctggtcattgatgagatgcagcgcgtgaagggcatgaccgagaggcactgggaagcggttttcaccctgcagagccaacaacgtctgcttctgatcgactcgccgctgcacaataccttcctggagctctggaccatggtgcacttcctggtcccagggatctccaggccctacctgagctcccctctgagggcccccagtgaagagagccaggattactaccataaagtggtcataaggttacacagggtgacacagccatttattttgaggagaactaagagagatgtggaaaagcaactaacaaagaaatatgagcatgttttgaagtgtcgcctttctaaccgacaaaaagccttatacgaggacgttatcctgcaacctggcactcaggaggccttgaagagcgggcactttgtcaacgtcctgagcatccttgtgcggctgcagcgcatctgcaaccaccctgggctcgtcgagccccggcacccaggctcttcctacgtggcggggccactggagtatccgtccgcatctctaatcctgaaggcactggagagagatttctggaaggaagcagatctttctatgtttgatctcatcggcttagaaaataaaatcactcgtcacgaggcagagttgctgtctaagaaaaagataccgcggaaactcatggaggaaatctccacttcagcagccccagcagcccgaccagcagcagcaaagctgaaggccagcaggttgtttcagcctgtgcagtatggccagaagcccgagggtcgcaccgtggctttccccagcactcacccgccccggacggcagcccccaccacggcctctgctgctccacagggcccgcttcgaggacggccgcccatcgccacgttctctgccaatccggaggcaaaagcagcagcagccccgtttcagacctctcaggcttccgccagtgctccacgacaccagcccgcctcggcctccagcacagccgctagcccggcccatcctgcgaaactgcgggcccagaccacagcacaggccttcaccccaggccagcccccgccccagccccaggccccctcgcacgcggccgggcagagcgcgctgcctcagaggctggtgctcccctcgcaggcccaggcccgcttgcccagtggagaggtagtgaaaatagctcagctggcatccatcacaggaccacagagccgcgtggctcagccagagacgccggtgacactgcagttccagggcagcaagttcaccctgtcacacagccagctccggcagctcacagcgggccagccgctgcagctgcaaggcagcgtcctccagatcgtgtccgcccccgggcagccctaccttcgagcccctggccctgtggtgatgcagaccgtgtctcaggcgggcgctgtgcacggcgccctgggaagcaagcccccggccggcggtcccagccctgcacccttgaccccacaagttggcgttccgggccgcgtggcggtgaatgccttggctgtaggagaacccggaacggcctccaaaccagcttctcccattggagggccgacccaggaggaaaagaccagactcttgaaagagcgcctggatcagatttatttagtcaacgagcggcgctgttctcaagctccagtctatggcagagacttgctaaggatttgtgccctgcctagccatggaagggtacagtggcgtgggtccctggatggccgtcgtgggaaggaggccgggccagcgcacagttacacttcatcctcagaaagtccaagtgagctgatgttgacgctttgtcggtgtggagagtctctgcaggatgttattgacagggtggcctttgtgattcctccggtggtggcagcacccccgtccctacgggtgccgcggccgccacccctgtacagccacagaatgaggatcttgaggcagggcctgagagagcacgctgcgccgtacttccagcagctgcggcagaccacggctccacgcctgctgcagttccctgagctgaggctggtgcagttcgactcagggaagttggaagctttagctatcttgcttcagaaattgaaatctgaaggacgtcgggtgctgattttatcacagatgattcttatgttggacattttagagatgttcttgaacttccattacctcacctatgtaagaatcgatgaaaatgccagcagtgagcaacggcaggaactgatgaggagtttcaacagagacaggcggattttttgtgccattctctccactcacagccgtaccacaggtataaaccttgtagaggcggacaccgtcgtgttttatgacaatgacctgaatccagtgatggatgccaaagctcaggagtggtgcgataggatcgggagatgcaaagacatccacatatacaggcttgtgagtggcaattccattgaagagaaattgttgaaaaatggaactaaagatctgatccgagaagtggctgctcagggaaatgactactccatggctttcttaactcagcgaaccatccaggagctgtttgaagtttattctcccatggatgatgctggcttcccggtcaaagctgaggagtttgtggtgctttctcaggaaccttctgtcacggaaaccattgcacccaaaattgcaagacctttcatagaggccctcaagagtattgagtatctggaggaggatgcccagaagtccgcacaggagggggtgctgggaccacacactgatgctctgtcatcagactctgagaacatgccgtgtgatgaagaaccatcccaattagaggagctagctgacttcatggagcagcttacaccaattgaaaaatatgctttaaattacctggaattattccatacttctattgagcaagaaaaggagagaaacagtgaggacgcagtgatgactgcagtgagggcatgggagttctggaacctgaagaccctgcaggagagggaggcccggctgcggctggagcaggaggaggcggagctcctgacctacacgcgagaggatgcctacagcatggagtatgtctacgaagatgtcgatgggcagacagaagtcatgccgctctggaccccacccaccccgccgcaggacgacagcgacatctacctcgactcggtcatgtgtctcatgtatgaagccactcccatcccagaggctaagctgccccctgtgtacgtgaggaaggagcggaagcgacacaaaacagacccctcagctgcaggcaggaagaagaagcagcgtcacggggaggcggtcgtccctcctcggtccctgtttgaccgcgcaacaccaggacttctgaaaattcgcagagagggcaaggagcagaagaagaatattctgctgaagcagcaggtgccattcgccaagcccctgccaacttttgccaaacccacagctgagcctggtcaagacaaccccgagtggctcatcagtgaggactgggcgctgctgcaggctgtaaagcagttactggagctgcctttgaacctcacaatcgtgtcacctgctcacacacctaattgggatcttgtcagtgacgttgttaactcctgtagccgaatctaccgctcttccaaacagtgccggaatcgctacgagaatgtcatcattccacgagaggaggggaagagtaaaaacaaccgtcctctccgtacgagccagatctatgcccaggatgagaatgccacacacacccagctgtacacgagccactttgacttaatgaaaatgactgctggcaagaggagtcccccaatcaaacctctgcttggcatgaatccctttcagaagaaccccaagcacgcgtctgtgttggcagaaagtggaatcaactatgacaagccgctgcctcccatccaggtggcatctctccgtgcagagcgaatcgcaaaagagaaaaaggctctggctgatcagcagaaggcacagcagccggccgtggcccagccacccccgccccagccgcagcccccaccacccccgcagcagccaccgccaccgctgccacaaccacaggcagcgggcagccagccgccagcagggccaccagctgtccagccccaaccccagccacagccccagacccagccacagcctgtgcaggccccagcgaaggcgcagcccgcaatcacgacggggggcagtgcagccgtactggcaggaaccattaaaacatcagttactgggacgagcatgcccactggtgccgtgagtggaaatgtgatcgtgaacaccatcgcaggggtcccagctgccaccttccagtccatcaacaagcgcctggcgtcgccagtggctcctggggccttgactacgccgggaggctctgctcccgcccaggtggtgcacacccagcccccgccacgggcagtcggctccccagccacggcgacccctgacctggtgtccatggcaacgactcagggtgttcgagcggtcacttctgtgacagcctcggccgtggtcactaccaacctgaccccagtgcagaccccggcacggtctttggtgccccaagtgtcccaagccacaggagttcagctccctggaaaaaccatcacacctgcacatttccagcttctcaggcagcagcagcagcagcagcagcaacagcagcagcagcagcagcagcagcagcagcagcagcagcagcagcaacagcagcagcagcaacagacgacgacgacctctcaggtgcaagttccacagatccagggccaggcccagtccccagcacagatcaaagctgtgggcaagctgacgccggaacacctcatcaaaatgcagaagcagaaactgcagatgcccccgcagcccccaccgccacaggcccagtctgcgcccccgcagccagcagcccaagtgcaagtgcagacctcgcagccgccgcagcagcagagcccccagctcacgacggtcacggccccaaggcctggtgccctgctgacgggcaccaccgtggccaacctccaggtggcccggctcacccgggttcccacttctcaactgcagtcgcaagggcagatgcagacccaggcaccccagccagcccaggtgcccttggcgaagcctccggtggtgtccgtcccggcagctgtggtctcctcaccgggagtcaccaccctgcccatgaacgtcgcggggatcagcgtggcgatcggtcagccacagaaggcagcaggacagaccgtggtggcccagcccgtgcacatgcagcagctgctgaagctgaagcagcaggccgtccagcagcagaaggccatccagccccaggctgcacagggcccggcagccgtccagcagaagatcaccgcacagcagatcaccacccctggcgcgcagcagaaggttgcctacgccgcgcagccggcccttaagacccagtttcttaccacacccatctcccaggcccagaaactggccggggcccagcaagtgcagacccagatccaggttgcaaaacttcctcaagttgttcaacagcaaacacccgtggccagcatccagcaagttgcctctgcttcccagcaggcttctccacagactgtggcgctcacgcaggcgacggcggccgggcagcaggtgcagatgatccctgcagtgaccgcgactgcccaggtggttcagcagaaactcattcagcagcaggtggtgaccacggcgtcggccccgctccagactccaggcgctcccaacccagcccaggtgcccgccagctccgacagcccaagccagcagcccaagttacagatgagggtccctgctgtcaggctaaagacacctactaagcctccgtgccagtagtcagggcagcagggctgcctctcatctaaagcaaaactaccttcctcacagaaaacgctttattagtgaaccttgggaccatgtcacgcaagagattcagcactgggaaagatataattgaaacaaaatagtgtaatcattttattaaaatgcatcccacactgcaggacaaatggtccttatggagtgccgcgttctctgtactacgtggctcatggaaaaagtgacaacatggcttcctctaaatcatttcacctttcagtccccacccgcacccgtcccctagagccatagtactgtgttctgaaagccatttagaatttctttgtgagcatgtagtgctttgcacgccacagaagccgtctgccgtgtgtgaggagcatacaatggactttctaaagataaggcgtgggcttccacagtgtctgccagagtttagttctttataccttactgaaaaatgcctcgtggtcttcgcagaggggaaggcctgtctaaagtcaatcatccgagatgggttttccattccaaagaaaggcaatatggttccttccttccctcctaaaatatgacttaacttttaagagaaatgttctgacacccacctaaacacacaaggcacgttcctggcctgtgttcaagggaaatgatcagtcattgcattgttattccaaagagcagccaacagtggcctcccccaggccctaccctgcaatgggattcgctttcatttaatggaaacttctgggactgatgcccaactcagtgcactcaagacgcatctccagttttcgggggaagctggtatttgacatagtgtgttaaacagctcctgagaacctttgggacactctgccatggctggcgtgaggcccagaggaccacgcagaggcaatggtagtacagatgtcacagctgagggtacgatgaggcctgggctcagtgagccaggacgaatgtgacagacaccccttgctgccacagtcagccctttgacgaaggtgggctggtgattctggaagtattggctatagcggtgggcccagtcaactcttccttgtggacttacgacagcagattttctctaggataagcttgtgtggttctgccagtgaagcagagaaccacctgtgctgttgtggaaggcgtgccgttgagggggaaaacgaagcccagtatttgctactgtttttcctttttttactatgacaggaaaataaatgcaattttagtggaattgattgacagtgtctccttactttgaagttttcaccaaagcaaaaaggtccatatccaatagtatcctttgtgctgtggcttgattttggcctattttacattatttggtccaggaaattaggttatattaggttttttgtatactaaaaatcagttatggcacaataaagattttctgtttttaaattgtatttcatctgcttcctccccattctctcactttaagtgacattgaggaaggtattctgtcccacaggtttctgtggacagcgatacagcaggagtcagtgaaatcaactggggagctcacttgagctcttgataagaaatgtggagaaaagtaaaaaccaagctttgaagaaacagaagaaattaatcttttagttagttgaacataccaaagcagaggactggaatctgtttgttctaaccaacccgttctccctggcttggcacgtgccgtgagagcgcagcttgccggagggagggccgctgtgtgcgcctcacatctggctcccagtggaaacttttactcctcctcatccgcagatgtgatagaactgaagtatctaggaattctgcctttgtcatttgttttaatttgtgtgccctgttcattttttttgtctttcccaaatcttggtagtctccttatagttgaagataaaatgttgagtgcacttattttagaatatcctagacataactgtctaagtaaaagcgctctattaatctaaaacactacaagagaatttaacaccatctctcaaatgcttttttggagagcttaatgggattctgaatatttgcaatgtggagtttccgccccgatctcacgtcagtgagggtctcctgtctctcaagtgtgtttcctttggctgttccctaatacaaaacacggacatatttttactcgtagcactcaatttagtaacttctagatgctaccgttgacctgagttaaattcatttagtcgtgtacgtaaaaactctccttttagtgtgttattttcttggccttcccttttaaaggttaaagtttctaacctaagaattaagtacgcgttcaggaagctgttgtctaggccttccccttgtgaatctgggttcattccaatacggcaagtaagagttggaaactttgagaacacagactataaaggcagcagcccgaacactgtcagactctaattggcgaccctgggaaacagttgccctgctattctttaaagaaagacgtttattctgatgataaaaacagttagccagactgtttttaaagcacctggcgggaagcagaaggttggatccaagcccttgttcagatttggtgcctgataagacaggggtttctctttttgtgacctttattattattattttgttaactgttgtaaccagttagctgttgtgttttaagatagaaaggaacaagactaaaattgtaaatactttgtaaacatcagcatttgtacttgaatagtaggattttaaagggcattgatagcataccaaacaaaaggcaaaataaagtgacctttttataaaaaaaaaaagaaaaagtcgac

SEQ ID NO: 547898 - DNA, 904 bp, Homo sapiens
tgggaccgagcccgcaagttatgggctcagacatcagagttgctaagctgtaatgaggaagttagatgcatgctgccaaattgaggtagtggagagactcgtggatgaatgctgggcaggctaggtctagcagggagttccctgaagttacaactaaggtaggtgggctaagtgatgtgatcatttattattcccttctttaacctatctagtggacatctatgatggtatggcatgctccatactcctcgttcttttctgttctttacttattgataagttttattgatatatggagatgggagttctctggtgcccagagacgtggaagtgacagaaggcgcaatactacggacatcagattgcaaaccattcggccttccacggagtaccaggcagaatactccgagcacatcatgcacattcaccagagaataagctgggataaacacgagcgcaccaacacaacaacaagcacaagactaaaatatcaaagagaaattaatatagggaaggagaggcaagggagatcatcagcccatgtggtgagggcaccacggacccaaggacatgagaaatacacagtgaagcaagtcaaagatgagaaatcacaacattcaggcacatacaaaaagcatcagcacaaaaaaagagtacgaggggacatcaaacactgaacagatgacgacacaacccgagaagcacccgaggaacttccgtgaacaccacaccacttatagtctccgtacacgcaaaagggatgacaccacagatatcccccacaaatcatgataccaaggaatcacatattcacgggagacattaaccacaatggagtaacgcaacagacataggaagaacacacagaaaaacaggggcacatagagatcccaggaggacgacg

SEQ ID NO: 547899 - DNA, 8565 bp, Homo sapiens
cctaccacttgcttgcccccacttctctttcagagcactcgctatgattgtgaatgaagtggagtggctgtctttccgtcagctctggtggggcggatgtcattctcaactggggatggcgaacaagtgcggaggggcctgcctgggatgtggacttgaatggccactctgtctaactcattaagcggacctagaaaatctgctcctgcctgcctttctggagttgggacagtcgatggtgagggtgggactatgtccatgtgcccgtttggattgaatgcttcgtgtttctttctccacgggcagcactcaggaggccttgaagagcgggcactttgtcaacgtcctgagcatccttgtgcggctgcagcgcatctgcaaccaccctgggctcgtcgagccccggcacccaggctcttcctacgtggcggggccactggagtatccgtccgcatctctaatcctgaaggcactggagagagatttctggaaggaagcagatctttctatgtttgatctcatcggcttagaaaataaaatcactcgtcacgaggcagagttgctgtctaagaaaaagataccgcggaaactcatggaggaaatctccacttcagcagccccagcagcccgaccagcagcagcaaagctgaaggccagcaggttgtttcagcctgtgcagtatggccagaagcccgagggtcgcaccgtggctttccccagcactcacccgccccggacggcagcccccaccacggcctctgctgctccacagggcccgcttcgaggacggccgcccatcgccacgttctctgccaatccggaggcaaaagcagcagcagccccgtttcagacctctcaggcttccgccagtgctccacgacaccagcccgcctcggcctccagcacagccgctagcccggcccatcctgcgaaactgcgggcccagaccacagcacaggccttcaccccaggccagcccccgccccagccccaggccccctcgcacgcggccgggcagagcgcgctgcctcagaggctggtgctcccctcgcaggcccaggcccgcttgcccagtggagaggtagtgaaaatagctcagctggcatccatcacaggaccacagagccgcgtggctcagccagagacgccggtgacactgcagttccagggcagcaagttcaccctgtcacacagccagctccggcagctcacagcgggccagccgctgcagctgcaaggcagcgtcctccagatcgtgtccgcccccgggcagccctaccttcgagcccctggccctgtggtgatgcagaccgtgtctcaggcgggcgctgtgcacggcgccctgggaagcaagcccccggccggcggtcccagccctgcacccttgaccccacaagttggcgttccgggccgcgtggcggtgaatgccttggctgtaggagaacccggaacggcctccaaaccagcttctcccattggagggccgacccaggaggaaaagaccagactcttgaaagagcgcctggatcagatttatttagtcaacgagcggcgctgttctcaagctccagtctatggcagagacttgctaaggatttgtgccctgcctagccatggaagggtacagtggcgtgggtccctggatggccgtcgtgggaaggaggccgggccagcgcacagttacacttcatcctcagaaagtccaagtgagctgatgttgacgctttgtcggtgtggagagtctctgcaggatgttattgacagggtggcctttgtgattcctccggtggtggcagcacccccgtccctacgggtgccgcggccgccacccctgtacagccacagaatgaggatcttgaggcagggcctgagagagcacgctgcgccgtacttccagcagctgcggcagaccacggctccacgcctgctgcagttccctgagctgaggctggtgcagttcgactcagggaagttggaagctttagctatcttgcttcagaaattgaaatctgaaggacgtcgggtgctgattttatcacagatgattcttatgttggacattttagagatgttcttgaacttccattacctcacctatgtaagaatcgatgaaaatgccagcagtgagcaacggcaggaactgatgaggagtttcaacagagacaggcggattttttgtgccattctctccactcacagccgtaccacaggtataaaccttgtagaggcggacaccgtcgtgttttatgacaatgacctgaatccagtgatggatgccaaagctcaggagtggtgcgataggatcgggagatgcaaagacatccacatatacaggcttgtgagtggcaattccattgaagagaaattgttgaaaaatggaactaaagatctgatccgagaagtggctgctcagggaaatgactactccatggctttcttaactcagcgaaccatccaggagctgtttgaagtttattctcccatggatgatgctggcttcccggtcaaagctgaggagtttgtggtgctttctcaggaaccttctgtcacggaaaccattgcacccaaaattgcaagacctttcatagaggccctcaagagtattgagtatctggaggaggatgcccagaagtccgcacaggagggggtgctgggaccacacactgatgctctgtcatcagactctgagaacatgccgtgtgatgaagaaccatcccaattagaggagctagctgacttcatggagcagcttacaccaattgaaaaatatgctttaaattacctggaattattccatacttctattgagcaagaaaaggagagaaacagtgaggacgcagtgatgactgcagtgagggcatgggagttctggaacctgaagaccctgcaggagagggaggcccggctgcggctggagcaggaggaggcggagctcctgacctacacgcgagaggatgcctacagcatggagtatgtctacgaagatgtcgatgggcagacagaagtcatgccgctctggaccccacccaccccgccgcaggacgacagcgacatctacctcgactcggtcatgtgtctcatgtatgaagccactcccatcccagaggctaagctgccccctgtgtacgtgaggaaggagcggaagcgacacaaaacagacccctcagctgcaggcaggaagaagaagcagcgtcacggggaggcggtcgtccctcctcggtccctgtttgaccgcgcaacaccaggacttctgaaaattcgcagagagggcaaggagcagaagaagaatattctgctgaagcagcaggtgccattcgccaagcccctgccaacttttgccaaacccacagctgagcctggtcaagacaaccccgagtggctcatcagtgaggactgggcgctgctgcaggctgtaaagcagttactggagctgcctttgaacctcacaatcgtgtcacctgctcacacacctaattgggatcttgtcagtgacgttgttaactcctgtagccgaatctaccgctcttccaaacagtgccggaatcgctacgagaatgtcatcattccacgagaggaggggaagagtaaaaacaaccgtcctctccgtacgagccagatctatgcccaggatgagaatgccacacacacccagctgtacacgagccactttgacttaatgaaaatgactgctggcaagaggagtcccccaatcaaacctctgcttggcatgaatccctttcagaagaaccccaagcacgcgtctgtgttggcagaaagtggaatcaactatgacaagccgctgcctcccatccaggtggcatctctccgtgcagagcgaatcgcaaaagagaaaaaggctctggctgatcagcagaaggcacagcagccggccgtggcccagccacccccgccccagccgcagcccccaccacccccgcagcagccaccgccaccgctgccacaaccacaggcagcgggcagccagccgccagcagggccaccagctgtccagccccaaccccagccacagccccagacccagccacagcctgtgcaggccccagcgaaggcgcagcccgcaatcacgacggggggcagtgcagccgtactggcaggaaccattaaaacatcagttactgggacgagcatgcccactggtgccgtgagtggaaatgtgatcgtgaacaccatcgcaggggtcccagctgccaccttccagtccatcaacaagcgcctggcgtcgccagtggctcctggggccttgactacgccgggaggctctgctcccgcccaggtggtgcacacccagcccccgccacgggcagtcggctccccagccacggcgacccctgacctggtgtccatggcaacgactcagggtgttcgagcggtcacttctgtgacagcctcggccgtggtcactaccaacctgaccccagtgcagaccccggcacggtctttggtgccccaagtgtcccaagccacaggagttcagctccctggaaaaaccatcacacctgcacatttccagcttctcaggcagcagcagcagcagcagcagcaacagcagcagcagcagcagcagcagcagcagcagcagcagcagcagcaacagcagcagcagcaacagacgacgacgacctctcaggtgcaagttccacagatccagggccaggcccagtccccagcacagatcaaagctgtgggcaagctgacgccggaacacctcatcaaaatgcagaagcagaaactgcagatgcccccgcagcccccaccgccacaggcccagtctgcgcccccgcagccagcagcccaagtgcaagtgcagacctcgcagccgccgcagcagcagagcccccagctcacgacggtcacggccccaaggcctggtgccctgctgacgggcaccaccgtggccaacctccaggtggcccggctcacccgggttcccacttctcaactgcagtcgcaagggcagatgcagacccaggcaccccagccagcccaggtgcccttggcgaagcctccggtggtgtccgtcccggcagctgtggtctcctcaccgggagtcaccaccctgcccatgaacgtcgcggggatcagcgtggcgatcggtcagccacagaaggcagcaggacagaccgtggtggcccagcccgtgcacatgcagcagctgctgaagctgaagcagcaggccgtccagcagcagaaggccatccagccccaggctgcacagggcccggcagccgtccagcagaagatcaccgcacagcagatcaccacccctggcgcgcagcagaaggttgcctacgccgcgcagccggcccttaagacccagtttcttaccacacccatctcccaggcccagaaactggccggggcccagcaagtgcagacccagatccaggttgcaaaacttcctcaagttgttcaacagcaaacacccgtggccagcatccagcaagttgcctctgcttcccagcaggcttctccacagactgtggcgctcacgcaggcgacggcggccgggcagcaggtgcagatgatccctgcagtgaccgcgactgcccaggtggttcagcagaaactcattcagcagcaggtggtgaccacggcgtcggccccgctccagactccaggcgctcccaacccagcccaggtgcccgccagctccgacagcccaagccagcagcccaagttacagatgagggtccctgctgtcaggctaaagacacctactaagcctccgtgccagtagtcagggcagcagggctgcctctcatctaaagcaaaactaccttcctcacagaaaacgctttattagtgaaccttgggaccatgtcacgcaagagattcagcactgggaaagatataattgaaacaaaatagtgtaatcattttattaaaatgcatcccacactgcaggacaaatggtccttatggagtgccgcgttctctgtactacgtggctcatggaaaaagtgacaacatggcttcctctaaatcatttcacctttcagtccccacccgcacccgtcccctagagccatagtactgtgttctgaaagccatttagaatttctttgtgagcatgtagtgctttgcacgccacagaagccgtctgccgtgtgtgaggagcatacaatggactttctaaagataaggcgtgggcttccacagtgtctgccagagtttagttctttataccttactgaaaaatgcctcgtggtcttcgcagaggggaaggcctgtctaaagtcaatcatccgagatgggttttccattccaaagaaaggcaatatggttccttccttccctcctaaaatatgacttaacttttaagagaaatgttctgacacccacctaaacacacaaggcacgttcctggcctgtgttcaagggaaatgatcagtcattgcattgttattccaaagagcagccaacagtggcctcccccaggccctaccctgcaatgggattcgctttcatttaatggaaacttctgggactgatgcccaactcagtgcactcaagacgcatctccagttttcgggggaagctggtatttgacatagtgtgttaaacagctcctgagaacctttgggacactctgccatggctggcgtgaggcccagaggaccacgcagaggcaatggtagtacagatgtcacagctgagggtacgatgaggcctgggctcagtgagccaggacgaatgtgacagacaccccttgctgccacagtcagccctttgacgaaggtgggctggtgattctggaagtattggctatagcggtgggcccagtcaactcttccttgtggacttacgacagcagattttctctaggataagcttgtgtggttctgccagtgaagcagagaaccacctgtgctgttgtggaaggcgtgccgttgagggggaaaacgaagcccagtatttgctactgtttttcctttttttactatgacaggaaaataaatgcaattttagtggaattgattgacagtgtctccttactttgaagttttcaccaaagcaaaaaggtccatatccaatagtatcctttgtgctgtggcttgattttggcctattttacattatttggtccaggaaattaggttatattaggttttttgtatactaaaaatcagttatggcacaataaagattttctgtttttaaattgtatttcatctgcttcctccccattctctcactttaagtgacattgaggaaggtattctgtcccacaggtttctgtggacagcgatacagcaggagtcagtgaaatcaactggggagctcacttgagctcttgataagaaatgtggagaaaagtaaaaaccaagctttgaagaaacagaagaaattaatcttttagttagttgaacataccaaagcagaggactggaatctgtttgttctaaccaacccgttctccctggcttggcacgtgccgtgagagcgcagcttgccggagggagggccgctgtgtgcgcctcacatctggctcccagtggaaacttttactcctcctcatccgcagatgtgatagaactgaagtatctaggaattctgcctttgtcatttgttttaatttgtgtgccctgttcattttttttgtctttcccaaatcttggtagtctccttatagttgaagataaaatgttgagtgcacttattttagaatatcctagacataactgtctaagtaaaagcgctctattaatctaaaacactacaagagaatttaacaccatctctcaaatgcttttttggagagcttaatgggattctgaatatttgcaatgtggagtttccgccccgatctcacgtcagtgagggtctcctgtctctcaagtgtgtttcctttggctgttccctaatacaaaacacggacatatttttactcgtagcactcaatttagtaacttctagatgctaccgttgacctgagttaaattcatttagtcgtgtacgtaaaaactctccttttagtgtgttattttcttggccttcccttttaaaggttaaagtttctaacctaagaattaagtacgcgttcaggaagctgttgtctaggccttccccttgtgaatctgggttcattccaatacggcaagtaagagttggaaactttgagaacacagactataaaggcagcagcccgaacactgtcagactctaattggcgaccctgggaaacagttgccctgctattctttaaagaaagacgtttattctgatgataaaaacagttagccagactgtttttaaagcacctggcgggaagcagaaggttggatccaagcccttgttcagatttggtgcctgataagacaggggtttctctttttgtgacctttattattattattttgttaactgttgtaaccagttagctgttgtgttttaagatagaaaggaacaagactaaaattgtaaatactttgtaaacatcagcatttgtacttgaatagtaggattttaaagggcattgatagcataccaaacaaaaggcaaaataaagtgacctttttataaaaaaaaaaagaaaaagtcgac

SEQ ID NO: 547900 - DNA, 871 bp, Homo sapiens
tgcttgagtcaatactgcaccactgcactccagcctgggcaacagcgagactcttgtctcaaaaaaaaaaaaagattattggctgaaaagaacccagcctgccaaactcaggggcagccaggggcaggtcagtgggaaatgggaagtgggagctcaagcggctcccaaaaccttccaaatggccctcaaggccattctctggcctctttcccaatcaagtccagctggcttctggggcatggtccttgggcaagagatttggccttcccttcccagttcaaagctccctctttaagtatgtgtggtcccaacgccaattggagtcttgtcgcggacacgtgggtcaggatgtctaagtcgtggcccaatgggcaggaatcccaagaaacaggtgtgagtggaggggacagtcgtgtggagtggccctccatctgggactgggaggcaggtctatgtcaggcctgcattaagatctctaaatggttccaagaaaagccctttcagttcattaagccgtgtttcctaacacagctgtggggatggtggctgggttaacatagcacgcgataccatcatagatccactttggcgaaatcttgaggccccaggagtgatctggtggccctcgcgggccaccgaggaagggcccaatctcagcctggcagcagggtggccagaaatgatctcgccccaaccgggaaaagccttctggataacgtggttccaaagagagctgggcccaaagggcactccgattcgggacggggagcctgggaggggacaaaaagggcctgggggcgcacggaagaaaaaacccgcgctctgagggggtgccaccccatccggggtctcgagccggggggggggacaa

SEQ ID NO: 547901 - DNA, 404 bp, Homo sapiens
agaagtttttaggccaggcgtggtggctcagctgtatcccagcatttgggaggccgagatgggcagataacctgaggtcaggagttggagacaaaactggccaacatgatgaaactccacctccattaaaaatagaaaaattagcctggcgtggtggtgcatgcctctggtcccagctacttgggaggctgaagcaggagaatcacttgtacccgggaggcggaaggtgcagtgaactgagaccacgccattgtactccagccagggcaacgagtgaaattccgtctcaaaaaaaaaaagggtttttaatttttcggccaggtcttttaccaaatttttttggagaccttcccttggggcggggggatggagggcggcaactccttagtggaattaaaggggga

SEQ ID NO: 547902 - DNA, 12266 bp, Homo sapiens
agcggggcggcggcgcggcttccatcctcccgccctcctgacgcggccggagcgcagccctgaggcccagggagaacgacacattggatacagaagggaggtgatcatgcaccatggcactggcccccagaacgtccagcatcagctgcagaggtccagggcctgccctggcagcgagggtgaggagcagccggcccaccccaacccacccccgtcccccgcagctcccttcgctccctcagcaagcccgtcggcaccccagtctcccagttatcaaatacagcagctgatgaataggagccctgcaaccgggcagaacgtgaacatcaccctgcagagcgtgggccctgtcgtcgggggaaaccagcagatcacactggccccactgccgctccccagccccacctctccaggcttccagttcagcgctcagcctcggcggtttgagcatgggtctccatcatacattcaggtcacgtcccccttgtcccagcaggtccagacccagagtcccacgcagcccagtccggggccggggcaggccttgcagaatgtgcgtgcaggtgcccctggccctgggctgggcctctgcagcagcagccctacaggggacttcgtggatgccagcgtgctggtgaggcagatcagcttgagcccctccagtggtggacactttgtgtttcaggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacgcccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcattaccaggagatgcaggctctgaaggaggtcttcaaggagtatttgattgaactgtttttcttgcaacactttcaagggaacatgatggatttcttagctttcaaggagagactgtatggaccattacaagcatatcttaggcagaatgatttggacattgaagaagaggaggaggaggaggaagaggaggaagaaaaatctgaggttatcaatgacgagcagcaagccctcgcagggagcctggtagcaggggccggaagcacagtagagacggacctgtttaagaggcagcaggcgatgccctccacaggtatggcagagcagtctaagaggcctcgccttgaagtgggtcaccaaggggtagttttccagcacccaggggcggacgcaggcgttcctctccagcaactaatgccgaccgcacaaggaggaatgccccccacgccgcaggccgcgcagctcgctggacagaggcagagtcagcagcagtatgacccctccacggggcctcccgtgcagaacgctgccagcttgcacaccccactgccgcagctgcccgggaggctgcccccagccggtgttcccactgcagccctctcctctgcgctgcagtttgcacagcagccgcaagtggtagaggcccagacacagctccaaatcccggtgaagactcagcagcccaatgttcccatccctgcaccgcccagcagccaactccccatccctccctcgcagcctgcacagctggccctccacgttcccacacctggaaaggtgcaggtgcaggcctctcagctttcctccctgccacagatggtagcatcgacaaggctccctgtggaccctgccccgccctgcccacggcctctgcccacctcttctacctcgtccctcgcgcctgtgagtggctccggcccaggaccctcccctgctcgatcctctccagtaaatagaccttcctcagccaccaataaggcactatctccagtcacttcccggaccccaggggtggtggcatctgcccccaccaaaccacagagtcctgctcagaatgccacctcgtcccaagacagttctcaggatacgctgacagaacaaataactctggagaaccaggtgcatcagcgcattgcggagctgaggaaagcaggtctgtggtcccagaggcgtctgccaaagctgcaggaggccccacgccccaagtcccactgggactatctgctggaggagatgcagtggatggccacagactttgcccaggagaggaggtggaaggtggctgctgcgaagaagctcgttagaactgtggtgcgccatcacgaggagaagcagctccgtgaagaaagggggaagaaggaagagcagagcagactgaggcggatagccgcctccacggcccgggagatagagtgcttttggtcgaatattgaacaggttgtggaaataaaactacgagtagaattagaagaaaaaaggaagaaggccttaaatttacagaaagtttccaggagagggaaagaattgagacctaaaggatttgacgcattacaggaaagttctctggattcaggaatgtctggaagaaaaagaaaagctagcatatctttgactgatgacgaagtggacgatgaagaggaaacaattgaagaggaggaagcaaatgaaggcgttgtggaccaccaaacagaactttctaatttagccaaggaagctgagctgcccctcctggacctgatgaagctgtacgaaggcgccttcctgccgagttctcagtggccccggccgaagcctgatggggaggacacaagcggagaggaagatgcagatgactgtccaggcgacagggagagtcgcaaggacttggttctcatcgactcgcttttcatcatggatcagttcaaagctgccgagaggatgaatatcgggaagccaaacgccaaggacattgcggacgtcactgcggtggctgaagccatcctgccgaagggcagtgctcgggtcacaacctcggtcaagtttaatgctccatctttgttgtatggggctctcagagattatcagaagattggcctggactggctggccaaactttacaggaagaatctcaatggcatattggcagatgaagctgggctgggtaaaacagtgcagatcattgctttttttgcccacctagcttgtaacgaaggtaattggggcccccatcttgttgttgtgagaagttgtaacatactcaagtgggagcttgaattgaaacgttggtgtcccggactcaaaatcctctcatatattggcagccacagagaactcaaagcaaagagacaggagtgggccgaacccaacagcttccacgtctgcatcacgtcctacactcagttcttccggggcctcaccgccttcacacgagtgcgctggaagtgcctggtcattgatgagatgcagcgcgtgaagggcatgaccgagaggcactgggaagcggttttcaccctgcagagccaacaacgtctgcttctgatcgactcgccgctgcacaataccttcctggagctctggaccatggtgcacttcctggtcccagggatctccaggccctacctgagctcccctctgagggcccccagtgaagagagccaggattactaccataaagtggtcataaggttacacagggtgacacagccatttattttgaggagaactaagagagatgtggaaaagcaactaacaaagaaatatgagcatgttttgaagtgtcgcctttctaaccgacaaaaagccttatacgaggacgttatcctgcaacctggcactcaggaggccttgaagagcgggcactttgtcaacgtcctgagcatccttgtgcggctgcagcgcatctgcaaccaccctgggctcgtcgagccccggcacccaggctcttcctacgtggcggggccactggagtatccgtccgcatctctaatcctgaaggcactggagagagatttctggaaggaagcagatctttctatgtttgatctcatcggcttagaaaataaaatcactcgtcacgaggcagagttgctgtctaagaaaaagataccgcggaaactcatggaggaaatctccacttcagcagccccagcagcccgaccagcagcagcaaagctgaaggccagcaggttgtttcagcctgtgcagtatggccagaagcccgagggtcgcaccgtggctttccccagcactcacccgccccggacggcagcccccaccacggcctctgctgctccacagggcccgcttcgaggacggccgcccatcgccacgttctctgccaatccggaggcaaaagcagcagcagccccgtttcagacctctcaggcttccgccagtgctccacgacaccagcccgcctcggcctccagcacagccgctagcccggcccatcctgcgaaactgcgggcccagaccacagcacaggccttcaccccaggccagcccccgccccagccccaggccccctcgcacgcggccgggcagagcgcgctgcctcagaggctggtgctcccctcgcaggcccaggcccgcttgcccagtggagaggtagtgaaaatagctcagctggcatccatcacaggaccacagagccgcgtggctcagccagagacgccggtgacactgcagttccagggcagcaagttcaccctgtcacacagccagctccggcagctcacagcgggccagccgctgcagctgcaaggcagcgtcctccagatcgtgtccgcccccgggcagccctaccttcgagcccctggccctgtggtgatgcagaccgtgtctcaggcgggcgctgtgcacggcgccctgggaagcaagcccccggccggcggtcccagccctgcacccttgaccccacaagttggcgttccgggccgcgtggcggtgaatgccttggctgtaggagaacccggaacggcctccaaaccagcttctcccattggagggccgacccaggaggaaaagaccagactcttgaaagagcgcctggatcagatttatttagtcaacgagcggcgctgttctcaagctccagtctatggcagagacttgctaaggatttgtgccctgcctagccatggaagggtacagtggcgtgggtccctggatggccgtcgtgggaaggaggccgggccagcgcacagttacacttcatcctcagaaagtccaagtgagctgatgttgacgctttgtcggtgtggagagtctctgcaggatgttattgacagggtggcctttgtgattcctccggtggtggcagcacccccgtccctacgggtgccgcggccgccacccctgtacagccacagaatgaggatcttgaggcagggcctgagagagcacgctgcgccgtacttccagcagctgcggcagaccacggctccacgcctgctgcagttccctgagctgaggctggtgcagttcgactcagggaagttggaagctttagctatcttgcttcagaaattgaaatctgaaggacgtcgggtgctgattttatcacagatgattcttatgttggacattttagagatgttcttgaacttccattacctcacctatgtaagaatcgatgaaaatgccagcagtgagcaacggcaggaactgatgaggagtttcaacagagacaggcggattttttgtgccattctctccactcacagccgtaccacaggtataaaccttgtagaggcggacaccgtcgtgttttatgacaatgacctgaatccagtgatggatgccaaagctcaggagtggtgcgataggatcgggagatgcaaagacatccacatatacaggcttgtgagtggcaattccattgaagagaaattgttgaaaaatggaactaaagatctgatccgagaagtggctgctcagggaaatgactactccatggctttcttaactcagcgaaccatccaggagctgtttgaagtttattctcccatggatgatgctggcttcccggtcaaagctgaggagtttgtggtgctttctcaggaaccttctgtcacggaaaccattgcacccaaaattgcaagacctttcatagaggccctcaagagtattgagtatctggaggaggatgcccagaagtccgcacaggagggggtgctgggaccacacactgatgctctgtcatcagactctgagaacatgccgtgtgatgaagaaccatcccaattagaggagctagctgacttcatggagcagcttacaccaattgaaaaatatgctttaaattacctggaattattccatacttctattgagcaagaaaaggagagaaacagtgaggacgcagtgatgactgcagtgagggcatgggagttctggaacctgaagaccctgcaggagagggaggcccggctgcggctggagcaggaggaggcggagctcctgacctacacgcgagaggatgcctacagcatggagtatgtctacgaagatgtcgatgggcagacagaagtcatgccgctctggaccccacccaccccgccgcaggacgacagcgacatctacctcgactcggtcatgtgtctcatgtatgaagccactcccatcccagaggctaagctgccccctgtgtacgtgaggaaggagcggaagcgacacaaaacagacccctcagctgcaggcaggaagaagaagcagcgtcacggggaggcggtcgtccctcctcggtccctgtttgaccgcgcaacaccaggacttctgaaaattcgcagagagggcaaggagcagaagaagaatattctgctgaagcagcaggtgccattcgccaagcccctgccaacttttgccaaacccacagctgagcctggtcaagacaaccccgagtggctcatcagtgaggactgggcgctgctgcaggctgtaaagcagttactggagctgcctttgaacctcacaatcgtgtcacctgctcacacacctaattgggatcttgtcagtgacgttgttaactcctgtagccgaatctaccgctcttccaaacagtgccggaatcgctacgagaatgtcatcattccacgagaggaggggaagagtaaaaacaaccgtcctctccgtacgagccagatctatgcccaggatgagaatgccacacacacccagctgtacacgagccactttgacttaatgaaaatgactgctggcaagaggagtcccccaatcaaacctctgcttggcatgaatccctttcagaagaaccccaagcacgcgtctgtgttggcagaaagtggaatcaactatgacaagccgctgcctcccatccaggtggcatctctccgtgcagagcgaatcgcaaaagagaaaaaggctctggctgatcagcagaaggcacagcagccggccgtggcccagccacccccgccccagccgcagcccccaccacccccgcagcagccaccgccaccgctgccacaaccacaggcagcgggcagccagccgccagcagggccaccagctgtccagccccaaccccagccacagccccagacccagccacagcctgtgcaggccccagcgaaggcgcagcccgcaatcacgacggggggcagtgcagccgtactggcaggaaccattaaaacatcagttactgggacgagcatgcccactggtgccgtgagtggaaatgtgatcgtgaacaccatcgcaggggtcccagctgccaccttccagtccatcaacaagcgcctggcgtcgccagtggctcctggggccttgactacgccgggaggctctgctcccgcccaggtggtgcacacccagcccccgccacgggcagtcggctccccagccacggcgacccctgacctggtgtccatggcaacgactcagggtgttcgagcggtcacttctgtgacagcctcggccgtggtcactaccaacctgaccccagtgcagaccccggcacggtctttggtgccccaagtgtcccaagccacaggagttcagctccctggaaaaaccatcacacctgcacatttccagcttctcaggcagcagcagcagcagcagcagcaacagcagcagcagcagcagcagcagcagcagcagcagcagcagcagcaacagcagcagcagcaacagacgacgacgacctctcaggtgcaagttccacagatccagggccaggcccagtccccagcacagatcaaagctgtgggcaagctgacgccggaacacctcatcaaaatgcagaagcagaaactgcagatgcccccgcagcccccaccgccacaggcccagtctgcgcccccgcagccagcagcccaagtgcaagtgcagacctcgcagccgccgcagcagcagagcccccagctcacgacggtcacggccccaaggcctggtgccctgctgacgggcaccaccgtggccaacctccaggtggcccggctcacccgggttcccacttctcaactgcagtcgcaagggcagatgcagacccaggcaccccagccagcccaggtgcccttggcgaagcctccggtggtgtccgtcccggcagctgtggtctcctcaccgggagtcaccaccctgcccatgaacgtcgcggggatcagcgtggcgatcggtcagccacagaaggcagcaggacagaccgtggtggcccagcccgtgcacatgcagcagctgctgaagctgaagcagcaggccgtccagcagcagaaggccatccagccccaggctgcacagggcccggcagccgtccagcagaagatcaccgcacagcagatcaccacccctggcgcgcagcagaaggttgcctacgccgcgcagccggcccttaagacccagtttcttaccacacccatctcccaggcccagaaactggccggggcccagcaagtgcagacccagatccaggttgcaaaacttcctcaagttgttcaacagcaaacacccgtggccagcatccagcaagttgcctctgcttcccagcaggcttctccacagactgtggcgctcacgcaggcgacggcggccgggcagcaggtgcagatgatccctgcagtgaccgcgactgcccaggtggttcagcagaaactcattcagcagcaggtggtgaccacggcgtcggccccgctccagactccaggcgctcccaacccagcccaggtgcccgccagctccgacagcccaagccagcagcccaagttacagatgagggtccctgctgtcaggctaaagacacctactaagcctccgtgccagtagtcagggcagcagggctgcctctcatctaaagcaaaactaccttcctcacagaaaacgctttattagtgaaccttgggaccatgtcacgcaagagattcagcactgggaaagatataattgaaacaaaatagtgtaatcattttattaaaatgcatcccacactgcaggacaaatggtccttatggagtgccgcgttctctgtactacgtggctcatggaaaaagtgacaacatggcttcctctaaatcatttcacctttcagtccccacccgcacccgtcccctagagccatagtactgtgttctgaaagccatttagaatttctttgtgagcatgtagtgctttgcacgccacagaagccgtctgccgtgtgtgaggagcatacaatggactttctaaagataaggcgtgggcttccacagtgtctgccagagtttagttctttataccttactgaaaaatgcctcgtggtcttcgcagaggggaaggcctgtctaaagtcaatcatccgagatgggttttccattccaaagaaaggcaatatggttccttccttccctcctaaaatatgacttaacttttaagagaaatgttctgacacccacctaaacacacaaggcacgttcctggcctgtgttcaagggaaatgatcagtcattgcattgttattccaaagagcagccaacagtggcctcccccaggccctaccctgcaatgggattcgctttcatttaatggaaacttctgggactgatgcccaactcagtgcactcaagacgcatctccagttttcgggggaagctggtatttgacatagtgtgttaaacagctcctgagaacctttgggacactctgccatggctggcgtgaggcccagaggaccacgcagaggcaatggtagtacagatgtcacagctgagggtacgatgaggcctgggctcagtgagccaggacgaatgtgacagacaccccttgctgccacagtcagccctttgacgaaggtgggctggtgattctggaagtattggctatagcggtgggcccagtcaactcttccttgtggacttacgacagcagattttctctaggataagcttgtgtggttctgccagtgaagcagagaaccacctgtgctgttgtggaaggcgtgccgttgagggggaaaacgaagcccagtatttgctactgtttttcctttttttactatgacaggaaaataaatgcaattttagtggaattgattgacagtgtctccttactttgaagttttcaccaaagcaaaaaggtccatatccaatagtatcctttgtgctgtggcttgattttggcctattttacattatttggtccaggaaattaggttatattaggttttttgtatactaaaaatcagttatggcacaataaagattttctgtttttaaattgtatttcatctgcttcctccccattctctcactttaagtgacattgaggaaggtattctgtcccacaggtttctgtggacagcgatacagcaggagtcagtgaaatcaactggggagctcacttgagctcttgataagaaatgtggagaaaagtaaaaaccaagctttgaagaaacagaagaaattaatcttttagttagttgaacataccaaagcagaggactggaatctgtttgttctaaccaacccgttctccctggcttggcacgtgccgtgagagcgcagcttgccggagggagggccgctgtgtgcgcctcacatctggctcccagtggaaacttttactcctcctcatccgcagatgtgatagaactgaagtatctaggaattctgcctttgtcatttgttttaatttgtgtgccctgttcattttttttgtctttcccaaatcttggtagtctccttatagttgaagataaaatgttgagtgcacttattttagaatatcctagacataactgtctaagtaaaagcgctctattaatctaaaacactacaagagaatttaacaccatctctcaaatgcttttttggagagcttaatgggattctgaatatttgcaatgtggagtttccgccccgatctcacgtcagtgagggtctcctgtctctcaagtgtgtttcctttggctgttccctaatacaaaacacggacatatttttactcgtagcactcaatttagtaacttctagatgctaccgttgacctgagttaaattcatttagtcgtgtacgtaaaaactctccttttagtgtgttattttcttggccttcccttttaaaggttaaagtttctaacctaagaattaagtacgcgttcaggaagctgttgtctaggccttccccttgtgaatctgggttcattccaatacggcaagtaagagttggaaactttgagaacacagactataaaggcagcagcccgaacactgtcagactctaattggcgaccctgggaaacagttgccctgctattctttaaagaaagacgtttattctgatgataaaaacagttagccagactgtttttaaagcacctggcgggaagcagaaggttggatccaagcccttgttcagatttggtgcctgataagacaggggtttctctttttgtgacctttattattattattttgttaactgttgtaaccagttagctgttgtgttttaagatagaaaggaacaagactaaaattgtaaatactttgtaaacatcagcatttgtacttgaatagtaggattgcaaccaacttaaccagtttcaatagcaaaacacaggaaataaaggcttacttctt

SEQ ID NO: 547903 - DNA, 476 bp, Homo sapiens
  misc_feature (205)..(205): n is a, c, g, or t
  misc_feature (216)..(216): n is a, c, g, or t
  misc_feature (221)..(221): n is a, c, g, or t
  misc_feature (224)..(224): n is a, c, g, or t
  misc_feature (226)..(226): n is a, c, g, or t
  misc_feature (240)..(240): n is a, c, g, or t
  misc_feature (243)..(245): n is a, c, g, or t
  misc_feature (248)..(248): n is a, c, g, or t
  misc_feature (253)..(253): n is a, c, g, or t
  misc_feature (256)..(256): n is a, c, g, or t
gctcgaccatccagccaatggggatgagtccccgggtcatcttacgtccctgcaggatgccatgtgcgagactatggagcagcagctctcctcggaccctgactcggaccctgactgaggatggcagctcttctgctcccccatcaggactggtgctgcttccagagacttccttggggttgcaacctggggaagccacatcccnctggatccacncccgnccncncttctccatcttanaannnccntctcntgnctcccgttctgttcatgatttgcctctggtccagtttctcatctctggactgcaatggtcttcttgtgctagaactcaggctcggctcggagttccacaggagtgttaggggcagggccgtgcaagtcagcccgcatgtgttcagaagctgctgcctgagggcagggcctacctgggcacacagaagagcatatgggagggcaggggtttgggtgtgggt

SEQ ID NO: 547904 - DNA, 3768 bp, Homo sapiens
  misc_feature (361)..(361): n is a, c, g, or t
gcggagagctggagcccagaggagctctgtagcaggcctcgaccggcgaccgccggtctagttatcatcactagcgcccgggaggagccgggagctgccgcagtccggtcccaggtcgaccatcgaccgataacatgagcaggcgaggccgagacccagcgaggcgtctggcgaagcctccggtggtgtccgtcccggcagctgtggtctcctcaccgggagtcaccaccctgcccatgaacgtcgcggggatcagcgtggcgatcggtcagccacagaaggcagcaggacaagagcgcgtgtgctggacaccgaagaccgctgtgcgagcaatagcaggtcaagacatggcgttgtacangctggtaaggcgagacagggctcagttcgctagcagtcagacatggcacatcacagcccccgagggctgtcgacatggggcccggcagccgtccagcagaagatcaccgcacagcagatcaccacccctggcgcgcagcagaaggttgcctacgccgcgcagccggcccttaagacccagtttcttaccacacccatctcccaggcccagaaactggccggggcccagcaagtgcagacccagatccaggttgcaaaacttcctcaagttgttcaacagcaaacacccgtggccagcatccagcaagttgcctctgcttcccagcaggcttctccacagactgtggcgctcacgcaggcgacggcggccgggcagcaggtgcagatgatccctgcagtgaccgcgactgcccaggtggttcagcagaaactcattcagcagcaggtggtgaccacggcgtcggccccgctccagactccaggcgctcccaacccagcccaggtgcccgccagctccgacagcccaagccagcagcccaagttacagatgagggtccctgctgtcaggctaaagacacctactaagcctccgtgccagtagtcagggcagcagggctgcctctcatctaaagcaaaactaccttcctcacagaaaacgctttattagtgaaccttgggaccatgtcacgcaagagattcagcactgggaaagatataattgaaacaaaatagtgtaatcattttattaaaatgcatcccacactgcaggacaaatggtccttatggagtgccgcgttctctgtactacgtggctcatggaaaaagtgacaacatggcttcctctaaatcatttcacctttcagtccccacccgcacccgtcccctagagccatagtactgtgttctgaaagccatttagaatttctttgtgagcatgtagtgctttgcacgccacagaagccgtctgccgtgtgtgaggagcatacaatggactttctaaagataaggcgtgggcttccacagtgtctgccagagtttagttctttataccttactgaaaaatgcctcgtggtcttcgcagaggggaaggcctgtctaaagtcaatcatccgagatgggttttccattccaaagaaaggcaatatggttccttccttccctcctaaaatatgacttaacttttaagagaaatgttctgacacccacctaaacacacaaggcacgttcctggcctgtgttcaagggaaatgatcagtcattgcattgttattccaaagagcagccaacagtggcctcccccaggccctaccctgcaatgggattcgctttcatttaatggaaacttctgggactgatgcccaactcagtgcactcaagacgcatctccagttttcgggggaagctggtatttgacatagtgtgttaaacagctcctgagaacctttgggacactctgccatggctggcgtgaggcccagaggaccacgcagaggcaatggtagtacagatgtcacagctgagggtacgatgaggcctgggctcagtgagccaggacgaatgtgacagacaccccttgctgccacagtcagccctttgacgaaggtgggctggtgattctggaagtattggctatagcggtgggcccagtcaactcttccttgtggacttacgacagcagattttctctaggataagcttgtgtggttctgccagtgaagcagagaaccacctgtgctgttgtggaaggcgtgccgttgagggggaaaacgaagcccagtatttgctactgtttttcctttttttactatgacaggaaaataaatgcaattttagtggaattgattgacagtgtctccttactttgaagttttcaccaaagcaaaaaggtccatatccaatagtatcctttgtgctgtggcttgattttggcctattttacattatttggtccaggaaattaggttatattaggttttttgtatactaaaaatcagttatggcacaataaagattttctgtttttaaattgtatttcatctgcttcctccccattctctcactttaagtgacattgaggaaggtattctgtcccacaggtttctgtggacagcgatacagcaggagtcagtgaaatcaactggggagctcacttgagctcttgataagaaatgtggagaaaagtaaaaaccaagctttgaagaaacagaagaaattaatcttttagttagttgaacataccaaagcagaggactggaatctgtttgttctaaccaacccgttctccctggcttggcacgtgccgtgagagcgcagcttgccggagggagggccgctgtgtgcgcctcacatctggctcccagtggaaacttttactcctcctcatccgcagatgtgatagaactgaagtatctaggaattctgcctttgtcatttgttttaatttgtgtgccctgttcattttttttgtctttcccaaatcttggtagtctccttatagttgaagataaaatgttgagtgcacttattttagaatatcctagacataactgtctaagtaaaagcgctctattaatctaaaacactacaagagaatttaacaccatctctcaaatgcttttttggagagcttaatgggattctgaatatttgcaatgtggagtttccgccccgatctcacgtcagtgagggtctcctgtctctcaagtgtgtttcctttggctgttccctaatacaaaacacggacatatttttactcgtagcactcaatttagtaacttctagatgctaccgttgacctgagttaaattcatttagtcgtgtacgtaaaaactctccttttagtgtgttattttcttggccttcccttttaaaggttaaagtttctaacctaagaattaagtacgcgttcaggaagctgttgtctaggccttccccttgtgaatctgggttcattccaatacggcaagtaagagttggaaactttgagaacacagactataaaggcagcagcccgaacactgtcagactctaattggcgaccctgggaaacagttgccctgctattctttaaagaaagacgtttattctgatgataaaaacagttagccagactgtttttaaagcacctggcgggaagcagaaggttggatccaagcccttgttcagatttggtgcctgataagacaggggtttctctttttgtgacctttattattattattttgttaactgttgtaaccagttagctgttgtgttttaagatagaaaggaacaagactaaaattgtaaatactttgtaaacatcagcatttgtacttgaatagtaggattttaaagggcattgatagcataccaaacaaaaggcaaaataaagtgacctttttataaaaaaaaaaagaaaaagtcgac

SEQ ID NO: 547905 - DNA, 305 bp, Homo sapiens
  misc_feature (6)..(6): n is a, c, g, or t
  misc_feature (179)..(179): n is a, c, g, or t
cgtttnggaggccaaggtgggcagatcacgaggtcaggagatcgagaccatcctggctaacaaggtgctaggattacaggcatgagcaccatgcccggccaagaatgttaatatatcttaaaaattaataaacttacatgttagcaaataacctttttaatgaaaaatattttctaaancaataaaattggaagagtagaattgttttacgcatttgaaaatttgaagatgtctggctccatagagacagctagattcctagatctccttcaacatatagcctgttgtgacttattgtttttgat

SEQ ID NO: 547906 - DNA, 2723 bp, Homo sapiens
tcctcccaccccccagataccaacctaacggctaggtagcgaggctgcgtgttgattttattaaaatgcatcccacactgcaggacaaatggtccttatggagtgccgcgttctctgtactacgtggctcatggaaaaagtgacaacatggcttcctctaaatcatttcacctttcagtccccacccgcacccgtcccctagagccatagtactgtgttctgaaagccatttagaatttctttgtgagcatgtagtgctttgcacgccacagaagccgtctgccgtgtgtgaggagcatacaatggactttctaaagataaggcgtgggcttccacagtgtctgccagagtttagttctttataccttactgaaaaatgcctcgtggtcttcgcagaggggaaggcctgtctaaagtcaatcatccgagatgggttttccattccaaagaaaggcaatatggttccttccttccctcctaaaatatgacttaacttttaagagaaatgttctgacacccacctaaacacacaaggcacgttcctggcctgtgttcaagggaaatgatcagtcattgcattgttattccaaagagcagccaacagtggcctcccccaggccctaccctgcaatgggattcgctttcatttaatggaaacttctgggactgatgcccaactcagtgcactcaagacgcatctccagttttcgggggaagctggtatttgacatagtgtgttaaacagctcctgagaacctttgggacactctgccatggctggcgtgaggcccagaggaccacgcagaggcaatggtagtacagatgtcacagctgagggtacgatgaggcctgggctcagtgagccaggacgaatgtgacagacaccccttgctgccacagtcagccctttgacgaaggtgggctggtgattctggaagtattggctatagcggtgggcccagtcaactcttccttgtggacttacgacagcagattttctctaggataagcttgtgtggttctgccagtgaagcagagaaccacctgtgctgttgtggaaggcgtgccgttgagggggaaaacgaagcccagtatttgctactgtttttcctttttttactatgacaggaaaataaatgcaattttagtggaattgattgacagtgtctccttactttgaagttttcaccaaagcaaaaaggtccatatccaatagtatcctttgtgctgtggcttgattttggcctattttacattatttggtccaggaaattaggttatattaggttttttgtatactaaaaatcagttatggcacaataaagattttctgtttttaaattgtatttcatctgcttcctccccattctctcactttaagtgacattgaggaaggtattctgtcccacaggtttctgtggacagcgatacagcaggagtcagtgaaatcaactggggagctcacttgagctcttgataagaaatgtggagaaaagtaaaaaccaagctttgaagaaacagaagaaattaatcttttagttagttgaacataccaaagcagaggactggaatctgtttgttctaaccaacccgttctccctggcttggcacgtgccgtgagagcgcagcttgccggagggagggccgctgtgtgcgcctcacatctggctcccagtggaaacttttactcctcctcatccgcagatgtgatagaactgaagtatctaggaattctgcctttgtcatttgttttaatttgtgtgccctgttcattttttttgtctttcccaaatcttggtagtctccttatagttgaagataaaatgttgagtgcacttattttagaatatcctagacataactgtctaagtaaaagcgctctattaatctaaaacactacaagagaatttaacaccatctctcaaatgcttttttggagagcttaatgggattctgaatatttgcaatgtggagtttccgccccgatctcacgtcagtgagggtctcctgtctctcaagtgtgtttcctttggctgttccctaatacaaaacacggacatatttttactcgtagcactcaatttagtaacttctagatgctaccgttgacctgagttaaattcatttagtcgtgtacgtaaaaactctccttttagtgtgttattttcttggccttcccttttaaaggttaaagtttctaacctaagaattaagtacgcgttcaggaagctgttgtctaggccttccccttgtgaatctgggttcattccaatacggcaagtaagagttggaaactttgagaacacagactataaaggcagcagcccgaacactgtcagactctaattggcgaccctgggaaacagttgccctgctattctttaaagaaagacgtttattctgatgataaaaacagttagccagactgtttttaaagcacctggcgggaagcagaaggttggatccaagcccttgttcagatttggtgcctgataagacaggggtttctctttttgtgacctttattattattattttgttaactgttgtaaccagttagctgttgtgttttaagatagaaaggaacaagactaaaattgtaaatactttgtaaacatcagcatttgtacttgaatagtaggattttaaagggcattgatagcataccaaacaaaaggcaaaataaagtgacctttttataaaaaaaaaaagaaaaagtcgac

SEQ ID NO: 547907 - DNA, 196 bp, Homo sapiens
taccgatcggctagttctcttactcctctagcctatcttgccctccctgaactacttttaggtaaacgtagtattgatatttttggtttttacccttcagatttgttggcaagaataggagaagcaaccaagcctggtgggacagtggagcacattggtcacattcttgtaaactgggtatggactaggccgatcg

SEQ ID NO: 547908 - DNA, 944 bp, Homo sapiens
  misc_feature (944)..(944): n is a, c, g, or t
ggtactaaacctaaagagaactatgaatagcttctgtcaaagtgatgctcataagatgaccaacagaccttcggaaactgctgcatgttggaagttctgaagcatgtgccatcacagaggaagctgatgacttgaaggctgctgttgccaacttgatggaatcaaccaaaacttgcagtgggtccagtgggagagaacaagatatgctaccagtaaatgtacagcatccagccttcatagtgtggacgagtgtaatgaaaatgggagtgctcagaagaccctcttggatgaaggctattctgtcatgggggattgtacctcagaaatggttagcaagtcatgtaactcctcatgtgagatgcacatggtgagcaaaactaatcctccaaaacaggtagatgaccagagtgatggccttcttactagcaatagctgcactgtgagtcagcgctccacaggggcctgtttccttacagatggggtgtattcccatgaggcttgtgctcagaaggagggcgtctatgagggagcttgcctaagtgatgagactcacattcctatcagagactgccatacaattcactctgtgcattcaaaagaaaacaaatgcactgatgatctggaatcaactgaagaactcaaactgttgacaaaagtcccaaaggttttagcttctggagaattctatgtttcacaatgagtctaatggtctacttttcaaaaggtcatttcgttagttcccaaggccttcctaagtgaactatctgaactggtagacataggccttaaaatttaatgcccgtgaaagggcgaagaacttttggagaacaccgtccctgccggctacagtgaacgaaaaccaattacggataagacgctcactaggggagacccggcgccacggctaaatgaagacacggggcacccaatatatcacaacaatn

SEQ ID NO: 547909 - DNA, 398 bp, Homo sapiens
taagcatagagacaagacggaataaacggaagtaagccaaaaaaaaccggatcggcaggcagataaccagcagcagacgaccgagccatcacgcagtcacaacgccggtcgataaattcagtaccggtgtacccgtactgaatacggacgagagccggatcgtcgccgatccgaacagattgtccctcttcgctaaaaatacgccggaagtagcggtggcgccgacccaccagacttatgtcatcgctttacaggatgcgcatcgcgctcggattactggtgacgatctgcccgccgggagcgatcaccatgatgcctactgacaggttggtgaccaccgaacgataacgtacttcactttcctccagactctgctccatgtactatacatcgattgc

SEQ ID NO: 547910 - DNA, 477 bp, Homo sapiens
gcccaccaaaaaattttttttggggaaacggaaataaaaatttctgcgagcaaaaaaatctacacccccctttgtgggccggggccccccttcaaaaaaacaccgggggcgcctttttttatgtaccccaggggaaaagagctctctcctctaagggggtcttctcccaccaaaggggttttgggggaagggccccccccccatgtttaaaaaacccagccccccccccccccacaaattcggggacaaaattttgggggggtaatacaacccccccgaggccccatttacacaccactggggggcgcccgggcttccctttggggggagaaattgcccacgccccctctggtgaaaaggaaaaacatcagggagccgcccccaaattaaaaaataaatcttctttaagagaatattttccgtcccccccacaaaatgaagaatttcttcgctccaccaaaaggggcttctcccaca

SEQ ID NO: 547911 - DNA, 412 bp, Homo sapiens
tgtacatattacatatgtacatatcgtataagatgaacttctctagtctttccattttctgaaactctttgacccagactcaggctgctagtatgatgtcccataccttataacgtctatatagtttaacccacacggatacccactgtggatcctagattgttttagattataaggctgcttgctaagagtgaaattctcatatcttagggcttgcctttaaaggatgaaagtacagaggctcgtttggctctaaagagaatacgcctttgatatagctgtatgtatatacaggtaagaaacttctcagatattactggctctagtggtctttactgcgtaacatataccccacatttagactctatgtgcccaactgtcttgcctatcgtgtctcctgatgtgctgctcc

SEQ ID NO: 547912 - DNA, 202 bp, Homo sapiens
tgatcgtcggattagcgggattggtgttccacgggctggcgagcagaatgccatgtgccatggagaagtctggcaggaggctgggcccacagtgagaagtaaggcaccattgttggtgcgagggcatagaggtggggcggtggaccaccatttggtaatcttctgtctttgcatattgtgatgggtctcgtctgtaggtatg

SEQ ID NO: 547913 - DNA, 81 bp, Homo sapiens
agcttctacatctgcagtgctagaggaggccggtcgcccactgaagctttctttggacaaggcaccagactcacagttgta

SEQ ID NO: 547914 - DNA, 219 bp, Homo sapiens
acttttattgttggtcttcttgcatcgatgatccaacagcaacaccattttttaattattgtgaaaagattaactggcaatgtacagagtttactcaaagtttttttaagggaaaaccctccaaaaagtcccaaggataccaaatggaaacacatgatgatgcctttgggtttgtatgagaccgtgatgaagtaaaaataaagcccttttgagatggca

SEQ ID NO: 547915 - DNA, 343 bp, Homo sapiens
ctgatggtgtaaagaaatgctcgtgatctatgcccattgattgcgtatcctgagcttattcaggcattcgttatcaatctaagtagtgttggggctccgatgatggcgtgttatgcgatacaacatcatgtcatctgcaagcacagtcaatctgacttcccctgtgcgactttggatagtcttgaactagctctctagcgtgattgccctgtccagaacttccaatcacagggaatgctcccagctcatgctcattcagtatgatataggctggaggtttgtcatacataggtcgcattattaggaggtatgtctcatcaaggcttagtaagctcaaagttat

SEQ ID NO: 547916 - DNA, 116 bp, Homo sapiens
caagccaattgctaaatcagctagcattcatactcggtaacacaataagttggcaacaacaataagtttgtatcttggttattaacatgtatctgggcctggtttgggcagaatat

SEQ ID NO: 547917 - DNA, 147 bp, Homo sapiens
  misc_feature (1)..(1): n is a, c, g, or t
  misc_feature (111)..(111): n is a, c, g, or t
ncttcaggtgacatgccctgctcccctcttcaccctcgatcatgattgtaaacttcgtgaggacatcaccaaaggctgacattgacggcatgcgtcctgtacaatctgcanaacaacgatggaacaaaataaacaccttttctttat

SEQ ID NO: 547918 - DNA, 122 bp, Homo sapiens
ctagtccgagacatattatatatcattactaaatgttaaactattacaacacagccataaaacagcatttgcgtttatggagagagaggatgtgccatcatggttaatgaaaactatctttt

SEQ ID NO: 547919 - DNA, 536 bp, Homo sapiens
aatcccacgatggatcacctgaggtcaggagttcaagaccagcctggccaacaaggtgaaaccctgtctctattaaaaatacaaaaattagctgggcgtgggggcgcgtgcctgtaatcccagctactcaggaggctgaggcaggagaatcacttgaacccaggaggcagaggttgcagtcagccgagattgtgccattgcactccagcctgggcgacaagagcaaaactccgtctacaaaaaaaaaaagggctccaaagaagaaaaggcactgggcgtagcgtcctatccattacgtggagtacttagacaggattccagcaggacgaggcgacatccatggtcccataagaacaggacttgcaagttttcaccaggttattaaagagcctcttaacactaagacataaggagacctcatgctctacagaaaggaagtacaaaaatttcgcggacttggtgggcacgtgcctgtagtcccaatactcagggggctgaggggggaagattccttgagcccaggaggtcaagacggg

SEQ ID NO: 547920 - DNA, 187 bp, Homo sapiens
aattagccgacgcattctactgcagaatgtgttatattgtggatactggaagatgtacagctttttgatttgaacaacgaagtgcataaattagaaacttccaagtgcactggttttggaagagatatatatatataaaatacatttattctgtcaggctaaaaataaagtatgatctttatgattc

SEQ ID NO: 547921 - DNA, 350 bp, Homo sapiens
tttttggagacagagtctggctctgtcacccaggctggagtgcagtggcacatctcggctcactgcaagctccacctcctgggttcacgccattctcctgcctcagcctccccagtggctgggactacaggtgcccgccaccacgcccggctaattttctgtatttttagtagagacggggtttcgccgtgttagccaggatggtctcgatctcctgaccttgtgatccgcccgcctcagcctcccaaagtgctgggattacaagcatgagccactgcaccagacctaaatactatatatttaaaaagcatcaggctggaggtggtggctcatgcctgtaatccgtcgac

SEQ ID NO: 547922 - DNA, 156 bp, Homo sapiens
gtttatccgtccttctggctccagctgctcaaacatgtaccactcacatgaagcccacttgtgggccctgcacacaactatataccccacaatgaattcaggaatgcaaaactcttgcagatttttttcaacgtttctcgggtttttttttgtgtt

SEQ ID NO: 547923 - DNA, 202 bp, Homo sapiens
agctctgtgatgatggatctgagatagtcaagatgcgagccttcgtagatgctatgaccaacgtggatgttattgctggaggtcacacatgatgttcttgttcttaggctccttatatacactgatcagagctttgggttcttgagagagcaacctacagcgattcttgaatgttttatgaatcgacagtgcagggtatcct

SEQ ID NO: 547924 - DNA, 1050 bp, Homo sapiens
  misc_feature (1050)..(1050): n is a, c, g, or t
ggacacacgtggcctcgtgtgtctcaaatacatgaccatgtgtcctgagtgtggcaatgtcccaacattggaagatgtgttggagcgtcatgaaacttcacactgagtgtaaaacccctgaaccacatacggactggcctgcccctgacctgtggccagatgatagtgaaatgcatgtagcctccacctgtggggtgcttctagtgaggacagccacgctcagtgggagtgggcacgatctgccagagtcggagcttgtgccccctgtttgcgcatgtgctgtgcacacatgtccatgcaatgacacgacactgttgcggcgacattgaactgctttgtgcaactgaccaggaacgtcaccttgtgcctgagagttgtgccacagatgccccatgaaatcaagagccaagggtcttgtactcgacccatgacgagattactggctaattcataaccaacttctttccacgggacacgacaaggatgtgggaccctgacacgacttacgccctatctatgataccttacgaacgatcataagacgatacgaagaacaaggaacgcaacaaggggaaaattcaaccttccccttcaaccacagagccaccttatcacactcatcaaccttggcaactggcttctcacggcaacgcgtgggcatgcacgccacgacaagcacgtgcaaccacgtatggtgggcacacattgcgattgggagccgccttgcgcaagacagtatctgactgaggacacgtaccccatatcccccgttgggttccaaccgaaaagttcagacaaacattttacatcagcagatgttgacctcccacaggatcaggggcgaacagcccatcatctatgcagctggagccacagcagcaatgtaccaagtgaccagacccgctcgacccaatggagaccaccccattctataacacacagtcgcagcataggcatcagtgcggatcccacatatcgagtaccaccgatttgatttacagcaacccgaacacgcccagatatcatacggcgcacacaacacaacaccan

SEQ ID NO: 547925 - DNA, 155 bp, Homo sapiens
aacgcagtcatagtaatatggtcagtgttcatgtagtgcttgggtggccctagctcaggcatgctggctcatagaatgagttagaaagtattcctcctcttcaagttttgaaagagttgcaaaggactggcattaattttcgttaaatgtctggt

SEQ ID NO: 547926 - DNA, 288 bp, Homo sapiens
cccaaaaagtgttaattccatgtcacttttctacataccaagtggtccccttcttattctgtataacactaagtactcaaaggacacaacaattaaaagatactttatcttcagtcaatgtagttctactggtataaagtaatggtgggggacgcggttcgtatatttcatctctcacagtacacgtttcccaatcaatctatcggaatacttattagccgaggccaggcgcggtggctcatccctgttatccccgcagtttgggaggctgaggcaggcggctcactt

SEQ ID NO: 547927 - DNA, 426 bp, Homo sapiens
gcacccaggcacttctggatgggaccctgtctggactccacgtggaatttaggcaagacacttagaatatgttctgggatctgggtcaagttgtagtaggggatggacatgggtctcgagagagatgtgcgtggcgcagaagacggacagtgttcattccgcctcacctgggctatggggaagctgggcgtggatggaccagagtgcccggtacggccgcatgagtgtaggagattgatgtgctggagctggtggctggccttcctgaggggtacatgttcatatggaatggtgaggtgtcacccaacctctttgaagaaattgacaaggatggcaacggagaagtcctcctggaagagttctcagagtacattcacgcccaggtggcatctggcaaagggaaactcgctcctggctttgatgctg

SEQ ID NO: 547928 - DNA, 629 bp, Homo sapiens
actaagttatattagaattataggagtttcacataattttggaacatacaccaataacatatttatacaaatacagcccaaagaaaaccaaacaccatttcacatttgacaatgcttcctatataatttttataccaaataagccaaattatgtcattttaggactttagggaaactaagatcttaaaggattaattaggttagaaaaatacataatttataatttgattttggaaagcttgtcaaatacaaaaggtttaaaacacttgacattacaaaataaaattacaggtcatcgtaaagtcatttatttaatccaagtgataattcaaggatttcaaaaaaagcaaaaaccttcattctttgagagaggtgacttaactttctaaacaagaagccctaataaaaacagcctgaagccaatcacatttgatttttaaaattttgtaaacaaactataagatttaatcttgattttaaaatataactttcataagccttttataacctttatgaaagagttggttaatgctttaaaaaaaccttgctaataagacacaaggggtgcctatactgaattttgataagtgtgccttttaacttgaaggattaatttataaagaaactgg

SEQ ID NO: 547929 - DNA, 184 bp, Homo sapiens
tcaacaccatggaagcgagtaactgcgtgaatacattcacactcttttaggtatattttgtactttcaaaataatatgacatcttaattgtggttctgtgcattctttcgaagacaatatttgcttattcatgtagcgagccagaccacaactactcgacgatctgctgctactaccatacgtg

SEQ ID NO: 547930 - DNA, 891 bp, Homo sapiens
ggaacaacaacaataaaaaaaactactgatcgttactgactttgcctaatatacacaagcagctgatgtactattaatgagagcgaatatacacattaggaaaatggacgccattccaacctagtggtatgggcaaggatggggaagagaaggggaaactattcatagtggatcgtggagttacattgaattaggcccctcctgaaaaggtggttgtcattggcattaattcaaagcaggtaatatgcaggaatgtaactgaggattatcttcaggcaatcagcaagatatcctcctcatggtccctttagctctcaaaggagcaatgagaatcctccggtctcatgtttactggctgtggttgtgctgctgaacaatactatcttctcaaattccatgccagaaattcagccaataacttttggatgtgaatttaacaaagatactgtaattggatgctgatgtggacaagaatatattgatttcgattgtcactcccgaatgtgatggcaccagtcttttatataggctgctgtggtatttgtaaaaccagaaggttctttaaattatgttgcaaggtgatctttggtgaatgtggggggggaatggctaagtgattaggttcgaagacacagctttaaatgatttagaatgggaggattcggggtacgttcaggaaataaagggatcctgggggtgtaccctcaggggagttgggaatgtttttttaaatctagagtcctggaacaatttagaaagatttatgggggtgtttaggatttcggccataatgaaagagcgttggtggggaacataaaacgtctttaagaaaaaaaaaaattgtggggcgcgaaaaaaaagggggcgggaagatatttgacagagggacag

SEQ ID NO: 547931 - DNA, 111 bp, Homo sapiens
aaccgtcctgcccacagtggataacttccctttctgaagttgattataccaaggaacaataggaatcattaggacaaattattattactgcttcatggtgcgacgatagct

SEQ ID NO: 547932 - DNA, 474 bp, Homo sapiens
actcatgcgtgtaagcatctgtaagacacgaacagtggtcaccaagagatcatgtgcactacaagcccatgtcatttaaatgaaagaaaaaaaccttggaaataaagtggtacatgcaaactttaacttccttagataccatgctgcagatttcagcactgttaagggtatagcaagaatgcccaaccctctggtgtctgatcatgtatctagcaacatggcagtatgaagaaaggagatgccccggtctcagcccatggactagttaatacagtgaagcaggttcctgtcttttacccttcctgctcagaacataaaagattaaggactaaaatcacggaagactgggagttttagagctggcaccatgacgtctaaaagataaatcaaggcaaacaattactgagaacttggcctgtagcttaacctggcaagtctaaaagcctttctttaaccttgtaggaattagatgca

SEQ ID NO: 547933 - DNA, 368 bp, Homo sapiens
tgtaaatgcattcaggatcatactaccataatcttggatgaataggcatctgtgttccatctatccatactaatctcctatagtcaataggtcactgtaccacagctcctttagtgtatactcccacacatgttcacacaacctgggcaagctgaaaaacttcaccatatccttaaattctgcttccttttctctgacggaaactgaggttctctattctgtcacgcaggtctagagcgcaacacctgaatcatggctcacttgaaacctctgtccttcctgggttcaagctatcttcctcacttcagtcctgactgaatatagctgggattacatgagtcgtgtgcctatcacgcccaactacttat

SEQ ID NO: 547934 - DNA, 328 bp, Homo sapiens
ggtggcctgacgcgaggtggtgcgtctcttggcctgctctactcgttatgtccggttgaacgtgtctgaacatgtcggtcattcccaggttctctagtgggcttcctgaggtcgacttcagtctccagggagaacttgggcagaaccaggaggcgggtgcagcctggtcatgttgccttaccagtggccgatgagctgggcactcagaatgttggtgagggcagagagaggcacctctttatcataaggggcagcaatgaacatgctgagggtgtccccgtggtagggcagttccaggatgtcgtaataaggggccatcgggcggaga

SEQ ID NO: 547935 - DNA, 232 bp, Homo sapiens
gaatcttggtacgtaagaatcatagggagaagagccaggcactgtcatagtcccagaatcttctgacagtgttatgcccttgaactatgggctacttgttccctagagcaatagttcttttttttttttttttggaaataatttcttgccttgtggcccaggcggaattgcagtgattgaccccattcgcggctctcaccgcacccctccgccctccggggttacaaacaat

SEQ ID NO: 547936 - DNA, 9882 bp, Homo sapiens
agcggggcggcggcgcggcttccatcctcccgccctcctgacgcggccggagcgcagccctgaggcccagggagaacgacacattggatacagaagggaggtgatcatgcaccatggcactggcccccagaacgtccagcatcagctgcagaggtccagggcctgccctggcagcgagggtgaggagcagccggcccaccccaacccacccccgtcccccgcagctcccttcgctccctcagcaagcccgtcggcaccccagtctcccagttatcaaatacagcagctgatgaataggagccctgcaaccgggcagaacgtgaacatcaccctgcagagcgtgggccctgtcgtcgggggaaaccagcagatcacactggccccactgccgctccccagccccacctctccaggcttccagttcagcgctcagcctcggcggtttgagcatgggtctccatcatacattcaggtcacgtcccccttgtcccagcaggtccagacccagagtcccacgcagcccagtccggggccggggcaggccttgcagaatgtgcgtgcaggtgcccctggccctgggctgggcctctgcagcagcagccctacaggggacttcgtggatgccagcgtgctggtgaggcagatcagcttgagcccctccagtggtggacactttgtgtttcaggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacgcccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcattaccaggagatgcaggctctgaaggaggtcttcaaggagtatttgattgaactgtttttcttgcaacactttcaagggaacatgatggatttcttagctttcaaggagagactgtatggaccattacaagcatatcttaggcagaatgatttggacattgaagaagaggaggaggaggaggaagaggaggaagaaaaatctgaggttatcaatgacgagcagcaagccctcgcagggagcctggtagcaggggccggaagcacagtagagacggacctgtttaagaggcagcaggcgatgccctccacaggtatggcagagcagtctaagaggcctcgccttgaagtgggtcaccaaggggtagttttccagcacccaggggcggacgcaggcgttcctctccagcaactaatgccgaccgcacaaggaggaatgccccccacgccgcaggccgcgcagctcgctggacagaggcagagtcagcagcagtatgacccctccacggggcctcccgtgcagaacgctgccagcttgcacaccccactgccgcagctgcccgggaggctgcccccagccggtgttcccactgcagccctctcctctgcgctgcagtttgcacagcagccgcaagtggtagaggcccagacacagctccaaatcccggtgaagactcagcagcccaatgttcccatccctgcaccgcccagcagccaactccccatccctccctcgcagcctgcacagctggccctccacgttcccacacctggaaaggtgcaggtgcaggcctctcagctttcctccctgccacagatggtagcatcgacaaggctccctgtggaccctgccccgccctgcccacggcctctgcccacctcttctacctcgtccctcgcgcctgtgagtggctccggcccaggaccctcccctgctcgatcctctccagtaaatagaccttcctcagccaccaataaggcactatctccagtcacttcccggaccccaggggtggtggcatctgcccccaccaaaccacagagtcctgctcagaatgccacctcgtcccaagacagttctcaggatacgctgacagaacaaataactctggagaaccaggtgcatcagcgcattgcggagctgaggaaagcaggtctgtggtcccagaggcgtctgccaaagctgcaggaggccccacgccccaagtcccactgggactatctgctggaggagatgcagtggatggccacagactttgcccaggagaggaggtggaaggtggctgctgcgaagaagctcgttagaactgtggtgcgccatcacgaggagaagcagctccgtgaagaaagggggaagaaggaagagcagagcagactgaggcggatagccgcctccacggcccgggagatagagtgcttttggtcgaatattgaacaggttgtggaaataaaactacgagtagaattagaagaaaaaaggaagaaggccttaaatttacagaaagtttccaggagagggaaagaattgagacctaaaggatttgacgcattacaggaaagttctctggattcaggaatgtctggaagaaaaagaaaagctagcatatctttgactgatgacgaagtggacgatgaagaggaaacaattgaagaggaggaagcaaatgaaggcgttgtggaccaccaaacagaactttctaatttagccaaggaagctgagctgcccctcctggacctgatgaagctgtacgaaggcgccttcctgccgagttctcagtggccccggccgaagcctgatggggaggacacaagcggagaggaagatgcagatgactgtccaggcgacagggagagtcgcaaggacttggttctcatcgactcgcttttcatcatggatcagttcaaagctgccgagaggatgaatatcgggaagccaaacgccaaggacattgcggacgtcactgcggtggctgaagccatcctgccgaagggcagtgctcgggtcacaacctcggtcaagtttaatgctccatctttgttgtatggggctctcagagattatcagaagattggcctggactggctggccaaactttacaggaagaatctcaatggcatattggcagatgaagctgggctgggtaaaacagtgcagatcattgctttttttgcccacctagcttgtaacgaaggtaattggggcccccatcttgttgttgtgagaagttgtaacatactcaagtgggagcttgaattgaaacgttggtgtcccggactcaaaatcctctcatatattggcagccacagagaactcaaagcaaagagacaggagtgggccgaacccaacagcttccacgtctgcatcacgtcctacactcagttcttccggggcctcaccgccttcacacgagtgcgctggaagtgcctggtcattgatgagatgcagcgcgtgaagggcatgaccgagaggcactgggaagcggttttcaccctgcagagccaacaacgtctgcttctgatcgactcgccgctgcacaataccttcctggagctctggaccatggtgcacttcctggtcccagggatctccaggccctacctgagctcccctctgagggcccccagtgaagagagccaggattactaccataaagtggtcataaggttacacagggtgacacagccatttattttgaggagaactaagagagatgtggaaaagcaactaacaaagaaatatgagcatgttttgaagtgtcgcctttctaaccgacaaaaagccttatacgaggacgttatcctgcaacctggcactcaggaggccttgaagagcgggcactttgtcaacgtcctgagcatccttgtgcggctgcagcgcatctgcaaccaccctgggctcgtcgagccccggcacccaggctcttcctacgtggcggggccactggagtatccgtccgcatctctaatcctgaaggcactggagagagatttctggaaggaagcagatctttctatgtttgatctcatcggcttagaaaataaaatcactcgtcacgaggcagagttgctgtctaagaaaaagataccgcggaaactcatggaggaaatctccacttcagcagccccagcagcccgaccagcagcagcaaagctgaaggccagcaggttgtttcagcctgtgcagtatggccagaagcccgagggtcgcaccgtggctttccccagcactcacccgccccggacggcagcccccaccacggcctctgctgctccacagggcccgcttcgaggacggccgcccatcgccacgttctctgccaatccggaggcaaaaggtggagaggtagtgaaaatagctcagctggcatccatcacaggaccacagagccgcgtggctcagccagagacgccggtgacactgcagttccagggcagcaagttcaccctgtcacacagccagctccggcagctcacagcgggccagccgctgcagctgcaaggcagcgtcctccagatcgtgtccgcccccgggcagccctaccttcgagcccctggccctgtggtgatgcagaccgtgtctcaggcgggcgctgtgcacggcgccctgggaagcaagcccccggccggcggtcccagccctgcacccttgaccccacaagttggcgttccgggccgcgtggcggtgaatgccttggctgtaggagaacccggaacggcctccaaaccagcttctcccattggagggccgacccaggaggaaaagaccagactcttgaaagagcgcctggatcagatttatttagtcaacgagcggcgctgttctcaagctccagtctatggcagagacttgctaaggatttgtgccctgcctagccatggaagggtacagtggcgtgggtccctggatggccgtcgtgggaaggaggccgggccagcgcacagttacacttcatcctcagaaagtccaagtgagctgatgttgacgctttgtcggtgtggagagtctctgcaggatgttattgacagggtggcctttgtgattcctccggtggtggcagcacccccgtccctacgggtgccgcggccgccacccctgtacagccacagaatgaggatcttgaggcagggcctgagagagcacgctgcgccgtacttccagcagctgcggcagaccacggctccacgcctgctgcagttccctgagctgaggctggtgcagttcgactcagggaagttggaagctttagctatcttgcttcagaaattgaaatctgaaggacgtcgggtgctgattttatcacagatgattcttatgttggacattttagagatgttcttgaacttccattacctcacctatgtaagaatcgatgaaaatgccagcagtgagcaacggcaggaactgatgaggagtttcaacagagacaggcggattttttgtgccattctctccactcacagccgtaccacaggtataaaccttgtagaggcggacaccgtcgtgttttatgacaatgacctgaatccagtgatggatgccaaagctcaggagtggtgcgataggatcgggagatgcaaagacatccacatatacaggcttgtgagtggcaattccattgaagagaaattgttgaaaaatggaactaaagatctgatccgagaagtggctgctcagggaaatgactactccatggctttcttaactcagcgaaccatccaggagctgtttgaagtttattctcccatggatgatgctggcttcccggtcaaagctgaggagtttgtggtgctttctcaggaaccttctgtcacggaaaccattgcacccaaaattgcaagacctttcatagaggccctcaagagtattgagtatctggaggaggatgcccagaagtccgcacaggagggggtgctgggaccacacactgatgctctgtcatcagactctgagaacatgccgtgtgatgaagaaccatcccaattagaggagctagctgacttcatggagcagcttacaccaattgaaaaatatgctttaaattacctggaattattccatacttctattgagcaagaaaaggagagaaacagtgaggacgcagtgatgactgcagtgagggcatgggagttctggaacctgaagaccctgcaggagagggaggcccggctgcggctggagcaggaggaggcggagctcctgacctacacgcgagaggatgcctacagcatggagtatgtctacgaagatgtcgatgggcagacagaagtcatgccgctctggaccccacccaccccgccgcaggacgacagcgacatctacctcgactcggtcatgtgtctcatgtatgaagccactcccatcccagaggctaagctgccccctgtgtacgtgaggaaggagcggaagcgacacaaaacagacccctcagctgcaggcaggaagaagaagcagcgtcacggggaggcggtcgtccctcctcggtccctgtttgaccgcgcaacaccaggacttctgaaaattcgcagagagggcaaggagcagaagaagaatattctgctgaagcagcaggtgccattcgccaagcccctgccaacttttgccaaacccacagctgagcctggtcaagacaaccccgagtggctcatcagtgaggactgggcgctgctgcaggctgtaaagcagttactggagctgcctttgaacctcacaatcgtgtcacctgctcacacacctaattgggatcttgtcagtgacgttgttaactcctgtagccgaatctaccgctcttccaaacagtgccggaatcgctacgagaatgtcatcattccacgagaggaggggaagagtaaaaacaaccgtcctctccgtacgagccagatctatgcccaggatgagaatgccacacacacccagctgtacacgagccactttgacttaatgaaaatgactgctggcaagaggagtcccccaatcaaacctctgcttggcatgaatccctttcagaagaaccccaagcacgcgtctgtgttggcagaaagtggaatcaactatgacaagccgctgcctcccatccaggtggcatctctccgtgcagagcgaatcgcaaaagagaaaaaggctctggctgatcagcagaaggcacagcagccggccgtggcccagccacccccgccccagccgcagcccccaccacccccgcagcagccaccgccaccgctgccacaaccacaggcagcgggcagccagccgccagcagggccaccagctgtccagccccaaccccagccacagccccagacccagccacagcctgtgcaggccccagcgaaggcgcagcccgcaatcacgacggggggcagtgcagccgtactggcaggaaccattaaaacatcagttactgggacgagcatgcccactggtgccgtgagtggaaatgtgatcgtgaacaccatcgcaggggtcccagctgccaccttccagtccatcaacaagcgcctggcgtcgccagtggctcctggggccttgactacgccgggaggctctgctcccgcccaggtggtgcacacccagcccccgccacgggcagtcggctccccagccacggcgacccctgacctggtgtccatggcaacgactcagggtgttcgagcggtcacttctgtgacagcctcggccgtggtcactaccaacctgaccccagtgcagaccccggcacggtctttggtgccccaagtgtcccaagccacaggagttcagctccctggaaaaaccatcacacctgcacatttccagcttctcaggcagcagcagcagcagcagcagcaacagcagcagcagcagcagcagcagcagcagcagcagcagcagcagcaacagcagcagcagcaacagacgacgacgacctctcaggtgcaagttccacagatccagggccaggcccagtccccagcacagatcaaagctgtgggcaagctgacgccggaacacctcatcaaaatgcagaagcagaaactgcagatgcccccgcagcccccaccgccacaggcccagtctgcgcccccgcagccagcagcccaagtgcaagtgcagacctcgcagccgccgcagcagcagagcccccagctcacgacggtcacggccccaaggcctggtgccctgctgacgggcaccaccgtggccaacctccaggtggcccggctcacccgggttcccacttctcaactgcagtcgcaagggcagatgcagacccaggcaccccagccagcccaggtgcccttggcgaagcctccggtggtgtccgtcccggcagctgtggtctcctcaccgggagtcaccaccctgcccatgaacgtcgcggggatcagcgtggcgatcggtcagccacagaaggcagcaggacagaccgtggtggcccagcccgtgcacatgcagcagctgctgaagctgaagcagcaggccgtccagcagcagaaggccatccagccccaggctgcacagggcccggcagccgtccagcagaagatcaccgcacagcagatcaccacccctggcgcgcagcagaaggttgcctacgccgcgcagccggcccttaagacccagtttcttaccacacccatctcccaggcccagaaactggccggggcccagcaagtgcagacccagatccaggttgcaaaacttcctcaagttgttcaacagcaaacacccgtggccagcatccagcaagttgcctctgcttcccagcaggcttctccacagactgtggcgctcacgcaggcgacggcggccgggcagcaggtgcagatgatccctgcagtgaccgcgactgcccaggtggttcagcagaaactcattcagcagcaggtggtgaccacggcgtcggccccgctccagactccaggcgctcccaacccagcccaggtgcccgccagctccgacagcccaagccagcagcccaagttacagatgagggtccctgctgtcaggctaaagacacctactaagcctccgtgccagtagtcagggcagcagggctgcctctcatctaaagcaaaactaccttcctcacagaaaacgctttattagtgaaccttgggaccatgtcacgcaagagattcagcactgggaaagatataattgaaacaaaatagtgtaatcattttattaaaatgcatcccacactgcaggacaaatggtccttatggagtgccgcgttctctgtactacgtggctcatggaaaaagtgacaacatggcttcctctaaatcatttcacctttcagtccccacccgcacccgtcccctagagccatagtactgtgttctgaaagccatttagaatttctttgtgagcatgtagtgctttgcacgccacagaagccgtctgccgtgtgtgaggagcatacaatggactttctaaagataaggcgtgggcttccacagtgtctgccagagtttagttctttattattattattttgttaactgttgtaaccagttagctgttgtgttttaagatagaaaggaacaagactaaaattgtaaatactttgtaaacatcagcatttgtacttgaatagtaggattttaaagggcattgatagcataccaaacaaaaggcaaaataaagtgacctttttataaaaaaaaaaagaaaaagtcgac

SEQ ID NO: 547937 - DNA, 777 bp, Homo sapiens
gagcggacgtgaggtgtgcgcgcgcgcggacgcgcggcggacgctggaactgctgcagctgcctgcgccgcccggaggaaccttgatccccgtgctccggacaccccgggccctcgccatggcgtgaccagctgcactgagcgagcagctcgcagagttcaaggaggccttctccctctttgacaaggatggcgcatggcactatcaccacccaggcacgcttggggaccgctgactgagatcccctgggcacaggaaccccactgaagccagagctgccggcatctgatcacatgcaggctggcatgccccactgtggcacccgggcacccattgaccttccccggaagcttccctggacccatgcactggccacgccacagcatgcaacgcgacaccacgaaccaccctgacggacacgcagatccctgcagcaaggggcggttacccagcgtgatcctgtctgaaccacacgggactgggcgaacttggacctacccatttcactgacggcccgcccagaagccttggcggtctttccccctgttaaccttgaacccaaaacccccttgaggtggggactgcaacacggcccgcacccccggaatgcaacgggtacggccttgggcaatcgaaccaactggcactgccacgcgggcacggggcgtgcacatcacttccggcatgcgcagcacatgaggcgcccgggctccaccctgtcgtcgacatcaggcttcatggctccacacggcatttactgcacccgccacacatgaa

SEQ ID NO: 547938 - DNA, 6651 bp, Homo sapiens
agcggggcggcggcgcggcttccatcctcccgccctcctgacgcggccggagcgcagccctgaggcccagggagaacgacacattggatacagaagggaggtgatcatgcaccatggcactggcccccagaacgtccagcatcagctgcagaggtccagggcctgccctggcagcgagggtgaggagcagccggcccaccccaacccacccccgtcccccgcagctcccttcgctccctcagcaagcccgtcggcaccccagtctcccagttatcaaatacagcagctgatgaataggagccctgcaaccgggcagaacgtgaacatcaccctgcagagcgtgggccctgtcgtcgggggaaaccagcagatcacactggccccactgccgctccccagccccacctctccaggcttccagttcagcgctcagcctcggcggtttgagcatgggtctccatcatacattcaggtcacgtcccccttgtcccagcaggtccagacccagagtcccacgcagcccagtccggggccggggcaggccttgcagaatgtgcgtgcaggtgcccctggccctgggctgggcctctgcagcagcagccctacaggggacttcgtggatgccagcgtgctggtgaggcagatcagcttgagcccctccagtggtggacactttgtgtttcaggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacgcccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcattaccaggagatgcaggctctgaaggaggtcttcaaggagtatttgattgaactgtttttcttgcaacactttcaagggaacatgatggatttcttagctttcaaggagagactgtatggaccattacaagcatatcttaggcagaatgatttggacattgaagaagaggaggaggaggaggaagaggaggaagaaaaatctgaggttatcaatgacgagcagcaagccctcgcagggagcctggtagcaggggccggaagcacagtagagacggacctgtttaagaggcagcaggcgatgccctccacaggtatggcagagcagtctaagaggcctcgccttgaagtgggtcaccaaggggtagttttccagcacccaggggcggacgcaggcgttcctctccagcaactaatgccgaccgcacaaggaggaatgccccccacgccgcaggccgcgcagctcgctggacagaggcagagtcagcagcagtatgacccctccacggggcctcccgtgcagaacgctgccagcttgcacaccccactgccgcagctgcccgggaggctgcccccagccggtgttcccactgcagccctctcctctgcgctgcagtttgcacagcagccgcaagtggtagaggcccagacacagctccaaatcccggtgaagactcagcagcccaatgttcccatccctgcaccgcccagcagccaactccccatccctccctcgcagcctgcacagctggccctccacgttcccacacctggaaaggtgcaggtgcaggcctctcagctttcctccctgccacagatggtagcatcgacaaggctccctgtggaccctgccccgccctgcccacggcctctgcccacctcttctacctcgtccctcgcgcctgtgagtggctccggcccaggaccctcccctgctcgatcctctccagtaaatagaccttcctcagccaccaataaggcactatctccagtcacttcccggaccccaggggtggtggcatctgcccccaccaaaccacagagtcctgctcagaatgccacctcgtcccaagacagttctcaggatacgctgacagaacaaataactctggagaaccaggtgcatcagcgcattgcggagctgaggaaagcaggtctgtggtcccagaggcgtctgccaaagctgcaggaggccccacgccccaagtcccactgggactatctgctggaggagatgcagtggatggccacagactttgcccaggagaggaggtggaaggtggctgctgcgaagaagctcgttagaactgtggtgcgccatcacgaggagaagcagctccgtgaagaaagggggaagaaggaagagcagagcagactgaggcggatagccgcctccacggcccgggagatagagtgcttttggtcgaatattgaacaggttgtggaaataaaactacgagtagaattagaagaaaaaaggaagaaggccttaaatttacagaaagtttccaggagagggaaagaattgagacctaaaggatttgacgcattacaggaaagttctctggattcaggaatgtctggaagaaaaagaaaagctagcatatctttgactgatgacgaagtggacgatgaagaggaaacaattgaagaggaggaagcaaatgaaggcgttgtggaccaccaaacagaactttctaatttagccaaggaagctgagctgcccctcctggacctgatgaagctgtacgaaggcgccttcctgccgagttctcagtggccccggccgaagcctgatggggaggacacaagcggagaggaagatgcagatgactgtccaggcgacagggagagtcgcaaggacttggttctcatcgactcgcttttcatcatggatcagttcaaagctgccgagaggatgaatatcgggaagccaaacgccaaggacattgcggacgtcactgcggtggctgaagccatcctgccgaagggcagtgctcgggtcacaacctcggtcaagtttaatgctccatctttgttgtatggggctctcagagattatcagaagattggcctggactggctggccaaactttacaggaagaatctcaatggcatattggcagatgaagctgggctgggtaaaacagtgcagatcattgctttttttgcccacctagcttgtaacgaaggtaattggggcccccatcttgttgttgtgagaagttgtaacatactcaagtgggagcttgaattgaaacgttggtgtcccggactcaaaatcctctcatatattggcagccacagagaactcaaagcaaagagacaggagtgggccgaacccaacagcttccacgtctgcatcacgtcctacactcagttcttccggggcctcaccgccttcacacgagtgcgctggaagtgcctggtcattgatgagatgcagcgcgtgaagggcatgaccgagaggcactgggaagcggttttcaccctgcagagccaacaacgtctgcttctgatcgactcgccgctgcacaataccttcctggagctctggaccatggtgcacttcctggtcccagggatctccaggccctacctgagctcccctctgagggcccccagtgaagagagccaggattactaccataaagtggtcataaggttacacagggtgacacagccatttattttgaggagaactaagagagatgtggaaaagcaactaacaaagaaatatgagcatgttttgaagtgtcgcctttctaaccgacaaaaagccttatacgaggacgttatcctgcaacctggcactcaggaggccttgaagagcgggcactttgtcaacgtcctgagcatccttgtgcggctgcagcgcatctgcaaccaccctgggctcgtcgagccccggcacccaggctcttcctacgtggcggggccactggagtatccgtccgcatctctaatcctgaaggcactggagagagatttctggaaggaagcagatctttctatgtttgatctcatcggcttagaaaataaaatcactcgtcacgaggcagagttgctgtctaagaaaaagataccgcggaaactcatggaggaaatctccacttcagcagccccagcagcccgaccagcagcagcaaagctgaaggccagcaggttgtttcagcctgtgcagtatggccagaagcccgagggtcgcaccgtggctttccccagcactcacccgccccggacggcagcccccaccacggcctctgctgctccacagggcccgcttcgaggacggccgcccatcgccacgttctctgccaatccggaggcaaaaggtggagaggtagtgaaaatagctcagctggcatccatcacaggaccacagagccgcgtggctcagccagagacgccggtgacactgcagttccagggcagcaagttcaccctgtcacacagccagctccggcagctcacagcgggccagccgctgcagctgcaaggcagcgtcctccagatcgtgtccgcccccgggcagccctaccttcgagcccctggccctgtggtgatgcagaccgtgtctcaggcgggcgctgtgcacggcgccctgggaagcaagcccccggccggcggtcccagccctgcacccttgaccccacaagttggcgttccgggccgcgtggcggtgaatgccttggctgtaggagaacccggaacggcctccaaaccagcttctcccattggagggccgacccaggaggaaaagaccagactcttgaaagagcgcctggatcagatttatttagtcaacgagcggcgctgttctcaagctccagtctatggcagagacttgctaaggatttgtgccctgcctagccatggaagggtacagtggcgtgggtccctggatggccgtcgtgggaaggaggccgggccagcgcacagttacacttcatcctcagaaagtccaagtgagctgatgttgacgctttgtcggtgtggagagtctctgcaggatgttattgacagggtggcctttgtgattcctccggtggtggcagcacccccgtccctacgggtgccgcggccgccacccctgtacagccacagaatgaggatcttgaggcagggcctgagagagcacgctgcgccgtacttccagcagctgcggcagaccacggctccacgcctgctgcagttccctgagctgaggctggtgcagttcgactcagggaagttggaagctttagctatcttgcttcagaaattgaaatctgaaggacgtcgggtgctgattttatcacagatgattcttatgttggacattttagagatgttcttgaacttccattacctcacctatgtaagaatcgatgaaaatgccagcagtgagcaacggcaggaactgatgaggagtttcaacagagacaggcggattttttgtgccattctctccactcacagccgtaccacaggtataaaccttgtagaggcggacaccgtcgtgttttatgacaatgacctgaatccagtgatggatgccaaagctcaggagtggtgcgataggatcgggagatgcaaagacatccacatatacaggcttgtgagtggcaattccattgaagagaaattgttgaaaaatggaactaaagatctgatccgagaagtggctgctcagggaaatgactactccatggctttcttaactcagcgaaccatccaggagctgtttgaagtttattctcccatggatgatgctggcttcccggtcaaagctgaggagtttgtggtgctttctcaggaaccttctgtcacggaaaccattgcacccaaaattgcaagacctttcatagaggccctcaagagtattgagtatctggaggaggatgcccagaagtccgcacaggagggggtgctgggaccacacactgatgctctgtcatcagactctgagaacatgccgtgtgatgaagaaccatcccaattagaggagctagctgacttcatggagcagcttacaccaattgaaaaatatgctttaaattacctggaattattccatacttctattgagcaagaaaaggagagaaacagtgaggacgcagtgatgactgcagtgagggcatgggagttctggaacctgaagaccctgcaggagagggaggcccggctgcggctggagcaggaggaggcggagctcctgacctacacgcgagaggatggtgtgaccccatatatgattttctttaaggatggtttagaaaatggaaaaatgttacaatgtggcattatttggatctatcacccgtcatcatactggttctgtgtcatcacacacaccgacttagacaatggcggtgtcatctgaaccctcattatgaatggatatgggggggagcctgtttaagaaaactgtcgtgtgtccaataagctttc

SEQ ID NO: 547939 - DNA, 6687 bp, Homo sapiens
agcggggcggcggcgcggcttccatcctcccgccctcctgacgcggccggagcgcagccctgaggcccagggagaacgacacattggatacagaagggaggtgatcatgcaccatggcactggcccccagaacgtccagcatcagctgcagaggtccagggcctgccctggcagcgagggtgaggagcagccggcccaccccaacccacccccgtcccccgcagctcccttcgctccctcagcaagcccgtcggcaccccagtctcccagttatcaaatacagcagctgatgaataggagccctgcaaccgggcagaacgtgaacatcaccctgcagagcgtgggccctgtcgtcgggggaaaccagcagatcacactggccccactgccgctccccagccccacctctccaggcttccagttcagcgctcagcctcggcggtttgagcatgggtctccatcatacattcaggtcacgtcccccttgtcccagcaggtccagacccagagtcccacgcagcccagtccggggccggggcaggccttgcagaatgtgcgtgcaggtgcccctggccctgggctgggcctctgcagcagcagccctacaggggacttcgtggatgccagcgtgctggtgaggcagatcagcttgagcccctccagtggtggacactttgtgtttcaggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacgcccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcattaccaggagatgcaggctctgaaggaggtcttcaaggagtatttgattgaactgtttttcttgcaacactttcaagggaacatgatggatttcttagctttcaaggagagactgtatggaccattacaagcatatcttaggcagaatgatttggacattgaagaagaggaggaggaggaggaagaggaggaagaaaaatctgaggttatcaatgacgagcagcaagccctcgcagggagcctggtagcaggggccggaagcacagtagagacggacctgtttaagaggcagcaggcgatgccctccacaggtatggcagagcagtctaagaggcctcgccttgaagtgggtcaccaaggggtagttttccagcacccaggggcggacgcaggcgttcctctccagcaactaatgccgaccgcacaaggaggaatgccccccacgccgcaggccgcgcagctcgctggacagaggcagagtcagcagcagtatgacccctccacggggcctcccgtgcagaacgctgccagcttgcacaccccactgccgcagctgcccgggaggctgcccccagccggtgttcccactgcagccctctcctctgcgctgcagtttgcacagcagccgcaagtggtagaggcccagacacagctccaaatcccggtgaagactcagcagcccaatgttcccatccctgcaccgcccagcagccaactccccatccctccctcgcagcctgcacagctggccctccacgttcccacacctggaaaggtgcaggtgcaggcctctcagctttcctccctgccacagatggtagcatcgacaaggctccctgtggaccctgccccgccctgcccacggcctctgcccacctcttctacctcgtccctcgcgcctgtgagtggctccggcccaggaccctcccctgctcgatcctctccagtaaatagaccttcctcagccaccaataaggcactatctccagtcacttcccggaccccaggggtggtggcatctgcccccaccaaaccacagagtcctgctcagaatgccacctcgtcccaagacagttctcaggatacgctgacagaacaaataactctggagaaccaggtgcatcagcgcattgcggagctgaggaaagcaggtctgtggtcccagaggcgtctgccaaagctgcaggaggccccacgccccaagtcccactgggactatctgctggaggagatgcagtggatggccacagactttgcccaggagaggaggtggaaggtggctgctgcgaagaagctcgttagaactgtggtgcgccatcacgaggagaagcagctccgtgaagaaagggggaagaaggaagagcagagcagactgaggcggatagccgcctccacggcccgggagatagagtgcttttggtcgaatattgaacaggttgtggaaataaaactacgagtagaattagaagaaaaaaggaagaaggccttaaatttacagaaagtttccaggagagggaaagaattgagacctaaaggatttgacgcattacaggaaagttctctggattcaggaatgtctggaagaaaaagaaaagctagcatatctttgactgatgacgaagtggacgatgaagaggaaacaattgaagaggaggaagcaaatgaaggcgttgtggaccaccaaacagaactttctaatttagccaaggaagctgagctgcccctcctggacctgatgaagctgtacgaaggcgccttcctgccgagttctcagtggccccggccgaagcctgatggggaggacacaagcggagaggaagatgcagatgactgtccaggcgacagggagagtcgcaaggacttggttctcatcgactcgcttttcatcatggatcagttcaaagctgccgagaggatgaatatcgggaagccaaacgccaaggacattgcggacgtcactgcggtggctgaagccatcctgccgaagggcagtgctcgggtcacaacctcggtcaagtttaatgctccatctttgttgtatggggctctcagagattatcagaagattggcctggactggctggccaaactttacaggaagaatctcaatggcatattggcagatgaagctgggctgggtaaaacagtgcagatcattgctttttttgcccacctagcttgtaacgaaggtaattggggcccccatcttgttgttgtgagaagttgtaacatactcaagtgggagcttgaattgaaacgttggtgtcccggactcaaaatcctctcatatattggcagccacagagaactcaaagcaaagagacaggagtgggccgaacccaacagcttccacgtctgcatcacgtcctacactcagttcttccggggcctcaccgccttcacacgagtgcgctggaagtgcctggtcattgatgagatgcagcgcgtgaagggcatgaccgagaggcactgggaagcggttttcaccctgcagagccaacaacgtctgcttctgatcgactcgccgctgcacaataccttcctggagctctggaccatggtgcacttcctggtcccagggatctccaggccctacctgagctcccctctgagggcccccagtgaagagagccaggattactaccataaagtggtcataaggttacacagggtgacacagccatttattttgaggagaactaagagagatgtggaaaagcaactaacaaagaaatatgagcatgttttgaagtgtcgcctttctaaccgacaaaaagccttatacgaggacgttatcctgcaacctggcactcaggaggccttgaagagcgggcactttgtcaacgtcctgagcatccttgtgcggctgcagcgcatctgcaaccaccctgggctcgtcgagccccggcacccaggctcttcctacgtggcggggccactggagtatccgtccgcatctctaatcctgaaggcactggagagagatttctggaaggaagcagatctttctatgtttgatctcatcggcttagaaaataaaatcactcgtcacgaggcagagttgctgtctaagaaaaagataccgcggaaactcatggaggaaatctccacttcagcagccccagcagcccgaccagcagcagcaaagctgaaggccagcaggttgtttcagcctgtgcagtatggccagaagcccgagggtcgcaccgtggctttccccagcactcacccgccccggacggcagcccccaccacggcctctgctgctccacagggcccgcttcgaggacggccgcccatcgccacgttctctgccaatccggaggcaaaaggtggagaggtagtgaaaatagctcagctggcatccatcacaggaccacagagccgcgtggctcagccagagacgccggtgacactgcagttccagggcagcaagttcaccctgtcacacagccagctccggcagctcacagcgggccagccgctgcagctgcaaggcagcgtcctccagatcgtgtccgcccccgggcagccctaccttcgagcccctggccctgtggtgatgcagaccgtgtctcaggcgggcgctgtgcacggcgccctgggaagcaagcccccggccggcggtcccagccctgcacccttgaccccacaagttggcgttccgggccgcgtggcggtgaatgccttggctgtaggagaacccggaacggcctccaaaccagcttctcccattggagggccgacccaggaggaaaagaccagactcttgaaagagcgcctggatcagatttatttagtcaacgagcggcgctgttctcaagctccagtctatggcagagacttgctaaggatttgtgccctgcctagccatggaagggtacagtggcgtgggtccctggatggccgtcgtgggaaggaggccgggccagcgcacagttacacttcatcctcagaaagtccaagtgagctgatgttgacgctttgtcggtgtggagagtctctgcaggatgttattgacagggtggcctttgtgattcctccggtggtggcagcacccccgtccctacgggtgccgcggccgccacccctgtacagccacagaatgaggatcttgaggcagggcctgagagagcacgctgcgccgtacttccagcagctgcggcagaccacggctccacgcctgctgcagttccctgagctgaggctggtgcagttcgactcagggaagttggaagctttagctatcttgcttcagaaattgaaatctgaaggacgtcgggtgctgattttatcacagatgattcttatgttggacattttagagatgttcttgaacttccattacctcacctatgtaagaatcgatgaaaatgccagcagtgagcaacggcaggaactgatgaggagtttcaacagagacaggcggattttttgtgccattctctccactcacagccgtaccacaggtataaaccttgtagaggcggacaccgtcgtgttttatgacaatgacctgaatccagtgatggatgccaaagctcaggagtggtgcgataggatcgggagatgcaaagacatccacatatacaggcttgtgagtggcaattccattgaagagaaattgttgaaaaatggaactaaagatctgatccgagaagtggctgctcagggaaatgactactccatggctttcttaactcagcgaaccatccaggagctgtttgaagtttattctcccatggatgatgctggcttcccggtcaaagctgaggagtttgtggtgctttctcaggaaccttctgtcacggaaaccattgcacccaaaattgcaagacctttcatagaggccctcaagagtattgagtatctggaggaggatgcccagaagtccgcacaggagggggtgctgggaccacacactgatgctctgtcatcagactctgagaacatgccgtgtgatgaagaaccatcccaattagaggagctagctgacttcatggagcagcttacaccaattgaaaaatatgctttaaattacctggaattattccatacttctattgagcaagaaaaggagagaaacagtgaggacgcagtgatgactgcagtgagggcatgggagttctggaacctgaagaccctgcaggagagggaggcccggctgcggctggagcaggaggaggcggagctcctgacctacacgcgagaggatgcctacagcatggtacccggcccggggccctcctgccctcttgcccccctgctgaggggcacttgtgcagccatgtttggcttgttcaaagtctgtgtacattgacatgagaaaatgcctaggaatttttacttctcatatcaacacaacctaacttatgttctaaaaacacaattttcttaaaaattgacacttggagattgtcagttagatattgaccagctctgattaaaacatttataagtcttata

SEQ ID NO: 547940 - DNA, 5882 bp, Homo sapiens
agcggggcggcggcgcggcttccatcctcccgccctcctgacgcggccggagcgcagccctgaggcccagggagaacgacacattggatacagaagggaggtgatcatgcaccatggcactggcccccagaacgtccagcatcagctgcagaggtccagggcctgccctggcagcgagggtgaggagcagccggcccaccccaacccacccccgtcccccgcagctcccttcgctccctcagcaagcccgtcggcaccccagtctcccagttatcaaatacagcagctgatgaataggagccctgcaaccgggcagaacgtgaacatcaccctgcagagcgtgggccctgtcgtcgggggaaaccagcagatcacactggccccactgccgctccccagccccacctctccaggcttccagttcagcgctcagcctcggcggtttgagcatgggtctccatcatacattcaggtcacgtcccccttgtcccagcaggtccagacccagagtcccacgcagcccagtccggggccggggcaggccttgcagaatgtgcgtgcaggtgcccctggccctgggctgggcctctgcagcagcagccctacaggggacttcgtggatgccagcgtgctggtgaggcagatcagcttgagcccctccagtggtggacactttgtgtttcaggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacgcccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcattaccaggagatgcaggctctgaaggaggtcttcaaggagtatttgattgaactgtttttcttgcaacactttcaagggaacatgatggatttcttagctttcaaggagagactgtatggaccattacaagcatatcttaggcagaatgatttggacattgaagaagaggaggaggaggaggaagaggaggaagaaaaatctgaggttatcaatgacgagcagcaagccctcgcagggagcctggtagcaggggccggaagcacagtagagacggacctgtttaagaggcagcaggcgatgccctccacaggtatggcagagcagtctaagaggcctcgccttgaagtgggtcaccaaggggtagttttccagcacccaggggcggacgcaggcgttcctctccagcaactaatgccgaccgcacaaggaggaatgccccccacgccgcaggccgcgcagctcgctggacagaggcagagtcagcagcagtatgacccctccacggggcctcccgtgcagaacgctgccagcttgcacaccccactgccgcagctgcccgggaggctgcccccagccggtgttcccactgcagccctctcctctgcgctgcagtttgcacagcagccgcaagtggtagaggcccagacacagctccaaatcccggtgaagactcagcagcccaatgttcccatccctgcaccgcccagcagccaactccccatccctccctcgcagcctgcacagctggccctccacgttcccacacctggaaaggtgcaggtgcaggcctctcagctttcctccctgccacagatggtagcatcgacaaggctccctgtggaccctgccccgccctgcccacggcctctgcccacctcttctacctcgtccctcgcgcctgtgagtggctccggcccaggaccctcccctgctcgatcctctccagtaaatagaccttcctcagccaccaataaggcactatctccagtcacttcccggaccccaggggtggtggcatctgcccccaccaaaccacagagtcctgctcagaatgccacctcgtcccaagacagttctcaggatacgctgacagaacaaataactctggagaaccaggtgcatcagcgcattgcggagctgaggaaagcaggtctgtggtcccagaggcgtctgccaaagctgcaggaggccccacgccccaagtcccactgggactatctgctggaggagatgcagtggatggccacagactttgcccaggagaggaggtggaaggtggctgctgcgaagaagctcgttagaactgtggtgcgccatcacgaggagaagcagctccgtgaagaaagggggaagaaggaagagcagagcagactgaggcggatagccgcctccacggcccgggagatagagtgcttttggtcgaatattgaacaggttgtggaaataaaactacgagtagaattagaagaaaaaaggaagaaggccttaaatttacagaaagtttccaggagagggaaagaattgagacctaaaggatttgacgcattacaggaaagttctctggattcaggaatgtctggaagaaaaagaaaagctagcatatctttgactgatgacgaagtggacgatgaagaggaaacaattgaagaggaggaagcaaatgaaggcgttgtggaccaccaaacagaactttctaatttagccaaggaagctgagctgcccctcctggacctgatgaagctgtacgaaggcgccttcctgccgagttctcagtggccccggccgaagcctgatggggaggacacaagcggagaggaagatgcagatgactgtccaggcgacagggagagtcgcaaggacttggttctcatcgactcgcttttcatcatggatcagttcaaagctgccgagaggatgaatatcgggaagccaaacgccaaggacattgcggacgtcactgcggtggctgaagccatcctgccgaagggcagtgctcgggtcacaacctcggtcaagtttaatgctccatctttgttgtatggggctctcagagattatcagaagattggcctggactggctggccaaactttacaggaagaatctcaatggcatattggcagatgaagctgggctgggtaaaacagtgcagatcattgctttttttgcccacctagcttgtaacgaaggtaattggggcccccatcttgttgttgtgagaagttgtaacatactcaagtgggagcttgaattgaaacgttggtgtcccggactcaaaatcctctcatatattggcagccacagagaactcaaagcaaagagacaggagtgggccgaacccaacagcttccacgtctgcatcacgtcctacactcagttcttccggggcctcaccgccttcacacgagtgcgctggaagtgcctggtcattgatgagatgcagcgcgtgaagggcatgaccgagaggcactgggaagcggttttcaccctgcagagccaacaacgtctgcttctgatcgactcgccgctgcacaataccttcctggagctctggaccatggtgcacttcctggtcccagggatctccaggccctacctgagctcccctctgagggcccccagtgaagagagccaggattactaccataaagtggtcataaggttacacagggtgacacagccatttattttgaggagaactaagagagatgtggaaaagcaactaacaaagaaatatgagcatgttttgaagtgtcgcctttctaaccgacaaaaagccttatacgaggacgttatcctgcaacctggcactcaggaggccttgaagagcgggcactttgtcaacgtcctgagcatccttgtgcggctgcagcgcatctgcaaccaccctgggctcgtcgagccccggcacccaggctcttcctacgtggcggggccactggagtatccgtccgcatctctaatcctgaaggcactggagagagatttctggaaggaagcagatctttctatgtttgatctcatcggcttagaaaataaaatcactcgtcacgaggcagagttgctgtctaagaaaaagataccgcggaaactcatggaggaaatctccacttcagcagccccagcagcccgaccagcagcagcaaagctgaaggccagcaggttgtttcagcctgtgcagtatggccagaagcccgagggtcgcaccgtggctttccccagcactcacccgccccggacggcagcccccaccacggcctctgctgctccacagggcccgcttcgaggacggccgcccatcgccacgttctctgccaatccggaggcaaaaggtggagaggtagtgaaaatagctcagctggcatccatcacaggaccacagagccgcgtggctcagccagagacgccggtgacactgcagttccagggcagcaagttcaccctgtcacacagccagctccggcagctcacagcgggccagccgctgcagctgcaaggcagcgtcctccagatcgtgtccgcccccgggcagccctaccttcgagcccctggccctgtggtgatgcagaccgtgtctcaggcgggcgctgtgcacggcgccctgggaagcaagcccccggccggcggtcccagccctgcacccttgaccccacaagttggcgttccgggccgcgtggcggtgaatgccttggctgtaggagaacccggaacggcctccaaaccagcttctcccattggagggccgacccaggaggaaaagaccagactcttgaaagagcgcctggatcagatttatttagtcaacgagcggcgctgttctcaagctccagtctatggcagagacttgctaaggatttgtgccctgcctagccatggaagggtacagtggcgtgggtccctggatggccgtcgtgggaaggaggccgggccagcgcacagttacacttcatcctcagaaagtccaagtgagctgatgttgacgctttgtcggtgtggagagtctctgcaggatgttattgacagggtggcctttgtgattcctccggtggtggcagcacccccgtccctacgggtgccgcggccgccacccctgtacagccacagaatgaggatcttgaggcagggcctgagagagcacgctgcgccgtacttccagcagctgcggcagaccacggctccacgcctgctgcagttccctgagctgaggctggtgcagttcgactcagggaagttggaagctttagctatcttgcttcagaaattgaaatctgaaggacgtcgggtgctgattttatcacagatgattcttatgttggacattttagagatgttcttgaacttccattacctcacctatgtaagaatcgatgaaaatgccagcagtgagcaacggcaggaactgatgaggagtttcaacagagacaggcggattttttgtgccattctctccactcacagccgtaccacaggtataaaccttgtagaggcggacaccgtcgtgttttatgacaatgacctgaatccagtgatggatgccaaagctcaggagtggtgcgataggatcgggagatgcaaagacatccacatatacaggtgaaggcctgcggggggatggatcaggagatgcaaagacatccacatatacaggtgaagggcctgcg

SEQ ID NO: 547941 - DNA, 567 bp, Homo sapiens
cgggcatcagggggatgaagaagagcataggataatagctaacgcatgtggggcttaatacctaggcacctaggctgtgggtggataggtacagcaaatcatcatagtgcacgtttacctatgtaacaaaccggcatgtcctgcacatgtatcctggaacttaaaataaaattttaaaaaaataaaaagataacaagagtactgaaaatgggctcacagttccacagcctgtacagcaagcatgatgctgacatctgctcagcttctgcggaggcctcaggagacttcataatcatgtgggaagggaaagcaagagcaggaggaagagagagagggggaaggtcctacacactttaaacaacaagatctcatgagaactctatcacaagagcagcgctagggtaatttaatgtcggcaaaggatggttagataattttagaaagaaggttggcttaaaatatgtcacaatagcagaaggggcagcttctgccaacgaagaggcagcagatgaattcccagataccattaagaaaatcatggagaccaggcatggtggctcacgtcta

SEQ ID NO: 547942 - DNA, 3055 bp, Homo sapiens
  misc_feature (2337)..(2337): n is a, c, g, or t
  misc_feature (2343)..(2343): n is a, c, g, or t
  misc_feature (2348)..(2348): n is a, c, g, or t
  misc_feature (2354)..(2354): n is a, c, g, or t
  misc_feature (2360)..(2360): n is a, c, g, or t
  misc_feature (2365)..(2365): n is a, c, g, or t
  misc_feature (2369)..(2369): n is a, c, g, or t
  misc_feature (2372)..(2372): n is a, c, g, or t
  misc_feature (2375)..(2375): n is a, c, g, or t
  misc_feature (2377)..(2378): n is a, c, g, or t
  misc_feature (2391)..(2391): n is a, c, g, or t
  misc_feature (2400)..(2400): n is a, c, g, or t
  misc_feature (2402)..(2402): n is a, c, g, or t
  misc_feature (2404)..(2404): n is a, c, g, or t
  misc_feature (2419)..(2419): n is a, c, g, or t
ctggctccgcgtcggccggtcggtttggtcggttgtagtggcctcgccgcccggtccgctgtcgcagcgctcatccgcgccgggagcccttggctgcgtcgcccggcagccgcgggagcatttcctgaagacgtagtcatgcagcacgtcagcagctcccagagcagccagcgccatgtccagtggcctggggcctgccccggcgcgggcgaggagcagccagcgtgctcccagccgtccctgcccctcacactgccatcccccagccaccaactacagcagctgatggtccagacccagagtcccacgcagcccagtccggggccggggcaggccttgcagaatgtgcgtgcaggtgcccctggccctgggctgggcctctgcagcagcagccctacaggggacttcgtggatgccagcgtgctggtgaggcagatcagcttgagcccctccagtggtggacactttgtgtttcaggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacgcccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcattaccaggagatgcaggctctgaaggaggtcttcaaggagtatttgattgaactgtttttcttgcaacactttcaagggaacatgatggatttcttagctttcaaggagagactgtatggaccattacaagcatatcttaggcagaatgatttggacattgaagaagaggaggaggaggaggaagaggaggaagaaaaatctgaggttatcaatgacgaggtaaaggttgtgacaggaaaggatgggcagactgggactcccgttgctatagcaacccagcttccgccaaaggtttctgctgctttttcatcccagcagcaaccatttcagcaagccctcgcagggagcctggtagcaggggccggaagcacagtagagacggacctgtttaagaggcagcaggcgatgccctccacaggtatggcaggaggaatgccccccacgccgcaggccgcgcagctcgctggacagaggcagagtcagcagcagtatgacccctccacggggcctcccgtgcagaacgctgccagcttgcacaccccactgccgcagctgcccgggaggctgcccccagccggtgttcccactgcagccctctcctctgcgctgcagtttgcacagcagccgcaagtggtagaggcccagacacagctccaaatcccggtgaagactcagcagcccaatgttcccatccctgcaccgcccagcagccaactccccatccctccctcgcagcctgcacagctggccctccacgttcccacacctggaaaggtgcaggtgcaggcctctcagctttcctccctgccacagatggtagcatcgacaaggctccctgtggaccctgccccgccctgcccacggcctctgcccacctcttctacctcgtccctcgcgcctgtgagtggctccggcccaggaccctcccctgctcgatcctctccagtaaatagaccttcctcagccaccaataaggcactatctccagtcacttcccggaccccaggggtggtggcatctgcccccaccaaaccacagagtcctgctcagaatgccacctcgtcccaagacagttctcaggatacgctgacagaacaaataactctggagaaccaggtgcatcagcgcattgcggagctgaggaaagcaggtctgtggtcccagaggcgtctgccaaagctgcaggaggccccacgccccaagtcccactgggactatctgctggaggagatgcagtggatggccacagactttgcccaggagaggaggtggaaggtggctgctgcgaagaagctcgttagaactgtggcccggcagccaggncaggangcganggaggncggggncagangganganccnannaggcgaggcagangtcacctgnantnccagagaaatcgagngtccctggtctagtactgcgcaggtaaagattccagcatcttggaagcaagtgctccactggaaaataaaagccacgtggagcacttgattagactccagaaacagaaactgcagctgctcccaccacccccaccaccacaggccctgcccggggcacagccaaccacacaagtgcaagtgcagccgtcacccgcctaccacagcagagcccccagctcaccacagtcacggccccgagacccagagccctgttgatgggcaccaccatggccaacctccagactcgagtttccacctcccacctgcaaggcccaagactgacgtcagcgctgacgtaccagatggcccaggttgctgtggccacgccccctgtggtgtctgtcctggcagttgtggtgctgtcagccagggtcacagtgcttccatcaacgcaacgggatcagtgttgtgataaggcagctgcaaaaagcggcaggtaggcagccaccttcgcctcaccaaactcgaaacaactcacttgagtgagttgcatcaaacctttctaaatttctcattctagaagttgctgagttgttctgccatgtgttaacttttttttcttatcagtaaaatcttttatttggtttataaaaaaa

SEQ ID NO: 547943 - DNA, 3023 bp, Homo sapiens
  misc_feature (2337)..(2337): n is a, c, g, or t
  misc_feature (2343)..(2343): n is a, c, g, or t
  misc_feature (2348)..(2348): n is a, c, g, or t
  misc_feature (2354)..(2354): n is a, c, g, or t
  misc_feature (2360)..(2360): n is a, c, g, or t
  misc_feature (2365)..(2365): n is a, c, g, or t
  misc_feature (2369)..(2369): n is a, c, g, or t
  misc_feature (2372)..(2372): n is a, c, g, or t
  misc_feature (2375)..(2375): n is a, c, g, or t
  misc_feature (2377)..(2378): n is a, c, g, or t
  misc_feature (2391)..(2391): n is a, c, g, or t
  misc_feature (2400)..(2400): n is a, c, g, or t
  misc_feature (2402)..(2402): n is a, c, g, or t
  misc_feature (2404)..(2404): n is a, c, g, or t
  misc_feature (2419)..(2419): n is a, c, g, or t
ctggctccgcgtcggccggtcggtttggtcggttgtagtggcctcgccgcccggtccgctgtcgcagcgctcatccgcgccgggagcccttggctgcgtcgcccggcagccgcgggagcatttcctgaagacgtagtcatgcagcacgtcagcagctcccagagcagccagcgccatgtccagtggcctggggcctgccccggcgcgggcgaggagcagccagcgtgctcccagccgtccctgcccctcacactgccatcccccagccaccaactacagcagctgatggtccagacccagagtcccacgcagcccagtccggggccggggcaggccttgcagaatgtgcgtgcaggtgcccctggccctgggctgggcctctgcagcagcagccctacaggggacttcgtggatgccagcgtgctggtgaggcagatcagcttgagcccctccagtggtggacactttgtgtttcaggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacgcccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcattaccaggagatgcaggctctgaaggaggtcttcaaggagtatttgattgaactgtttttcttgcaacactttcaagggaacatgatggatttcttagctttcaaggagagactgtatggaccattacaagcatatcttaggcagaatgatttggacattgaagaagaggaggaggaggaggaagaggaggaagaaaaatctgaggttatcaatgacgaggtaaaggttgtgacaggaaaggatgggcagactgggactcccgttgctatagcaacccagcttccgccaaaggtttctgctgctttttcatcccagcagcaaccatttcagcaagccctcgcagggagcctggtagcaggggccggaagcacagtagagacggacctgtttaagaggcagcaggcgatgccctccacaggtatggcaggaggaatgccccccacgccgcaggccgcgcagctcgctggacagaggcagagtcagcagcagtatgacccctccacggggcctcccgtgcagaacgctgccagcttgcacaccccactgccgcagctgcccgggaggctgcccccagccggtgttcccactgcagccctctcctctgcgctgcagtttgcacagcagccgcaagtggtagaggcccagacacagctccaaatcccggtgaagactcagcagcccaatgttcccatccctgcaccgcccagcagccaactccccatccctccctcgcagcctgcacagctggccctccacgttcccacacctggaaaggtgcaggtgcaggcctctcagctttcctccctgccacagatggtagcatcgacaaggctccctgtggaccctgccccgccctgcccacggcctctgcccacctcttctacctcgtccctcgcgcctgtgagtggctccggcccaggaccctcccctgctcgatcctctccagtaaatagaccttcctcagccaccaataaggcactatctccagtcacttcccggaccccaggggtggtggcatctgcccccaccaaaccacagagtcctgctcagaatgccacctcgtcccaagacagttctcaggatacgctgacagaacaaataactctggagaaccaggtgcatcagcgcattgcggagctgaggaaagcaggtctgtggtcccagaggcgtctgccaaagctgcaggaggccccacgccccaagtcccactgggactatctgctggaggagatgcagtggatggccacagactttgcccaggagaggaggtggaaggtggctgctgcgaagaagctcgttagaactgtggcccggcagccaggncaggangcganggaggncggggncagangganganccnannaggcgaggcagangtcacctgnantnccagagaaatcgagngtccctggtctagtactgcgcaggtaaagattccagcatcttggaagcaagtgctccactggaaaataaaagccacgtggagcacttgattagactccagaaacagaaactgcagctgctcccaccacccccaccaccacaggccctgcccggggcacagccaaccacacaagtgcaagtgcagccgtcacccgcctaccacagcagagcccccagctcaccacagtcacggccccgagacccagagccctgttgatgggcaccaccatggccaacctccagactcgagtttccacctcccacctgcaaggcccaagactgacgtcagcgctgacgtaccagatggcccaggttgctgtggccacgccccctgtggtgtctgtcctggcagttgtggtgctgtcagccagggtcacagtgcttccatcaacgcaacgggatcagtgttgtgataaggcagctgcaaaaagcggcagtgggcaacagatttgagcagacactccaccaaagaagctctctaggtggcaaataagcactgtcctctgggaaatgcaaataaaaatcacaatgagaaactactgcacacccgtgagaatgccttaaa

SEQ ID NO: 547944 - DNA, 2918 bp, Homo sapiens
  misc_feature (2337)..(2337): n is a, c, g, or t
  misc_feature (2343)..(2343): n is a, c, g, or t
  misc_feature (2348)..(2348): n is a, c, g, or t
  misc_feature (2354)..(2354): n is a, c, g, or t
  misc_feature (2360)..(2360): n is a, c, g, or t
  misc_feature (2365)..(2365): n is a, c, g, or t
  misc_feature (2369)..(2369): n is a, c, g, or t
  misc_feature (2372)..(2372): n is a, c, g, or t
  misc_feature (2375)..(2375): n is a, c, g, or t
  misc_feature (2377)..(2378): n is a, c, g, or t
  misc_feature (2391)..(2391): n is a, c, g, or t
  misc_feature (2400)..(2400): n is a, c, g, or t
  misc_feature (2402)..(2402): n is a, c, g, or t
  misc_feature (2404)..(2404): n is a, c, g, or t
  misc_feature (2419)..(2419): n is a, c, g, or t
ctggctccgcgtcggccggtcggtttggtcggttgtagtggcctcgccgcccggtccgctgtcgcagcgctcatccgcgccgggagcccttggctgcgtcgcccggcagccgcgggagcatttcctgaagacgtagtcatgcagcacgtcagcagctcccagagcagccagcgccatgtccagtggcctggggcctgccccggcgcgggcgaggagcagccagcgtgctcccagccgtccctgcccctcacactgccatcccccagccaccaactacagcagctgatggtccagacccagagtcccacgcagcccagtccggggccggggcaggccttgcagaatgtgcgtgcaggtgcccctggccctgggctgggcctctgcagcagcagccctacaggggacttcgtggatgccagcgtgctggtgaggcagatcagcttgagcccctccagtggtggacactttgtgtttcaggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacgcccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcattaccaggagatgcaggctctgaaggaggtcttcaaggagtatttgattgaactgtttttcttgcaacactttcaagggaacatgatggatttcttagctttcaaggagagactgtatggaccattacaagcatatcttaggcagaatgatttggacattgaagaagaggaggaggaggaggaagaggaggaagaaaaatctgaggttatcaatgacgaggtaaaggttgtgacaggaaaggatgggcagactgggactcccgttgctatagcaacccagcttccgccaaaggtttctgctgctttttcatcccagcagcaaccatttcagcaagccctcgcagggagcctggtagcaggggccggaagcacagtagagacggacctgtttaagaggcagcaggcgatgccctccacaggtatggcaggaggaatgccccccacgccgcaggccgcgcagctcgctggacagaggcagagtcagcagcagtatgacccctccacggggcctcccgtgcagaacgctgccagcttgcacaccccactgccgcagctgcccgggaggctgcccccagccggtgttcccactgcagccctctcctctgcgctgcagtttgcacagcagccgcaagtggtagaggcccagacacagctccaaatcccggtgaagactcagcagcccaatgttcccatccctgcaccgcccagcagccaactccccatccctccctcgcagcctgcacagctggccctccacgttcccacacctggaaaggtgcaggtgcaggcctctcagctttcctccctgccacagatggtagcatcgacaaggctccctgtggaccctgccccgccctgcccacggcctctgcccacctcttctacctcgtccctcgcgcctgtgagtggctccggcccaggaccctcccctgctcgatcctctccagtaaatagaccttcctcagccaccaataaggcactatctccagtcacttcccggaccccaggggtggtggcatctgcccccaccaaaccacagagtcctgctcagaatgccacctcgtcccaagacagttctcaggatacgctgacagaacaaataactctggagaaccaggtgcatcagcgcattgcggagctgaggaaagcaggtctgtggtcccagaggcgtctgccaaagctgcaggaggccccacgccccaagtcccactgggactatctgctggaggagatgcagtggatggccacagactttgcccaggagaggaggtggaaggtggctgctgcgaagaagctcgttagaactgtggcccggcagccaggncaggangcganggaggncggggncagangganganccnannaggcgaggcagangtcacctgnantnccagagaaatcgagngtccctggtctagtactgcgcaggtaaagattccagcatcttggaagcaagtgctccactggaaaataaaagccacgtggagcacttgattagactccagaaacagaaactgcagctgctcccaccacccccaccaccacaggccctgcccggggcacagccaaccacacaagtgcaagtgcagccgtcacccgcctaccacagcagagcccccagctcaccacagtcacggccccgagacccagagccctgttgatgggcaccaccatggccaacctccagactcgagtttccacctcccacctgcaaggcccaagactgacgtcagcgctgacgtaccagatggcccaggttgctgtggccacgccccctgtggtgtctgtcctggcagttgtggtgctgtcagccagggtcacagtgcttccatcaacgcaacgggatcagtgtgtgggcagtcgtgtaatggcacagattgaccgacctcaccgagcttttgtgc

SEQ ID NO: 547945 - DNA, 950 bp, Homo sapiens
ctggctccgcgtcggccggtcggtttggtcggttgtagtggcctcgccgcccggtccgctgtcgcagcgctcatccgcgccgggagcccttggctgcgtcgcccggcagccgcgcctcgcgagaccgctgtctacggcgctgacgccgcctctgcctcttgaccccttggccccgctgtcctgatccctgaggtcggggcctggtctgcactccaggaaagacgagtgcgcttagtgtgcgctgcacgtgagcagtgaagttgattccacgcgctgcgctgctcggcagctgtcccagaactgaccacggacccctccgcgggtcctgctcctgacaagggccttccggcactgggagttttgtgttagtggaaaggaagaatctaataataccaccacctttacagtaaagacgctgcgaattgacgccttttataataaagacacttatcttgcccaagagctgggtgagtatttcctccttaccaaaaagttggtttacttacagttaactggctgaaagtttgagtcttaggcttatttgtgccgctccaggcaggctgattggcgctggtttccatctgtcagattggacagcagtaccactggctgttgggggctcacgaccagatagagtcttgtctgggaaccacaagtgagtgttgttaccacagctctgcagcagtgagggcacctctcaatccacgtgcagtcgccccaccttatcttcaggggatacggtccaacaccctcaatggatgcctgaaatcaaggatagtagtgaacactatatacactgttttgttatgcatccttccatatctacgataaagtttaattcataaactaggcacaggaagagattaataacagctaataataaaatagaacagtcgtaacaatatactgtaataaaagtcatgtgaaagtgatgtctctctcctaaaaaa

SEQ ID NO: 547946 - DNA, 846 bp, Homo sapiens
cttgaacctgaaggaaacagaaaaacaaaaaccaaaaaacaccacacacaccaaccaaacaacaaaacaaaacaacaacacaaaaaaaaaaaaaaaaaaaaaaacacaacaacaacacaaaaaaaaaaacaacacaaaccaaaaacaccaaccacaccacccaaaagataaaacccaagagaaaatagaaagcaaatgtactatacaaagactatggacatataatagtattaataagtaaaaaacacaaaaaaaaatagataagtcagaaagatagctaagtaagactgtagaccagatctaaactatacgagatcagatataaatataataagaaagatcctcatagagtattaataataataccataatctatattaatagagataagctaagtacagactatatctaatagctaagtatagagaagatatggaatagtgataactaaaaaatcataatgtatatataataaatacaaataaagataaaatataaaaattacattactaatagatacaatataatatgatatataatataagataaatataataatataaatatatatatatatagataagaatatatatataatatatatatagataatatattaaaatataagataaaactataaaaaaatataaacatacaagatacaatataattataaaacatcatgccctctgcataaatagattacatcactttcgtcgatataaaataaatacctcaactcattttctcttattatatcattctaccactctttattaatagtataattttatttctattatttttcacatctatcttattaatttttataattataatacaatg

SEQ ID NO: 547947 - DNA, 128 bp, Homo sapiens
tgtttctctaatagatggtgacactgtcatatccagccaatatgtgtgtctcatcatatatcgtgccacagatctacagttgctcaaataatccaatctgtcatcattatacacctagccaagtgtat

SEQ ID NO: 547948 - DNA, 315 bp, Homo sapiens
agaaactgctgcagcgccagggttttaccctttgcaggaactcaggggcacaacagatgcttaatggaccaatgctttctgactgagctcctctctaccctgaatacaagagaccctaataggcaggaatatcatcgcccctgttcagcatgaagaagttgcagaagatggaccttcatccttctgcagcccttaggattaaaggtccttttgtaaaagggaagggggaaatatgtaagaagcattcaaaccagagcgactacattttgaataagggctcggtgctatttgtaacggaataaaatttgtagccag

SEQ ID NO: 547949 - DNA, 704 bp, Homo sapiens
ctggctccgcgtcggccggtcggtttggtcggttgtagtggcctcgccgcccggtccgctgtcgcagcgctcatccgcgccgggagcccttggctgcgtcgcccggcagccgcgcctcgcgagaccgctgtctacggcgctgacgccgcctctgcctcttgaccccttggccccgctgtcctgatccctgaggtcggggcctggtctgcactccaggaaagacgagtgcgcttagtgtgcgctgcacgtgagcagtgaagttgattccacgcgctgcgctgctcggcagctgtcccagaactgaccacggacccctccgcgggtcctgctcctgacaagggccttccggcactgggagttttgtgttagtggccagaaagcacgggcagcctgggactcctgttgccatagcaacccagctaccgccgaggacttctgcggcttttccagcccagcagcagccgctccaggtactttctgatggctccacagtgcagctccccagactttcctcactcggatttgaggactcgatgtgctgaggcaggacccagaggggtcccaagagcctgtcctcttttgttcaaaatacatcttgaaacgtctttgtgaaggctcttagttttaatgcatggatgctgttatttttccctactgttactgaaattaaaaagtgtttgtctctgaaaacaacaaaaaaaaaa

SEQ ID NO: 547950 - DNA, 1635 bp, Homo sapiens
ctggctccgcgtcggccggtcggtttggtcggttgtagtggcctcgccgcccggtccgctgtcgcagcgctcatccgcgccgggagcccttggctgcgtcgcccggcagccgcgggagcatttcctgaagacgtagtcatgcagcacgtcagcagctcccagagcagccagcgccatgtccagtggcctggggcctgccccggcgcgggcgaggagcagccagcgtgctcccagccgtccctgcccctcacactgccatcccccagccaccaactacagcagctgatggtccagacccagagtcccacgcagcccagtccggggccggggcaggccttgcagaatgtgcgtgcaggtgcccctggccctgggctgggcctctgcagcagcagccctacaggggacttcgtggatgccagcgtgctggtgaggcagatcagcttgagcccctccagtggtggacactttgtgtttcaggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacgcccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcattaccaggagatgcaggctctgaaggaggtcttcaaggagtatttgattgaactgtttttcttgcaacactttcaagggaacatgatggatttcttagctttcaaggagagactgtatggaccattacaagcatatcttaggcagaatgatttggacattgaagaagaggaggaggaggaggaagaggaggaagaaaaatctgaggttatcaatgacgagcagcaagccctcgcagggagcctggtagcaggggccggaagcacagtagagacggacctgtttaagaggcagcaggcgatgccctccacaggtatggcagagcagtctaagaggcctcgccttgaagtgggtcaccaaggggtagttttccagcacccaggggcggacgcaggcgttcctctccagcaactaatgccgaccgcacaaggaggaatgccccccacgccgcaggccgcgcagctcgctggacagaggcagagtcagcagcagtatgacccctccacggggcctcccgtgcagaacgctgccagcttgcacaccccactgccgcagctgcccctgagtacctgcagctcgcctctgagttagcagctcgcgcctgagttagcagctcgccccgag

SEQ ID NO: 547951 - DNA, 912 bp, Homo sapiens
ggctgcctgctggacagctccggcatgctctcgcccgtggactccctggagtcaccccatggctacctgtcagacgtggcctcgccgccactgctgccctccccgttccagcagtctccgtcctgtgcccctcaaccacctgcctgggatgcccgacacccacctgggcatcgggcacctgatacgtggcgggcaatgccccgagatggctggtgctgggtggggtgcgggcggctggcctttgagactggcgccacctcgtctctcccacgctgcctgtggcctctggcaccagcatcctggtcctgggctccacgcatgcggtactgggggccctgaatttcactgtgggcgggtccaccacgtttgaatggtcaatgcgagtggctgtcccggctgcagagcgggcatggtggccctgaacgcaatacaaccctcgtgctgggggaagttgttgggcaccaggccccctgagcacacgaggccccctccctgcagcgatggcatggtagtgcccgattgcacagtatgccttgcatggcagcgccctgtcccagatgatgagctagcagggcctgtccagcacccggctggcacccagtcgtcacctggtgcatgacctcagcactgttgcatgcgcacaatagacttcacaagattgcagggagcatgaacctggagccagcaaactgtccagcagcagccaaagcctgcatagacaggcaccaccatcaacagcagcggactttgggtgagcccagaagccagcggccacctgggccggaacccctgaggtgacaagccaagcccgcaagttcgccctgggccacacctggcgggcacgatttgcgccgggagccgcccgccacggggccctctgcccccggacgggccagagcccccacgactgcc

SEQ ID NO: 547952 - DNA, 367 bp, Homo sapiens
caaagggagggcctccggcaattggccttggagaccctttggcatccaacaaaggacccgttcttcaataaaaacccccctgggctcctatgaatgcaaactttgcctgacccttcccaacaatgagggagctacctggcacatacgcaggggaaaaagccccagaccaacctggcccggcgaacaaccaaggaggccaaggaggcccctgcccagcccgggccttaaaaggtcaaggtggaggtgaaaaagtttgttaagatcggccgcccggggtacaaaatgaccaaacaaaaagactcggagatgggccagcaaagcctccttttccagattgactaccctgagtgccctgaaaaaaaaaaaa

SEQ ID NO: 547953 - DNA, 495 bp, Homo sapiens
  misc_feature (26)..(26): n is a, c, g, or t
tctgtctgtacatcggatggacctcncaatcggagaatgagagctgcccagcctggccttacattttttcaattaattcataaacagaaagggggatatgcagggagccgaaggcccatgggatgtgaccaacgcagcattccactggaggctatatgatccaacagcaaactgtttatcatgaatgcaggatgtgagaaaactgacgactgctcctgccgacagaatgtttgctggaggcaatcactccctggcgctgaggttatctactgcaacatttagcctgttgttcgaggaatgcagtcttgcaagcctgctctagactgagcagctgaccccttcttccaccccgcttctcactatctcttttgcctaataaataaggagggctgtataaagctcagggcccttgtccactaggggcaaggtaccccctgaccccttcttcaagatatacaaaataataaaaaaaacacaatggcctccttggcctca

SEQ ID NO: 547954 - DNA, 325 bp, Homo sapiens
  misc_feature (15)..(15): n is a, c, g, or t
  misc_feature (22)..(22): n is a, c, g, or t
aagaacccaggcggnaggcttngagtcccagatctttccactggtgggaagtttctttcaggagaaatacagttgccatgctgggctcagcaaggaaagtctgcagctctgccccaacagtcaggcagtcctggtgcttgtgaatagccttggagaagatgacttcttttccccctcattcaccactgcagacacaggtggggcttttcccatgggagcttggcatgggtatacctataggacaacctctctggaaacacttcagggtgacttgcatccccacagggagggagcatttccaagtgcagggtttgcattgaggagg

SEQ ID NO: 547955 - DNA, 103 bp, Homo sapiens
ccttcgagactccatcagaatcacctcccaatacgaaccccctggactgctcagtgctgagatacgaagggagattacctccaatatcacgacagagtgccat

SEQ ID NO: 547956 - DNA, 395 bp, Homo sapiens
caagtaaaacactgtaagctatatacatactacgacttagatgaaccttgaggatgttatgctaagtgaaataagccagtcacagcctggcgcgatggctcatgcctgtaatcccagcactttgggaggctgaggcaggagaattgcttgaacccaggagttggaggttgtagtgaaccaagatcgtgccaccgtactccagcctgggcaacaggacaattgtgccactacactccagcttgggtaacagagtgagacctcacctaaaaagataaaataacccatacagtaaaattgacctgaccacaattatctcactgcagcctggaactgttggcctcaagcaatcctctaacctcagcctcccaaagtgctgggaattaagtatgagccac

SEQ ID NO: 547957 - DNA, 247 bp, Homo sapiens
cccccctttttgggggaaaattttttttttccccccccaattttttttttttggggccccccccgggggggggggggggggggggcccccccttcttttttttcttttttttttttttttttggggggggggggggcccaaattcccccccctttggggggggggggtttttttttttttttttttttttttccctttggggggaaaattttgggggttttttcccggggggggggggggggaaaga

SEQ ID NO: 547958 - DNA, 347 bp, Homo sapiens
  misc_feature (56)..(56): n is a, c, g, or t
ttgcacgctcgggtatgtgcagaatagtgggaagatttataggtagaggcgacaanctaccgagcctggtgatagctgtgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctgctacgcaaccaccggttaaggaagcgctcaagtctccacacacactacctgtataatgcccctatactagtataagcttgaactcctctacatcgcccattgacttattta

SEQ ID NO: 547959 - DNA, 935 bp, Homo sapiens
agcgggagggctccggggtaggtgggtgacggcgtgtcggacgcgtgtaggagggacgccgtgttatgcgtccatggtgactgcttagaataactgcgacagtcatctgactgaaattagcagaactaatgaacatcaagccatgctcttacactccaggagttggatggctgaccccgtccgccagtatggcccacgaggatctcttctataagcatccaggaaggatcacatcatgtgttcgttgtggagaatagcagaatgaacgtcgtgaagtcagacttggaacacgctcagagattcagcctgagattgaggcaatcggttgctcaccgagaagctagctagttagtatcgtaaccagacttgcgcgagaagaatactagattacagtacagttaaaagagtttggaatctcatgacccaccagcccccaggtgaacagcgtcaatcggagaatgcagaaggatcgcttagtggcagagtttcatcgaactagtctactgacaagacttcctagaaggtccagaggcagggctgctgagcgagcaggaaagagttcgttgctcgagtaagagccagttccagagtgtctggcagttttcctgaggacagctcatatagaaaggaagtcgtggtatcctgggaaagccaaactcaagctcaagtgccggtgcaggatgaagaagatcacacgaggatgacctccgtcttattcatgagagagaatcttcgtatcaggcaacttgaagcgtgatatcatggatattaatgaaactatttgaagagattgggtgaatgctgattgcatgaaccaaggagatgtgagtagataggcatagaagccaatgttgggaaaatgcagaggtgcacgttcaggaaagcaaatcagcagctgtcaaaggcagcagattatcagggcaatccagaaaaac

SEQ ID NO: 547960 - DNA, 268 bp, Homo sapiens
taaagagacaggtctcgctctgttgccaggctggagtgcagtggtgtgatcatggctcactgcatcctctaactccggggctcaagcgaacctcccactttaccctccggaatagctggaaccacaagcgcacaccaccacatccagctaagttttaaaaaactgcttgtaaagacagggtctcactatgttgcccaggttcaaggtcagatttgttaatccttctgacattgtctcctgtgggagttctggatgttcattagttcat

SEQ ID NO: 547961 - DNA, 366 bp, Homo sapiens
ctaaacctaggcacaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctatacctctgcatatagaaattacccaggcatacactctgcgcaaggggacgcacagattaagcgctcgcgcggagccgagcgggtagacttggagccagtagagaggagaccacaccgtctttgtggcgctaaatgagtggggtgagtgtatgtaggtaggagaggcgcccaacaccccgcggtcggtgtgttatg

SEQ ID NO: 547962 - DNA, 494 bp, Homo sapiens
  misc_feature (272)..(272): n is a, c, g, or t
  misc_feature (284)..(284): n is a, c, g, or t
  misc_feature (428)..(428): n is a, c, g, or t
  misc_feature (430)..(430): n is a, c, g, or t
  misc_feature (489)..(489): n is a, c, g, or t
  misc_feature (492)..(492): n is a, c, g, or t
ctaaacctaggcacaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagtctatgtagcnaaatatgggagnttatagtagaggcgacaaacctaccgagcctggtgatagctggtgtccagatagatctagttcactttaattgccacagacctctaatccctgtaattactgtagtcaagggacagcttttgacactagaaaacctgtagaggntnttacacccaagtaggctaagcgccaccataagggttcagtcacacctactatcccactntantg

SEQ ID NO: 547963 - DNA, 269 bp, Homo sapiens
acgcgcatacgtggagaacgtgcttaagatcactatgatgggaaacatttcattctcaaaaaaaaaaaaaattttctcttcttcctgtaatagggtagtttctgaccgttagatatttattttcccatggggtcaaaaggtacctaagtatataattgcgagtggaaaaataggggacagaattcaggttttggcagtttttcccattttccatttgtgtgtgtgacttttttaattataaattgcgcgagacgttaatagcatttaat

SEQ ID NO: 547964 - DNA, 234 bp, Homo sapiens
tgcgacgcagtcttcctctgtcgactagtggctcttctgtgggcgagattacaggacacaacgaaagtcatcaacagcgtgcacatcaagcagagccggacataccggctggccacgggaagcgatgataactgcgcggaattctttgagggacccccattcaagttcaagttcacagttggcgaccacagcccgctttgtcaaactgtgtgcgattctctcctgatgggaaca

SEQ ID NO: 547965 - DNA, 708 bp, Homo sapiens
  misc_feature (436)..(436): n is a, c, g, or t
  misc_feature (442)..(442): n is a, c, g, or t
  misc_feature (448)..(448): n is a, c, g, or t
  misc_feature (453)..(453): n is a, c, g, or t
  misc_feature (455)..(455): n is a, c, g, or t
cccccccccccccggggcagaatgttaagcttcccccccagtccaaggaactcttttactatactcaattgatccaataacttgaccaacggaacaagttaccctagggataacagcgcaatcctattctagagtccatatcaacaatagggtttacgacctcgatgttggatcaggacatcccgatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttagtattatacccacacccaccccaagaacagggtttgttaagatggcagagcccggtaatcgcataanacttanaacttnacagncngaggttcaattcctcttcttaacaacaatacccatggacaaactcctactccctcattgtaaccattctaatcgcaatgggaattctaatgctaaccgaagaaaaattctaggctatataaactacgcaaaggcccaagtagtaagacctaagggctatacaacctttgctgacgcataaaatctaacaaaagcctaaaaccgcaactacatacataaatcacgaccgactagtttacatgaaataatagaac

SEQ ID NO: 547966 - DNA, 128 bp, Homo sapiens
  misc_feature (6)..(7): n is a, c, g, or t
tggatnnccgggctgcaggaattcggcacgaggctaaacctagccccaaacccactccaccttactaccagacaaccttagccaaaccatttacccaaataaagtataggcgatagaaattgaaacct

SEQ ID NO: 547967 - DNA, 551 bp, Homo sapiens
gcacgagctcacacatacaatccaaccatcggagcgacaaagcggaaaagcgagtatactgtcaattctcataagaatacctttatccattataatggtttcgaggctaacttcgacgcttcacttaaaattttaccgctagttactttgcttgaatgtggcaaggtaatgattacgtttctcatcggagctcttggcttccttaattgagaggcaaacaccaaagaacttgttagcaacgccaaagcaccagcttgatggatagaagctaacgatattgggactaggtacaatatagttaaaataccaagggttgcttgtaaagtaacgacgcccatcataacatgcaaagaggtcatcgcgttccttggaattacggccttctttttgatagcgtacatatgagcagctagtactgatgtaaacgcaacgtacgcacatgtcctatggaccaactgaactgtaactgggttttctagcaaattcctccaccacagatctttcttgtcctctcttctacagaagttttcgtccattaattcacgagaact

SEQ ID NO: 547968 - DNA, 412 bp, Homo sapiens
  misc_feature (163)..(163): n is a, c, g, or t
ctaaacctaggcacaaacccactccaccttactaccagacaaccttagccaaaccatttacccaaataaagtataggcgatagaaattgaaacctggcgcaatagatatagtaccgcaagggaaagatgaaaattattaccccaggattattttggcgagggncttacccctattaacttctggcaatatatgaattaactagggagtacacttttcaaagggagaacacagagtgtaagccccccgggacccagagcgagtggtctctctgagccagggtataagggccgcaccacctctatatcgtcgtaaatagtaggtggtgagtatatagtagtagtagtacgacgacaacatcctagccgccgtcgtcgataatcataatttgctcctacaatgatgatgatcatg

SEQ ID NO: 547969 - DNA, 446 bp, Homo sapiens
ggaatctatattatatcgtaacaactggacttccttagaatcacataagtagtaacacactaaagccagcatacatgattcacacataggagtcaactagcaatagacattcctgtactccaatgattttaacaccacatttttctacgaacctcatagacacctccagagaacaacttgtcttagttactgtttatatctcatattttagaggctccaaccacatgaaacgtctccagggtattgtcaaacacactatgcaaccttcaagtggtctctgagaagcttgttttgaaattgcattgtatcactttgctcaggctactgtcagttttcaaatacaggaaatcacccaatggatcacaggctgcagctgatgtctgcctgacctcatggcttcagtttcctaactgacaacatctatacagaggcagatctcatacaag

SEQ ID NO: 547970 - DNA, 343 bp, Homo sapiens
gtatgtataaataagaactcccttaaaaaaaaaaaaaatagggccaggcgcagaaccccacgcctacaatcccagcaccttgggaggccgaggcgggtggataaaccgagatcaggagttcgagaccagcccggccaacacggaaaaaccccatctccaccaaaaatacaaaaaaaaaatttagacgggcttcctcataaggaaaggttaaaaaaagtaaaaggaactcggcaaatcttaccccgcctgtttaccaaaaacatcacctctagcatcaccagtatatggatacggagtacaaaacggcccttggatgatggagtaggtaaccagtgagggcctg

SEQ ID NO: 547971 - DNA, 186 bp, Homo sapiens
  misc_feature (49)..(49): n is a, c, g, or t
tttacaactatctcggaacatgagggaatcttaggaatgcattattagngctgagatagaagggagaaaaaggagcctagtgtccctaaagacattgtgaaggtaccattatagaactttgtaactacattacatcacaactatctctataaattaataaaaaaatagttaacgtgcctattcttt

SEQ ID NO: 547972 - DNA, 126 bp, Homo sapiens
  misc_feature (88)..(88): n is a, c, g, or t
gttgaggatcctagcacagaggaggaacagaaacaacccaggttcatcatgggtagcatcacgcccacggactacaccctctccaagntgctacctccctgtgctgtccacctcctctggtgcggt

SEQ ID NO: 547973 - DNA, 159 bp, Homo sapiens
  misc_feature (9)..(9): n is a, c, g, or t
  misc_feature (22)..(22): n is a, c, g, or t
  misc_feature (39)..(39): n is a, c, g, or t
  misc_feature (66)..(66): n is a, c, g, or t
  misc_feature (113)..(113): n is a, c, g, or t
  misc_feature (152)..(152): n is a, c, g, or t
ccctgccancctgaaatcaaantgttgtactatgatcanagtccctgtgccatccttttccaagantggggctcaaaccatgtttttgaatgagaatccctgctggttgaganttttgcttccacttgtttccttggagatgtttttccaangagcata

SEQ ID NO: 547974 - DNA, 7157 bp, Homo sapiens
ttggctactagtctacgctggaatacgattgctccacggttggctactagtccacaggttggctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataaggaaaggttaaaaaaagtaaaaggaactcggcaaatcttaccccgcctgtttaccaaaaacatcacctctagcatcaccagtattagaggcaccgcctgcccagtgacacatgtttaacggccgcggtaccctaaccgtgcaaaggtagcataatcacttgttccttaattagggacctgtatgaatggctccacgagggttcagctgtctcttacttttaaccagtgaaattgacctgcccgtgaagaggcgggcatgacacagcaagacgagaagaaaggcaaagaaggcttcaactctgattgaaaatgagtggagaatcaaacaaagttgagaacagatatgatataggtacagtgagatacttgaaactagaatttgatagttgatagttatagaagctcaattaaatcatcttgaagtggaattagacaaagcatctacattttaatggagaaccagtattacagtgaccaggtaactcggcatggtattatcacttaaaaatttttcctaaataccatgaagtcggtagaagacctttgcatcagaccatgttctttgaagcttaaaaaagtccctgactgactaggaaagacagcacagtgctccaaaaagaaaccctgcagagatgtattaataccaaaaactccatttgaccctggacaggcccaggattcgggattcttcacaatgaggggaatggaccaggtttcttccaagcaaaacattctatcgttttgttgacaatgaattaaattgaaattgtttagaacaatcccaattttggtggggaaggaaaggaggataagttaagcaagataaagaaagctcacagaaacttcatgcagaggtacagcattaaagttctttgtttcctaattaatgttgtatgcagaagtattctgtaaactaaattttcctgacagaaaagttcccacatcctcaacagatgagaatgattgcattatttgggatccttgatcaatacgaaccacatactgtcccttctcaaagactaagttccttatttttcacccaaatcctatatattgaaagacaaccaaggtgctaaatgttaaccactagtcaagttaggaatgtctgaagaaaatatattaaccttgacataaagaagatgtttttggtcaaatttcagacatgtattattataaattaataactggctccatccaccaggttaaagatgaagggagggcctaagatgtctctagagtttatatacacacaagtgagtgtcactgttttgttttgtttttgacctagttttattaaatattgcttccttggggtgtgtttataacaactcccagaacatttcatgtaaggattcaaagcggtcatattaaaatacagcttcaatataaagtttatcacagttttacagtattcaaaaatgacagacctgccttaaaaaacaaaacaaaaaccaaaaaaggactattacacccaaaacataagaaaacaattaaataaacaagtttggcattttcataactttatagtataaaacagaatattaaatttattactggcaaacggacactgatttatttcctttgaaatgtgtcccatttaaacacactatacaagttcattatacaaaagatggatgatcattttgatgaaagaagtgcaccctgaaaatttttgccagtttagaatatttagctcttaaagtttaaaaaaaaagtccttttccttttttaaactgaaggctgaattcagattttttttgttgtctcatctgtcagccttcctggtttaaaaacaatagtgtctatggacgcccaccagggggcagtgtaagattagccattaaatcacgaacagctgcaaatattgtgcattcaccttgtcgtggtggattcatctctgcaaacctcttcagaatgttgctgaccatcatgggagcagcaacagaagagttctgctgtctgggaatgtctgcctgctgggttgtacctgaagccatgtcataaatgattggaactataatactaacaggttcttggggagggaccgatgttttctgagttagttgaagaaaaaatagcattttggatttcagcaccacagcaggcgtcccaggaggtgcaatcggcggcgcgctgggagggatcgtcaggcaaaactgaacattccattttagctgtgttgcttggtcagggaacagctccagcttcataatgtgcacacaatccctgaggatgtgtgtaggagctcctaatagcttggtgaaggctattaacgtattagctttaaatggtggtcctgcaactcttgtttcaaagaatttctccaaaacttgaagttcatcaggtttccactgtcctgcattttcaggtgtcacttttagctgaagcgtttggttggttttgggactaagagctactctgcatttcagtgcatcagtcttaaacatgatcactccgggttcattagaatttatcagctgcagcgtttcttgttgaataattctttgaagatgtcgtctcatgatgactgatccaaggaatctctcaagtggagaacaaaggtaactacctgccaggccgggcacaaggcctggagttggagagggcagcagtaaaatgttcaaggcactgtgagtgaggatggtaggtatggatgccgcccaagagcgctgaggtagtttacgaggtggaggcatgtttgttggcattgtttgagaacttgttccagctcgaggggaatgagaagcatctggaaccggagaatgtagtgaggggttggctggtgacattccaggcatgcgtgctgctggtgaggggccagacacttgaggagatcctggccagttccctgctcgtccacttggtgacaccatagtgtatggggaactagggtcaagagttccatgtggactagcaaaactggcccctggtcctattgagattccatgcgaggatgggggaggagttggaacaaatgacgctggtgatggggctctcaaagccccactgggggagctggcagcatgcagatttcctggagactgtgtgtgcatcattgagggagactgattgactgtgctatgataagatgtagggggtgaagtaagaggataagcacctgatgttcctggctgctttggaaatggctgttgctggggtggtggctggagctgcgatattaaagaatccatcatatctcctcctataggagaagggggattatcgtcctcatttacagaccttcttcgagcatcctgattgctgtcaacaaacatattcaggaacgtctttagtcctggtgcaggatagaaaccttcaactagtttgctgttatcaaaaagactataggcaccatcccgtattgccacaacacctcgactccggcagtatatatcaatgcaatacatgttcctgaaggccagtctgatgtgggtggacgactgtggcagaatggagaagcactggtaggcagtattggttctctgggtcaagcccaacatcggcacagtggggagtttgttgatggcatttaatggagcctgagtatcaaacagtacctgtaataactgaaccacatttggtgttttgttgaacatttcttgaagctgatggagaatggtattgtgacagttactgcaacctgagtttgggccaacagttcccaaagaaatgtggaatttttgatggatcgaattccattggatactaattgagcttcccttggtggttccataacacaagataagttttcggtaattataaacacgaacttctgagaaaatatttagatgagcaggtatgtctggtagagaacgtgcaaattccaacacacactcatataatcgtgcaatgctattccagtcattaagaaacatttcaaccacctttctaccaccaacaggctcagacaacagattttcatatgtcaggtaaacgtgccgggatggtccttgctccctagtagaagtgccattaagtggacaatttgcaaacactaactctgctacccaagtgcggttatttctaccttgtaatcggaaagtgcaatcaagaagagagcggtccagagccttttgggtttcctcagttatacccttacagggaggaatttttaataagcgaattgcatggctgaagccatcaccttccacttgcactccttgatgtggaatctccagattggacaactccaaccgaagtcctacaaatggcatatttgtatcacacatagcgacgaagtgggctaaaactttattgaaggcacacatttctcctgctcgttttgttttcttggattctactggacatggatcatcagacaacttgcgcttggcattggttctggtctgtttcccggtttttgtacgaaaaaccaagtcctgaatgttttccttgaactgctgcagcagcaatgccattgcagggctgtcttcacgatctgcagcattcacagacataaagtagtacttgtacgacagttgtgtgggtttattgggaacctccaacatctccacaacaatgtagtattgtggaaggcgggtaagtttaatgaacagtttattcttagaaaggtttccaataggatgagttgagtaattggaaagctgcaatgtttcactgcttatcgtaggcagatgttttatagactgcttgcaacgctgttgtccaagccaaaacttaagttgctgaatccagggtatgattcgtttcatatcatcattcacagacttctccatgtcatccagagtggcctggtcaagtccataaagcatcaattgaaacattccagaatgtaaatctacaaaaatgtgcagacactctgaattaccacagggctccaagatgggaacaacaagagctgggagtgcagtctctatggaagagttttcattggcattgaagcctctaagaatggccttcagttcttggagcttctgatgagctcttgcatggacactgtcaatcaggagtttttctattgataagtggtcgatcttcatggctctttctactaatttggaatcagaagctggcaaaggaggatcgtgaaaaatctgtaaaggcttggagacatcattctcatcaattttaattgtaactttgtgaacagatgctgttccagtttttctcccaagaacctgttgattccaaactgaaagggagaggcactttccagcatgatacctttccacctgcacaaggtctccccaccgttctcggattaacattagagtttgggaatgtaacacttctaactgaagtgataaacagaaagaatgtaggcagttgtacatatcctgaagaggtttctcatcagcaaagagcctagactgcaccagttgatggatgaagctgatttgcatgctatgaaccaaagctcgcccatctcctgtttccttatcctcaactagaatttctagcttgagaagacgccatggaacatcagggtcatctcccatcacagtcaaggtggcttcaaattctccttcaacacgaaacttcacccggccatttgcaactgtaagatttgctaactgaggaggaagatctgtggttacaagccgatgtctaagaatctgattcagctgatggagtgtggcttgtttttcaattttggtaattgggtctggaggaataattttatccctaatgcaggttggcagccgtgggtaagatccagtagttagtacatcaatggcatatgggatggcaaaactaggcaggcgtgcatggaccagagcatctctagctaacgaggccaggcgatcagcagtgtccacaaacaggatggcttgctgatctaaaaagcttgaaatcatcgcacatttttccactttgccagcattattagcccatttcactaaagctaataatcgaacgaagagttggcgtgtccggctagcaaactgcactatttctattttcctttccacatcagatttccttggcagtaggtccgtcaacaccataagctccgagtaggcccggtgcagcagaaattcaatgagggtgctcagccggtagcccgggctagccgcagctgcagcggccgccgccacggcggctcccgggggaggaggggctggggctgacgggggtccgccgctgcccccgccgccgcctccgggcgggaccagctggtggttctccagctgcactggggccatggcggcgcaggaccgggcttggcgcaacggcacacgatgcggtcctcgagcctcccgggcgctcggtcaccgcgccgaaacgggagcgggcagagtcgccaccgcctaccgccggcaaccctcggccgattaaaccagcctcgtactagcta

SEQ ID NO: 547975 - DNA, 593 bp, Homo sapiens
attttattttaatttgagaaataaagatttcctccaagccacatgaggactctggcacccacccacaaagcaagacctgtatttataagccgagggctcagggagcctaactgcgggacccgtcagggccccgtgacccatccccgtcccacccacccactccacgactgggaaccatcagtgtgtgttggggggatgcttaggaaagctggtgtgtgaggagacaacaaaactcgggaactggagccagagcatgccggctgactgacgctttgatgctcacgggaaatttctgacccaggatctcagccacacaggactggtatgtatggctacacaatctctctcaacattgtaattaattttggatgacgaaaacgctgacaggagcattcgctcacaactccgccatccaacaaacttatgcaatcatactccacgtaagatgttcacacaatccccctttgacacacaacataggacactcgggagcaggccagaactcagcctgcgccacgagttctttgtacactacaccaggcccactaatcaaggtcctgcctgtcccaggccatatacgctagctacaagtg

SEQ ID NO: 547976 - DNA, 7018 bp, Homo sapiens
ttggctactagtctacgctggaatacgattgctccacggttggctactagtccacaggttggctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataaggaaaggttaaaaaaagtaaaaggaactcggcaaatcttaccccgcctgtttaccaaaaacatcacctctagcatcaccagtattagaggcaccgcctgcccagtgacacatgtttaacggccgcggtaccctaaccgtgcaaaggtagcataatcacttgttccttaattagggacctgtatgaatggctccacgagggttcagctgtctcttacttttaaccagtgaaattgacctgcccgtgaagaggcgggcatgacacagcaagacgagaagaaaggcaaagaaggcttcaactctgattgaaaatgagtggagaatcaaacaaagttgagaacagatatgatataggtacagtgagatacttgaaactagaatttgatagttgatagttatagaagctcaattaaatcatcttgaagtggaattagacaaagcatctacattttaatggagaaccagtattacagtgaccaggtaactcggcatggtattatcacttaaaaatttttcctaaataccatgaagtcggtagaagacctttgcatcagaccatgttctttgaagcttaaaaaagtccctgactgactaggaaagacagcacagtgctccaaaaagaaaccctgcagagatgtattaataccaaaaactccatttgaccctggacaggcccaggattcgggattcttcacaatgaggggaatggaccaggtttcttccaagcaaaacattctatcgttttgttgacaatgaattaaattgaaattgtttagaacaatcccaattttggtggggaaggaaaggaggataagttaagcaagataaagaaagctcacagaaacttcatgcagaggtacagcattaaagttctttgtttcctaattaatgttgtatgcagaagtattctgtaaactaaattttcctgacagaaaagttcccacatcctcaacagatgagaatgattgcattatttgggatccttgatcaatacgaaccacatactgtcccttctcaaagactaagttccttatttttcacccaaatcctatatattgaaagacaaccaaggtgctaaatgttaaccactagtcaagttaggaatgtctgaagaaaatatattaaccttgacataaagaagatgtttttggtcaaatttcagacatgtattattataaattaataactggctccatccaccaggttaaagatgaagggagggcctaagatgtctctagagtttatatacacacaagtgagtgtcactgttttgttttgtttttgacagacctgccttaaaaaacaaaacaaaaaccaaaaaaggactattacacccaaaacataagaaaacaattaaataaacaagtttggcattttcataactttatagtataaaacagaatattaaatttattactggcaaacggacactgatttatttcctttgaaatgtgtcccatttaaacacactatacaagttcattatacaaaagatggatgatcattttgatgaaagaagtgcaccctgaaaatttttgccagtttagaatatttagctcttaaagtttaaaaaaaaagtccttttccttttttaaactgaaggctgaattcagattttttttgttgtctcatctgtcagccttcctggtttaaaaacaatagtgtctatggacgcccaccagggggcagtgtaagattagccattaaatcacgaacagctgcaaatattgtgcattcaccttgtcgtggtggattcatctctgcaaacctcttcagaatgttgctgaccatcatgggagcagcaacagaagagttctgctgtctgggaatgtctgcctgctgggttgtacctgaagccatgtcataaatgattggaactataatactaacaggttcttggggagggaccgatgttttctgagttagttgaagaaaaaatagcattttggatttcagcaccacagcaggcgtcccaggaggtgcaatcggcggcgcgctgggagggatcgtcaggcaaaactgaacattccattttagctgtgttgcttggtcagggaacagctccagcttcataatgtgcacacaatccctgaggatgtgtgtaggagctcctaatagcttggtgaaggctattaacgtattagctttaaatggtggtcctgcaactcttgtttcaaagaatttctccaaaacttgaagttcatcaggtttccactgtcctgcattttcaggtgtcacttttagctgaagcgtttggttggttttgggactaagagctactctgcatttcagtgcatcagtcttaaacatgatcactccgggttcattagaatttatcagctgcagcgtttcttgttgaataattctttgaagatgtcgtctcatgatgactgatccaaggaatctctcaagtggagaacaaaggtaactacctgccaggccgggcacaaggcctggagttggagagggcagcagtaaaatgttcaaggcactgtgagtgaggatggtaggtatggatgccgcccaagagcgctgaggtagtttacgaggtggaggcatgtttgttggcattgtttgagaacttgttccagctcgaggggaatgagaagcatctggaaccggagaatgtagtgaggggttggctggtgacattccaggcatgcgtgctgctggtgaggggccagacacttgaggagatcctggccagttccctgctcgtccacttggtgacaccatagtgtatggggaactagggtcaagagttccatgtggactagcaaaactggcccctggtcctattgagattccatgcgaggatgggggaggagttggaacaaatgacgctggtgatggggctctcaaagccccactgggggagctggcagcatgcagatttcctggagactgtgtgtgcatcattgagggagactgattgactgtgctatgataagatgtagggggtgaagtaagaggataagcacctgatgttcctggctgctttggaaatggctgttgctggggtggtggctggagctgcgatattaaagaatccatcatatctcctcctataggagaagggggattatcgtcctcatttacagaccttcttcgagcatcctgattgctgtcaacaaacatattcaggaacgtctttagtcctggtgcaggatagaaaccttcaactagtttgctgttatcaaaaagactataggcaccatcccgtattgccacaacacctcgactccggcagtatatatcaatgcaatacatgttcctgaaggccagtctgatgtgggtggacgactgtggcagaatggagaagcactggtaggcagtattggttctctgggtcaagcccaacatcggcacagtggggagtttgttgatggcatttaatggagcctgagtatcaaacagtacctgtaataactgaaccacatttggtgttttgttgaacatttcttgaagctgatggagaatggtattgtgacagttactgcaacctgagtttgggccaacagttcccaaagaaatgtggaatttttgatggatcgaattccattggatactaattgagcttcccttggtggttccataacacaagataagttttcggtaattataaacacgaacttctgagaaaatatttagatgagcaggtatgtctggtagagaacgtgcaaattccaacacacactcatataatcgtgcaatgctattccagtcattaagaaacatttcaaccacctttctaccaccaacaggctcagacaacagattttcatatgtcaggtaaacgtgccgggatggtccttgctccctagtagaagtgccattaagtggacaatttgcaaacactaactctgctacccaagtgcggttatttctaccttgtaatcggaaagtgcaatcaagaagagagcggtccagagccttttgggtttcctcagttatacccttacagggaggaatttttaataagcgaattgcatggctgaagccatcaccttccacttgcactccttgatgtggaatctccagattggacaactccaaccgaagtcctacaaatggcatatttgtatcacacatagcgacgaagtgggctaaaactttattgaaggcacacatttctcctgctcgttttgttttcttggattctactggacatggatcatcagacaacttgcgcttggcattggttctggtctgtttcccggtttttgtacgaaaaaccaagtcctgaatgttttccttgaactgctgcagcagcaatgccattgcagggctgtcttcacgatctgcagcattcacagacataaagtagtacttgtacgacagttgtgtgggtttattgggaacctccaacatctccacaacaatgtagtattgtggaaggcgggtaagtttaatgaacagtttattcttagaaaggtttccaataggatgagttgagtaattggaaagctgcaatgtttcactgcttatcgtaggcagatgttttatagactgcttgcaacgctgttgtccaagccaaaacttaagttgctgaatccagggtatgattcgtttcatatcatcattcacagacttctccatgtcatccagagtggcctggtcaagtccataaagcatcaattgaaacattccagaatgtaaatctacaaaaatgtgcagacactctgaattaccacagggctccaagatgggaacaacaagagctgggagtgcagtctctatggaagagttttcattggcattgaagcctctaagaatggccttcagttcttggagcttctgatgagctcttgcatggacactgtcaatcaggagtttttctattgataagtggtcgatcttcatggctctttctactaatttggaatcagaagctggcaaaggaggatcgtgaaaaatctgtaaaggcttggagacatcattctcatcaattttaattgtaactttgtgaacagatgctgttccagtttttctcccaagaacctgttgattccaaactgaaagggagaggcactttccagcatgatacctttccacctgcacaaggtctccccaccgttctcggattaacattagagtttgggaatgtaacacttctaactgaagtgataaacagaaagaatgtaggcagttgtacatatcctgaagaggtttctcatcagcaaagagcctagactgcaccagttgatggatgaagctgatttgcatgctatgaaccaaagctcgcccatctcctgtttccttatcctcaactagaatttctagcttgagaagacgccatggaacatcagggtcatctcccatcacagtcaaggtggcttcaaattctccttcaacacgaaacttcacccggccatttgcaactgtaagatttgctaactgaggaggaagatctgtggttacaagccgatgtctaagaatctgattcagctgatggagtgtggcttgtttttcaattttggtaattgggtctggaggaataattttatccctaatgcaggttggcagccgtgggtaagatccagtagttagtacatcaatggcatatgggatggcaaaactaggcaggcgtgcatggaccagagcatctctagctaacgaggccaggcgatcagcagtgtccacaaacaggatggcttgctgatctaaaaagcttgaaatcatcgcacatttttccactttgccagcattattagcccatttcactaaagctaataatcgaacgaagagttggcgtgtccggctagcaaactgcactatttctattttcctttccacatcagatttccttggcagtaggtccgtcaacaccataagctccgagtaggcccggtgcagcagaaattcaatgagggtgctcagccggtagcccgggctagccgcagctgcagcggccgccgccacggcggctcccgggggaggaggggctggggctgacgggggtccgccgctgcccccgccgccgcctccgggcgggaccagctggtggttctccagctgcactggggccatggcggcgcaggaccgggcttggcgcaacggcacacgatgcggtcctcgagcctcccgggcgctcggtcaccgcgccgaaacgggagcgggcagagtcgccaccgcctaccgccggcaaccctcggccgattaaaccagcctcgtactagcta

SEQ ID NO: 547977 - DNA, 7099 bp, Homo sapiens
ttggctactagtctacgctggaatacgattgctccacggttggctactagtccacaggttggctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataaggaaaggttaaaaaaagtaaaaggaactcggcaaatcttaccccgcctgtttaccaaaaacatcacctctagcatcaccagtattagaggcaccgcctgcccagtgacacatgtttaacggccgcggtaccctaaccgtgcaaaggtagcataatcacttgttccttaattagggacctgtatgaatggctccacgagggttcagctgtctcttacttttaaccagtgaaattgacctgcccgtgaagaggcgggcatgacacagcaagacgagaagaaaggcaaagaaggcttcaactctgattgaaaatgagtggagaatcaaacaaagttgagaacagatatgatataggtacagtgagatacttgaaactagaatttgatagttgatagttatagaagctcaattaaatcatcttgaagtggaattagacaaagcatctacattttaatggagaaccagtattacagtgaccaggtaactcggcatggtattatcacttaaaaatttttcctaaataccatgaagtcggtagaagacctttgcatcagaccatgttctttgaagcttaaaaaagtccctgactgactaggaaagacagcacagtgctccaaaaagaaaccctgcagagatgtattaataccaaaaactccatttgaccctggacaggcccaggattcgggattcttcacaatgaggggaatggaccaggtttcttccaagcaaaacattctatcgttttgttgacaatgaattaaattgaaattgtttagaacaatcccaattttggtggggaaggaaaggaggataagttaagcaagataaagaaagctcacagaaacttcatgcagaggtacagcattaaagttctttgtttcctaattaatgttgtatgcagaagtattctgtaaactaaattttcctgacagaaaagttcccacatcctcaacagatgagaatgattgcattatttgggatccttgatcaatacgaaccacatactgtcccttctcaaagactaagttccttatttttcacccaaatcctatatattgaaagacaaccaaggtgctaaatgttaaccactagtcaagttaggaatgtctgaagaaaatatattaaccttgacataaagaagatgtttttggtcaaatttcagacatgtattattataaattaataactggctccatccaccaggttaaagatgaagggagggcctaagatgtctctagagtttatatacacacaagtgagtgtcactgttttgttttgtttttgacctagttttattaaatattgcttccttggggtgtgtttataacaactcccagaacatttcatgtaaggattcaaagcggtcatattaaaatacagcttcaatataaagtttatcacagttttacagtattcaaaaatgacagacctgccttaaaaaacaaaacaaaaaccaaaaaaggactattacacccaaaacataagaaaacaattaaataaacaagtttggcattttcataactttatagtataaaacagaatattaaatttattactggcaaacggacactgatttatttcctttgaaatgtgtcccatttaaacacactatacaagttcattatacaaaagatggatgatcattttgatgaaagaagtgcaccctgaaaatttttgccagtttagaatatttagctcttaaagtttaaaaaaaaagtccttttccttttttaaactgaaggctgaattcagattttttttgttgtctcatctgtcagccttcctggtttaaaaacaatagtgtctatggacgcccaccagggggcagtgtaagattagccattaaatcacgaacagctgcaaatattgtgcattcaccttgtcgtggtggattcatctctgcaaacctcttcagaatgttgctgaccatcatgggagcagcaacagaagagttctgctgtctgggaatgtctgcctgctgggttgtacctgaagccatgtcataaatgattggaactataatactaacaggttcttggggagggaccgatgttttctgagttagttgaagaaaaaatagcattttggatttcagcaccacagcaggcgtcccaggaggtgcaatcggcggcgcgctgggagggatcgtcaggcaaaactgaacattccattttagctgtgttgcttggtcagggaacagctccagcttcataatgtgcacacaatccctgaggatgtgtgtaggagctcctaatagcttggtgaaggctattaacgtattagctttaaatggtggtcctgcaactcttgtttcaaagaatttctccaaaacttgaagttcatcaggtttccactgtcctgcattttcaggtgtcacttttagctgaagcgtttggttggttttgggactaagagctactctgcatttcagtgcatcagtcttaaacatgatcactccgggttcattagaatttatcagctgcagcgtttcttgttgaataattctttgaagatgtcgtctcatgatgactgatccaaggaatctctcaagtggagaacaaaggtaactacctgccaggccgggcacaaggcctggagttggagagggcagcagtaaaatgttcaaggcactgtgagtgaggatggtaggtatggatgccgcccaagagcgctgaggtagtttacgaggtggaggcatgtttgttggcattgtttgagaacttgttccagctcgaggggaatgagaagcatctggaaccggagaatgtagtgaggggttggctggtgacattccaggcatgcgtgctgctggtgaggggccagacacttgaggagatcctggccagttccctgctcgtccacttggtgacaccatagtgtatggggaactagggtcaagagttccatgtggactagcaaaactggcccctggtcctattgagattccatgcgaggatgggggaggagttggaacaaatgacgctggtgatggatgaagctgatttgcatgctatgaaccaaagctcgcccatctcctgtttccttatcctcaactagaatttctagcttgagaagacgccatggaaatggctgttgctggggtggtggctggagctgcgatattaaagaatccatcatatctcctcctataggagaagggggattatcgtcctcatttacagaccttcttcgagcatcctgattgctgtcaacaaacatattcaggaacgtctttagtcctggtgcaggatagaaaccttcaactagtttgctgttatcaaaaagactataggcaccatcccgtattgccacaacacctcgactccggcagtatatatcaatgcaatacatgttcctgaaggccagtctgatgtgggtggacgactgtggcagaatggagaagcactggtaggcagtattggttctctgggtcaagcccaacatcggcacagtggggagtttgttgatggcatttaatggagcctgagtatcaaacagtacctgtaataactgaaccacatttggtgttttgttgaacatttcttgaagctgatggagaatggtattgtgacagttactgcaacctgagtttgggccaacagttcccaaagaaatgtggaatttttgatggatcgaattccattggatactaattgagcttcccttggtggttccataacacaagataagttttcggtaattataaacacgaacttctgagaaaatatttagatgagcaggtatgtctggtagagaacgtgcaaattccaacacacactcatataatcgtgcaatgctattccagtcattaagaaacatttcaaccacctttctaccaccaacaggctcagacaacagattttcatatgtcaggtaaacgtgccgggatggtccttgctccctagtagaagtgccattaagtggacaatttgcaaacactaactctgctacccaagtgcggttatttctaccttgtaatcggaaagtgcaatcaagaagagagcggtccagagccttttgggtttcctcagttatacccttacagggaggaatttttaataagcgaattgcatggctgaagccatcaccttccacttgcactccttgatgtggaatctccagattggacaactccaaccgaagtcctacaaatggcatatttgtatcacacatagcgacgaagtgggctaaaactttattgaaggcacacatttctcctgctcgttttgttttcttggattctactggacatggatcatcagacaacttgcgcttggcattggttctggtctgtttcccggtttttgtacgaaaaaccaagtcctgaatgttttccttgaactgctgcagcagcaatgccattgcagggctgtcttcacgatctgcagcattcacagacataaagtagtacttgtacgacagttgtgtgggtttattgggaacctccaacatctccacaacaatgtagtattgtggaaggcgggtaagtttaatgaacagtttattcttagaaaggtttccaataggatgagttgagtaattggaaagctgcaatgtttcactgcttatcgtaggcagatgttttatagactgcttgcaacgctgttgtccaagccaaaacttaagttgctgaatccagggtatgattcgtttcatatcatcattcacagacttctccatgtcatccagagtggcctggtcaagtccataaagcatcaattgaaacattccagaatgtaaatctacaaaaatgtgcagacactctgaattaccacagggctccaagatgggaacaacaagagctgggagtgcagtctctatggaagagttttcattggcattgaagcctctaagaatggccttcagttcttggagcttctgatgagctcttgcatggacactgtcaatcaggagtttttctattgataagtggtcgatcttcatggctctttctactaatttggaatcagaagctggcaaaggaggatcgtgaaaaatctgtaaaggcttggagacatcattctcatcaattttaattgtaactttgtgaacagatgctgttccagtttttctcccaagaacctgttgattccaaactgaaagggagaggcactttccagcatgatacctttccacctgcacaaggtctccccaccgttctcggattaacattagagtttgggaatgtaacacttctaactgaagtgataaacagaaagaatgtaggcagttgtacatatcctgaagaggtttctcatcagcaaagagcctagactgcaccagttgatggatgaagctgatttgcatgctatgaaccaaagctcgcccatctcctgtttccttatcctcaactagaatttctagcttgagaagacgccatggaacatcagggtcatctcccatcacagtcaaggtggcttcaaattctccttcaacacgaaacttcacccggccatttgcaactgtaagatttgctaactgaggaggaagatctgtggttacaagccgatgtctaagaatctgattcagctgatggagtgtggcttgtttttcaattttggtaattgggtctggaggaataattttatccctaatgcaggttggcagccgtgggtaagatccagtagttagtacatcaatggcatatgggatggcaaaactaggcaggcgtgcatggaccagagcatctctagctaacgaggccaggcgatcagcagtgtccacaaacaggatggcttgctgatctaaaaagcttgaaatcatcgcacatttttccactttgccagcattattagcccatttcactaaagctaataatcgaacgaagagttggcgtgtccggctagcaaactgcactatttctattttcctttccacatcagatttccttggcagtaggtccgtcaacaccataagctccgagtaggcccggtgcagcagaaattcaatgagggtgctcagccggtagcccgggctagccgcagctgcagcggccgccgccacggcggctcccgggggaggaggggctggggctgacgggggtccgccgctgcccccgccgccgcctccgggcgggaccagctggtggttctccagctgcactggggccatggcggcgcaggaccgggcttggcgcaacggcacacgatgcggtcctcgagcctcccgggcgctcggtcaccgcgccgaaacgggagcgggcagagtcgccaccgcctaccgccggcaaccctcggccgattaaaccagcctcgtactagcta

SEQ ID NO: 547978 - DNA, 380 bp, Homo sapiens
  misc_feature (1)..(1): n is a, c, g, or t
  misc_feature (94)..(94): n is a, c, g, or t
  misc_feature (109)..(109): n is a, c, g, or t
  misc_feature (112)..(112): n is a, c, g, or t
  misc_feature (117)..(117): n is a, c, g, or t
  misc_feature (120)..(120): n is a, c, g, or t
  misc_feature (124)..(124): n is a, c, g, or t
  misc_feature (131)..(132): n is a, c, g, or t
  misc_feature (136)..(136): n is a, c, g, or t
  misc_feature (139)..(140): n is a, c, g, or t
  misc_feature (154)..(154): n is a, c, g, or t
  misc_feature (172)..(172): n is a, c, g, or t
  misc_feature (180)..(180): n is a, c, g, or t
  misc_feature (191)..(191): n is a, c, g, or t
  misc_feature (193)..(193): n is a, c, g, or t
  misc_feature (196)..(196): n is a, c, g, or t
  misc_feature (200)..(200): n is a, c, g, or t
  misc_feature (207)..(207): n is a, c, g, or t
  misc_feature (214)..(214): n is a, c, g, or t
  misc_feature (229)..(229): n is a, c, g, or t
  misc_feature (236)..(236): n is a, c, g, or t
  misc_feature (239)..(240): n is a, c, g, or t
  misc_feature (242)..(242): n is a, c, g, or t
  misc_feature (263)..(263): n is a, c, g, or t
  misc_feature (274)..(274): n is a, c, g, or t
  misc_feature (276)..(277): n is a, c, g, or t
  misc_feature (289)..(289): n is a, c, g, or t
  misc_feature (291)..(291): n is a, c, g, or t
  misc_feature (293)..(293): n is a, c, g, or t
  misc_feature (295)..(295): n is a, c, g, or t
  misc_feature (314)..(314): n is a, c, g, or t
  misc_feature (318)..(318): n is a, c, g, or t
  misc_feature (352)..(352): n is a, c, g, or t
nggagaggaaaggggcagtcgagtaagacggctaagggaactgagaagcctgaggtgatgggggctctgccttaggcctcctcttcggcctccncaccgaaatcctccnccnctccngcngcgncatcccnncacnccnnacacccacagaccnggccgtccatctcccccncaccctcnctgaaccccancnccnccanccccccncctctcncccactcgaggaagncctcccnccnnancacccgcactcaacccccccnacacgccgccncnncacctccccgancncncncccatccccaaccaagggnagcngccaccccgaggccacgaccgcggggtgtcacanacggcgtgtcttgacatttgttggggat

SEQ ID NO: 547979 - DNA, 154 bp, Homo sapiens
gaagtgattggtcgtgaacaatgaagcagctcaggaagagcacaaggagaagacagaaatatcagagagtctcaagaacctttgaatgaagtaaacagtttcccacaagaaaatcagcgtatacacagagtttctcagtccttgcggagtgggt

SEQ ID NO: 547980 - DNA, 546 bp, Homo sapiens
  misc_feature (73)..(73): n is a, c, g, or t
  misc_feature (87)..(87): n is a, c, g, or t
  misc_feature (100)..(100): n is a, c, g, or t
  misc_feature (105)..(105): n is a, c, g, or t
  misc_feature (118)..(118): n is a, c, g, or t
  misc_feature (138)..(138): n is a, c, g, or t
  misc_feature (159)..(159): n is a, c, g, or t
  misc_feature (174)..(174): n is a, c, g, or t
  misc_feature (228)..(228): n is a, c, g, or t
  misc_feature (236)..(236): n is a, c, g, or t
  misc_feature (376)..(377): n is a, c, g, or t
  misc_feature (385)..(385): n is a, c, g, or t
  misc_feature (407)..(407): n is a, c, g, or t
  misc_feature (438)..(438): n is a, c, g, or t
  misc_feature (449)..(449): n is a, c, g, or t
  misc_feature (451)..(451): n is a, c, g, or t
  misc_feature (459)..(459): n is a, c, g, or t
  misc_feature (461)..(461): n is a, c, g, or t
  misc_feature (477)..(477): n is a, c, g, or t
  misc_feature (485)..(485): n is a, c, g, or t
  misc_feature (487)..(487): n is a, c, g, or t
  misc_feature (511)..(511): n is a, c, g, or t
  misc_feature (520)..(520): n is a, c, g, or t
atggccagcaaggccagctatgttctgtaaaaacaagaagctcaactggggcaccccacaaggatgtagaggngggcgctttgaggnttgcccctccccnccagntgccccatccttnaggcagcgctccatgggggnatggttttgtcactgcccagncctagcagtgacatntcattgtccccagcccagtgggcattggaggtgccaggggagtcagggttgtanccaaaacncccccgcccggggagggttgggaagggggggcaggaagctcaacccctttgggccccaaccctgcattgcaggttggccccttacttccctgggatccccaaagttggtccaaggagggagagtgggttctcaatccggnnccaaaaanataatcccctaggtttccaaanatttttaggactcccgttaactcccatttanacagcaaaaangntattttgnangctgttaagtttttcnatctgggncntttttttaagggaaaaattttaanattaaaccnggggcttctccctcccaaaaacccca

SEQ ID NO: 547981 - DNA, 287 bp, Homo sapiens
  misc_feature (6)..(6): n is a, c, g, or t
  misc_feature (13)..(13): n is a, c, g, or t
  misc_feature (48)..(48): n is a, c, g, or t
  misc_feature (75)..(75): n is a, c, g, or t
  misc_feature (110)..(110): n is a, c, g, or t
  misc_feature (141)..(141): n is a, c, g, or t
  misc_feature (169)..(169): n is a, c, g, or t
  misc_feature (177)..(177): n is a, c, g, or t
  misc_feature (244)..(244): n is a, c, g, or t
aggtanccagatntcccctggttgtatcccaacctgcaatacaatttncacagtgcatgcagaccacagggcacntctgcatggtccctgaaccaactaagcactatgtncagcatgtccaccgtgcctgcaattatgacnaccatgtaaaccagttgttaaattgggntaattttntgtccttgctcaagtccactttttcatctgatttggttcctccaggacagctagaaactggtgttcncatattaatgagacaaagcgcacatcgaggaagtggttttcga

SEQ ID NO: 547982 - DNA, 1178 bp, Homo sapiens
  misc_feature (15)..(15): n is a, c, g, or t
  misc_feature (72)..(72): n is a, c, g, or t
  misc_feature (87)..(87): n is a, c, g, or t
  misc_feature (114)..(114): n is a, c, g, or t
  misc_feature (124)..(124): n is a, c, g, or t
  misc_feature (136)..(136): n is a, c, g, or t
  misc_feature (148)..(148): n is a, c, g, or t
  misc_feature (154)..(154): n is a, c, g, or t
  misc_feature (174)..(174): n is a, c, g, or t
  misc_feature (259)..(259): n is a, c, g, or t
  misc_feature (261)..(261): n is a, c, g, or t
  misc_feature (277)..(277): n is a, c, g, or t
  misc_feature (279)..(279): n is a, c, g, or t
  misc_feature (281)..(281): n is a, c, g, or t
  misc_feature (299)..(300): n is a, c, g, or t
  misc_feature (306)..(306): n is a, c, g, or t
  misc_feature (363)..(363): n is a, c, g, or t
  misc_feature (408)..(408): n is a, c, g, or t
  misc_feature (591)..(591): n is a, c, g, or t
  misc_feature (593)..(593): n is a, c, g, or t
  misc_feature (792)..(792): n is a, c, g, or t
  misc_feature (824)..(824): n is a, c, g, or t
  misc_feature (921)..(921): n is a, c, g, or t
  misc_feature (941)..(941): n is a, c, g, or t
  misc_feature (953)..(953): n is a, c, g, or t
  misc_feature (964)..(964): n is a, c, g, or t
  misc_feature (991)..(991): n is a, c, g, or t
acgccctttcaaaancaaacacttgtctacagtaagcgctcaggaaaaccccgttgctatccttcatcgagnacgaacacgagcaanacatgaatccgctaaaaaaaacgcagntggcaagaanattgatggcagnaggtccttgtgnacgtgnagagggccgaaccgtgaagngctggaggccccggcggctaggaggaggcctcggtggtaccagaagaggaggggctgatgtgaacatccggcattcaggccgcgntnacacctcccgctacgntnanaggcccggcccctccccnnttccgnacagggaccgggaccgggaccgtgagcgggagcgcagagagcggagccgggagcganacaaggagcgagaacggcgaagctcccgctcccgggaaccggcgnaggcgctcacgaagtcgcagacaaggaggagcggaaggcgctccagggagcggagcaagaacaaggaccgggaccggaagcaggcgaagcagccgaagtcgggagcgaggcccggcgggagcgggagcgcaaggaggagctgcgtggcggcggtggcgacatggcggagccctccgaggcggntnacgcgccccctgatgatgggcctccaggggaggcactccctaacggccctgacggtccagaggaaaagggccgggatcgtgaccgggagcgacggcggagccaccggagcgagcgcgagcggcgccgggaccgggatcgtgaccgtgaccgtgaccgcgagcacaaacggggggagcggggcagtgagcggggcagggntaaggcccgaggtgggggcggtggccaggacnacgggctggagggtctgggcaacgacagccgagacatgtacatggagtctgagggcggcgacggctacctggctccgagagatgggtatttgatggnagtgcgccggagtgaagagntcgtcctctccntctgctgtgtntcggacgcgttcctgcaccagcccctngctgtcatcccctcccccaaccttggccacttgagtttgtcctccaagggtaggtgtctcatttgttctggccccttggatttaaaaataaaattaatttcctgttgataaaaaaaaaaacacaacaacaaaagaaaaagaacaagcccacacaacataacctacaaaatgtaaaaatagaaaaaaa

SEQ ID NO: 547983 - DNA, 135 bp, Homo sapiens
ggccttatttaggagaggcgcgcctgccttccccatctgttctatctatctggctggcaggcaaggaaagaacttgcatgttggtgcaaggaagaacgtggggtggaagaagtgcgggtgggacgacagtgaaat

SEQ ID NO: 547984 - DNA, 1056 bp, Homo sapiens
  misc_feature (6)..(6): n is a, c, g, or t
  misc_feature (66)..(66): n is a, c, g, or t
  misc_feature (69)..(69): n is a, c, g, or t
  misc_feature (78)..(78): n is a, c, g, or t
  misc_feature (80)..(80): n is a, c, g, or t
  misc_feature (90)..(90): n is a, c, g, or t
  misc_feature (95)..(95): n is a, c, g, or t
  misc_feature (106)..(106): n is a, c, g, or t
  misc_feature (108)..(108): n is a, c, g, or t
  misc_feature (119)..(119): n is a, c, g, or t
  misc_feature (135)..(135): n is a, c, g, or t
  misc_feature (156)..(156): n is a, c, g, or t
  misc_feature (163)..(164): n is a, c, g, or t
  misc_feature (167)..(167): n is a, c, g, or t
  misc_feature (191)..(191): n is a, c, g, or t
  misc_feature (202)..(202): n is a, c, g, or t
  misc_feature (222)..(222): n is a, c, g, or t
  misc_feature (234)..(234): n is a, c, g, or t
  misc_feature (251)..(251): n is a, c, g, or t
  misc_feature (263)..(263): n is a, c, g, or t
  misc_feature (286)..(286): n is a, c, g, or t
  misc_feature (469)..(469): n is a, c, g, or t
  misc_feature (471)..(471): n is a, c, g, or t
  misc_feature (670)..(670): n is a, c, g, or t
  misc_feature (702)..(702): n is a, c, g, or t
  misc_feature (799)..(799): n is a, c, g, or t
  misc_feature (819)..(819): n is a, c, g, or t
  misc_feature (831)..(831): n is a, c, g, or t
  misc_feature (842)..(842): n is a, c, g, or t
  misc_feature (869)..(869): n is a, c, g, or t
aaaganctggaagcccccggccggcttaggagaaggcctccggtggttaccaagaaagaggaaggngcntgaatgtgnancatcccggcnatccnaggccagcgantnactccctcccngcttacggatcaagangccccggccccctccccccgnttcccgnnacnaggggaccgggaaccgggaacctntgcagcggggngcgccagagcagcggtagcncgggcagcgaanaccaaggaagcggaganacgggcggtagntccccgctcccgggaaccggcgnaggcgctcacgaagtcgcagacaaggaggagcggaaggcgctccagggagcggagcaagaacaaggaccgggaccggaagcaggcgaagcagccgaagtcgggagcgaggcccggcgggagcgggagcgcaaggaggagctgcgtggcggcggtggcgacatggcggagccctccgaggcggntnacgcgccccctgatgatgggcctccaggggaggcactccctaacggccctgacggtccagaggaaaagggccgggatcgtgaccgggagcgacggcggagccaccggagcgagcgcgagcggcgccgggaccgggatcgtgaccgtgaccgtgaccgcgagcacaaacggggggagcggggcagtgagcggggcagggntaaggcccgaggtgggggcggtggccaggacnacgggctggagggtctgggcaacgacagccgagacatgtacatggagtctgagggcggcgacggctacctggctccgagagatgggtatttgatggnagtgcgccggagtgaagagntcgtcctctccntctgctgtgtntcggacgcgttcctgcaccagcccctngctgtcatcccctcccccaaccttggccacttgagtttgtcctccaagggtaggtgtctcatttgttctggccccttggatttaaaaataaaattaatttcctgttgataaaaaaaaaaacacaacaacaaaagaaaaagaacaagcccacacaacataacctacaaaatgtaaaaatagaaaaaaa

SEQ ID NO: 547985 - DNA, 1342 bp, Homo sapiens
ctggctccgcgtcggccggtcggtttggtcggttgtagtggcctcgccgcccggtccgctgtcgcagcgctcatccgcgccgggagcccttggctgcgtcgcccggcagccgcgggagcatttcctgaagacgtagtcatgcagcacgtcagcagctcccagagcagccagcgccatgtccagtggcctggggcctgccccggcgcgggcgaggagcagccagcgtgctcccagccgtccctgcccctcacactgccatcccccagccaccaactacagcagctgatggtccagacccagagtcccacgcagcccagtccggggccggggcaggccttgcagaatgtgcgtgcaggtgcccctggccctgggctgggcctctgcagcagcagccctacaggggacttcgtggatgccagcgtgctggtgaggcagatcagcttgagcccctccagtggtggacactttgtgtttcaggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacgcccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcattaccaggagatgcaggctctgaaggaggtcttcaaggagtatttgattgaactgtttttcttgcaacactttcaagggaacatgatggatttcttagctttcaaggagagactgtatggaccattacaagcatatcttaggcagaatgatttggacattgaagaagaggaggaggaggaggaagaggaggaagaaaaatctgaggttatcaatgacgaggtaagaaaacggagttaatttgtttagtacaaatcttctagatgatcagagtctatgcgacaatgaataagtaataatttattgagcctcgaacctatgagggatcctc

SEQ ID NO: 547986 - DNA, 252 bp, Homo sapiens
  misc_feature (31)..(31): n is a, c, g, or t
gacaggtggatgagcgcccgcgaacgacggncctcaggcagccatgctcaccccgattgcttccaccagctcaggctgcatggtttcgacaagaggaatttgtttctcatagttggggaggggggaattccaagatcaagcagggcctatgaccatgtctgatgttcagggaatgaagaagtgaagaaagcaggaatgaatgaaggaaggaagcagccccagcaattggttcccacgcgagaagctggtggg

SEQ ID NO: 547987 - DNA, 128 bp, Homo sapiens
tgtgtatcacaagtgtgcaccaccacacccagccagttgggaaaatcttattggagaaacgaggactatgctgtgttgcccaggctggtctcaaactcctggccccaagcattctccccgctatgagt

SEQ ID NO: 547988 - DNA, 864 bp, Homo sapiens
ctggctccgcgtcggccggtcggtttggtcggttgtagtggcctcgccgcccggtccgctgtcgcagcgctcatccgcgccgggagcccttggctgcgtcgcccggcagccgcgcctcgcgagaccgctgtctacggcgctgacgccgcctctgcctcttgaccccttggccccgctgtcctgatccctgaggtcggggcctggtctgcactccaggaaagacgagtgcgcttagtgtgcgctgcacgtgagcagtgaagttgattccacgcgctgcgctgctcggcagctgtcccagaactgaccacggacccctccgcgggtcctgctcctgacaagggccttccggcactgggagttttgtgttagtggaaaggaagaatctaataataccaccacctttacagtaaagacgctgcgaattgacgccttttataataaagacacttatcttgcccaagagctgggggcaggctgattggcgctggtttccatctgtcagattggacagcagtaccactggctgttgggggctcacgaccagatagagtcttgtctgggaaccacaagtgagtgttgttaccacagctctgcagcagtgagggcacctctcaatccacgtgcagtcgccccaccttatcttcaggggatacggtccaacaccctcaatggatgcctgaaatcaaggatagtagtgaacactatatacactgttttgttatgcatccttccatatctacgataaagtttaattcataaactaggcacaggaagagattaataacagctaataataaaatagaacagtcgtaacaatatactgtaataaaagtcatgtgaaagtgatgtctctctcctaaaaaa

SEQ ID NO: 547989 - DNA, 838 bp, Homo sapiens
gccgagagcgccggtggagccaccagaattgtgataccagggtgtggattggacgccaggaagtcgcgccacgagggcacaaggaggtgggcccccgaaagggcgaagaggggtacgggccagcgagtgaaacagcgagcccgttgcagggggcatgcgagcggagtgagcaagagtgtgttaacggggaacaggcagagagcaacaaccgatacgccgtccggcgccccctgggggggccgctgcttgtgcccccccccgccgctggtcgagggaatgaagataagggcgagcccgcttttcggggaacaaatttggcgggccccaaatgtggcgacagaagttcttaagcgaagagagatctttcggaaaagttaaatgttttccccggggggggacaccatccacttgtgcaccacgaagccctcgcgtgaagcgccaaaccttcataggtgggcggcgcaaagtaggaaatagaacgcgcgcgaatgttttccacggtgggcggccaccactgttggcacgcacagaaagtaaaacgccagacttgtttacaatttctcttgcgcataaagtcagaatggggcgcccaatagagggcaatatagaaggccagtcaattcgctccgccttcattgatctctttgagaatgtttcattgatgtcgtgcgtgacactatatggagcaccaagggttttagttaaacgagggtgctgtcaccgtgcgaattcaatcaaaaggaggccgaattgcgaggaaaaatgttggcggaggctccatctttaaaagcttttagtctttggtttttaaaaaaaaaaaatccaagaacacaagaca

SEQ ID NO: 547990 - DNA, 460 bp, Homo sapiens
aagggcttcagttttccactttgcctagacttaggcagaataatttggacatttaataagaggaagagagagcaactttgaacgtcgattaagtgatgaaggttaaaagagttgtgggccaagagtggccagaaagcacgggcagcctgggactcctgttgccatagcaacccagctaccgccgaggacttctgcggcttttccagcccagcagcagccgctccaggtactttctgatggctccacagtgcagctccccagactttcctcactcggatttgaggactcgatgtgctgaggcaggacccagaggggtcccaagagcctgtcctcttttgttcaaaatacatcttgaaacgtctttgtgaaggctcttagttttaatgcatggatgctgttatttttccctactgttactgaaattaaaaagtgtttgtctctgaaaacaacaaaaaaaaaa

SEQ ID NO: 547991 - DNA, 2878 bp, Homo sapiens
caaactcacagccctctccaaactggctggggctgctgggagactcccaaggaactcgtcaggaaggcaggagacaggagacgggacctctacagggagacggtgggccggcccttgggggggctgatgtggccccaaggctgagtcccgtcagggtctggcctcggcctcaggcccccaaggagccggccctacaccccatgggtttgtcactgcccaaggagaaagggctaattctctgcctatggagcaagttctgcagatggttccagagacgggagtcctgggcccagagccgagatgagcagaacctgctgcagcagaagaggatctgggagtctcctctccttctagctgccaaagataatgatgtccaggccctgaacaagttgctcaagtatgaggattgcaaggtgcaccagagaggagccatgggggaaacagcgctacacatagcagccctctatgacaacctggaggccgccatggtgctgatggaggctgccccggagctggtctttgagcccatgacatctgagctctatgagggtcagactgcactgcacatcgctgttgtgaaccagaacatgaacctggtgcgagccctgcttgcccgcagggccagtgtctctgccagagccacaggcactgccttccgccgtagtccctgcaacctcatctactttggggagcaccctttgtcctttgctgcctgtgtgaacagtgaggagatcgtgcggctgctcattgagcatggagctgacatccgggcccaggactccctgggaaacacagtgttacacatcctcatcctccagcccaacaaaacctttgcctgccagatgtacaacctgttgctgtcctacgacagacatggggaccacctgcagcccctggacctcgtgcccaatcaccagggtctcacccctttcaagctggctggagtggagggtaacactgtgatgtttcagcacctgatgcagaagcggaagcacacccagtggacgtatggaccactgacctcgactctctatgacctcacagagatcgactcctcaggggatgagcagtccctgctggaacttatcatcaccaccaagaagcgggaggctcgccagatcctggaccagacgccggtgaaggagctggtgagcctcaagtggaagcggtacgggcggccgtacttctgcatgctgggtgccatatatctgctgtacatcatctgcttcaccatgtgctgcatctaccgccccctcaagcccaggaccaataaccgcacgagcccccgggacaacaccctcttacagcagaagctacttcaggaagcctacatgacccctaaggacgatatccggctggtcggggagctggtgactgtcattggggctatcatcatcctgctggtagaggttccagacatcttcagaatgggggtcactcgcttctttggacagaccatccttgggggcccattccatgtcctcatcatcacctatgccttcatggtgctggtgaccatggtgatgcggctcatcagtgccagcggggaggtggtacccatgtcctttgcactcgtgctgggctggtgcaacgtcatgtacttcgcccgaggattccagatgctaggccccttcaccatcatgattcagaagatgatttttggcgacctgatgcgattctgctggctgatggctgtggtcatcctgggctttgcttcagccttctatatcatcttccagacagaggaccccgaggagctaggccacttctacgactaccccatggccctgttcagcaccttcgagctgttccttaccatcatcgatggcccagccaactacaacgtggacctgcccttcatgtacagcatcacctatgctgcctttgccatcatcgccacactgctcatgctcaacctcctcattgccatgatgggcgacactcactggcgagtggcccatgagcgggatgagctgtggagggcccagattgtggccaccacggtgatgctggagcggaagctgcctcgctgcctgtggcctcgctccgggatctgcggacgggagtatggcctgggagaccgctggttcctgcgggtggaagacaggcaagatctcaaccggcagcggatccaacgctacgcacaggccttccacacccggggctctgaggatttggacaaagactcagtggaaaaactagagctgggctgtcccttcagcccccacctgtcccttcctatgccctcagtgtctcgaagtacctcccgcagcagtgccaattgggaaaggcttcggcaagggaccctgaggagagacctgcgtgggataatcaacaggggtctggaggacggggagagctgggaatatcagatctgactgcgtgttctcacttcgcttcctggaacttgctctcattttcctgggtgcatcaaacaaaacaaaaaccaaacacccagaggtctcatctcccaggccccaggggagaaagaggagtagcatgaacgccaaggaatgtacgttgagaatcactgctccaggcctgcattactccttcagctctggggcagaggaagcccagcccaagcacggggctggcagggcgtgaggaactctcctgtggcctgctcatcacccttccgacaggagcactgcatgtcagagcactttaaaaacaggccagcctgcttgggcgctcggtctccaccccagggtcataagtggggagagagcccttcccagggcacccaggcaggtgcagggaagtgcagagcttgtggaaagcgtgtgagtgagggagacaggaacggctctgggggtgggaagtggggctaggtcttgccaactccatcttcaataaagtcgttttcggatccctg

SEQ ID NO: 547992 - DNA, 102 bp, Homo sapiens
tccaggttggcctggtgggcatgtcgcctgaccgcagcactcctctgtctctgctctatgcctgcacccttccatcctcctttgcctaggaggccttctcgc

SEQ ID NO: 547993 - DNA, 942 bp, Homo sapiens
ctggctccgcgtcggccggtcggtttggtcggttgtagtggcctcgccgcccggtccgctgtcgcagcgctcatccgcgccgggagcccttggctgcgtcgcccggcagccgcgcctcgcgagaccgctgtctacggcgctgacgccgcctctgcctcttgaccccttggccccgctgtcctgatccctgaggtcggggcctggtctgcactccaggaaagacgagtgcgcttagtgtgcgctgcacgtgagcagtgaagttgattccacgcgctgcgctgctcggcagctgtcccagaactgaccacggacccctccgcgggtcctgctcctgacaagggccttccggcactgggagttttgtgttagtggaaaggaagaatctaataataccaccacctttacagtaaagacgctgcgaattgacgccttttataataaagacacttatcttgcccaagagctgggtgagtatttcctccttaccaaaaagttggtttacttacagttaactggctgaaagtttgagtcttaggcttatttgtgccgctccaggcaggctgattggcgctggtttccatctgtcagattggacagcagtaccactggctgttgggggctcacgaccagatagagtcttgtctgggaaccacaagtgagtgttgttaccacagctctgcagcagtgagggcacctctcaatccacgtgcagtcgccccaccttatcttcaggggatacggtccaacaccctcaatggatgcctgaaatcaaggatagtagtgaacactatatacactgttttgttatgcatccttccatatctacgataaagtttaattcataaactaggcacaggaagaatcagctttttttgatatcagttggtagttggaaagactatatactattttatctgaggcatgcgtgagtgaaaaaaaagc

SEQ ID NO: 547994 - DNA, 728 bp, Homo sapiens
  misc_feature (258)..(258): n is a, c, g, or t
  misc_feature (264)..(264): n is a, c, g, or t
tttattttctccaggaatatatattgatattctaagtgggatgtttatatttataagtggcctttatgtctgtagggtcaaaatatctgggagcccttaaaagccctttctatttgctttctctggtgcctgtgctcctgggaatggggcttctgcttcctgtctttctcctgcctctggcctggctgcgtcatggatgttgggtcattgggtaaagaattgttggtctcaagctctatcaactctctcccactgaanaaggtnaacaaaggctgccctacccctacctctgtctgcgcccagcctcatctctgacttctccttttgttcccatacgcagattgtggccaccacggtgatgctggagcggaagctgcctcgctgcctgtggcctcgctccgggatctgcggacgggagtatggcctgggagaccgctggttcctgcggtgagtgatatgcgggggtaggtgtcccctgagaagcctcatcggcagggtatccccctgctcagacagcttccggctcctgggttccctgtggaggcctgtgtgctccctaggctctatgcttgttgattgagctggtgaggaaggggtcccgtttggagctcagacttcccaaagcatccagggagtctgtggcagagcctgctgctttctgaggcctagctgccaaggggccagtgacccaggcatccaccatggctgcagaaaagggaaaaggccag

SEQ ID NO: 547995 - DNA, 460 bp, Homo sapiens
gatcttagaggatcccccagttacaacagctgaagaagttttgagaacactctgtagcaaatgatcagtctgttgctacttgtaactgatagtgcagctaagtgctcagatcgacaagacagcgatgccactgtctctcaaaaagaatgtcatgggaacatactgaaattttcctctgccgtaaacataccatcataacctgatctcccgagacatgctctatgaatacctacggtaatactgtcagatcattcagtacagagaggactcagatcatggtgaagtgccaatgccatctcaggtacctgtcgtccattttattaaataaaagtgtgtctagagtttaactgtatgggcttttctttaaaaacttttaaatgagtatggcttgttagcattttttattttttgagtttgattatcattttgttttatcaggctagcctagatcaaggaaaga

SEQ ID NO: 547996 - DNA, 159 bp, Homo sapiens
gtactttgccacaggggaggtccatagatactgctgaaacaggaaaaccaacgaggtatcaatagagaatgatacttagtgatgagcagagcaataccaataagaagaagcttaaagagagatgaaatggtgtgcctcagtggaacaggcaaatagtgc

SEQ ID NO: 547997 - DNA, 479 bp, Homo sapiens
aacagagataccctcaacagggggccgaactttgctgaagaggcggagagctagctgtcgcccagactggcaggagctctggggccgcagtactacctgtaggatagagagtaaagaagagcccaacccaatgtccttcctgccataaagcaacccacaaatcctctgcagaatgagaggagaagcaatggtactgttaagctgggcaagctttcaccctgtcagatcaccacattgttttccatagtggatttatactgaagggccgttataaatgcgccatgctaaaatcatacaaatgcattaggaaaggggaaataagcctcacctgatatccaggtgttagtaatagggtattaaaggttaaccagggcaactacagatgatgttaggcatgtgtcataaaacttattctcatataaagacagattttgccccatatagtataataaacctttcccaaaagtttaaaaaaaaaa

SEQ ID NO: 547998 - DNA, 623 bp, Homo sapiens
  misc_feature (569)..(569): n is a, c, g, or t
ctggctccgcgtcggccggtcggtttggtcggttgtagtggcctcgccgcccggtccgctgtcgcagcgctcatccgcgccgggagcccttggctgcgtcgcccggcagccgcgcctcgcgagaccgctgtctacggcgctgacgccgcctctgcctcttgaccccttggccccgctgtcctgatccctgaggtcggggcctggtctgcactccaggaaagacgagtgcgcttagtgtgcgctgcacgtgagcagtgaagttgattccacgcgctgcgctgctcggcagctgtcccagaactgaccacggacccctccgcgggtcctgctcctgacaagggccttccggcactgggagttttgtgttagtggaaaggaagaatctaataataccaccacctttacagtaaagacgctgcgaattgacgccttttataataaagacacttatcttgcccaagagctgggatctgggtttcctgcattacttattaagaagctttcaccacctcgcagttgtagagatagtccccgaaatattattccaataaagtgttttcctcctttcntccctgcctcctcttccttccttccaggataacatttagttctttattctgact

SEQ ID NO: 547999 - DNA, 786 bp, Homo sapiens
  misc_feature (566)..(566): n is a, c, g, or t
  misc_feature (576)..(576): n is a, c, g, or t
caaactcacagccctctccaaactggctggggctgctgggagactcccaaggaactcgtcaggaaggcaggagacaggagacgggacctctacagggagacggtgggccggcccttgggggggctgatgtggccccaaggctgagtcccgtcagggtctggcctcggcctcaggcccccaaggagccggccctacaccccatgggtttgtcactgcccaaggagaaagggctaattctctgcctatggagcaagttctgcagatggttccagagacgggagtcctgggcccagagccgagatgagcagaacctgctgcagcagaagaggatctgggagtctcctctccttctagctgccaaagataatgatgtccaggccctgaacaagttgctcaagtatgaggattgcaaggtgcaccagagaggtaagaagcacaaatgcagcatgatctcctaggtgagccccacacatggggcctcccaggagtgcccaggacctcgtgctgttggcctctgaatctatcgtctccaatccgctgtcccacagaagccatataacccaccnctctgtaaangccaggagccatgggggaaacagcgctacacatagcagccctctatgacaacctggaggccgccatggtgctgatggaggctgccccggagctggtctttgagcccatgacatctgagctctatgagggtgagggccacgggtctggggtgaagagcaggagtgactggttgggtatctcaaggcagttctccgtgatggatattattag

SEQ ID NO: 548000 - DNA, 2634 bp, Homo sapiens
tgatggataatttgggaaagacacaggggatctgagcctcctactctttttttctcttctctgtctcccttccgtgtcagtcctgactgcccatcacttgaacgcctgccccctgaaatgccaggggcctagagaagaggaagagatgggcagcagctggatcccctgggaatcctgaacacccgagagctccctgttctccatcccaggctacccctgagggaaagagactggggtgcatatgggagggaccccctgcaggatcctggggacagacccgtgactgacagctgtctctgggccaggtcagactgcactgcacatcgctgttgtgaaccagaacatgaacctggtgcgagccctgcttgcccgcagggccagtgtctctgccagagccacaggcactgccttccgccgtagtccctgcaacctcatctactttggggagcaccctttgtcctttgctgcctgtgtgaacagtgaggagatcgtgcggctgctcattgagcatggagctgacatccgggcccaggactccctgggaaacacagtgttacacatcctcatcctccagcccaacaaaacctttgcctgccagatgtacaacctgttgctgtcctacgacagacatggggaccacctgcagcccctggacctcgtgcccaatcaccagggtctcacccctttcaagctggctggagtggagggtaacactgtgatgtttcagcacctgatgcagaagcggaagcacacccagtggacgtatggaccactgacctcgactctctatgacctcacagagatcgactcctcaggggatgagcagtccctgctggaacttatcatcaccaccaagaagcgggaggctcgccagatcctggaccagacgccggtgaaggagctggtgagcctcaagtggaagcggtacgggcggccgtacttctgcatgctgggtgccatatatctgctgtacatcatctgcttcaccatgtgctgcatctaccgccccctcaagcccaggaccaataaccgcacgagcccccgggacaacaccctcttacagcagaagctacttcaggaagcctacatgacccctaaggacgatatccggctggtcggggagctggtgactgtcattggggctatcatcatcctgctggtagaggttccagacatcttcagaatgggggtcactcgcttctttggacagaccatccttgggggcccattccatgtcctcatcatcacctatgccttcatggtgctggtgaccatggtgatgcggctcatcagtgccagcggggaggtggtacccatgtcctttgcactcgtgctgggctggtgcaacgtcatgtacttcgcccgaggattccagatgctaggccccttcaccatcatgattcagaagatgatttttggcgacctgatgcgattctgctggctgatggctgtggtcatcctgggctttgcttcagccttctatatcatcttccagacagaggaccccgaggagctaggccacttctacgactaccccatggccctgttcagcaccttcgagctgttccttaccatcatcgatggcccagccaactacaacgtggacctgcccttcatgtacagcatcacctatgctgcctttgccatcatcgccacactgctcatgctcaacctcctcattgccatgatgggcgacactcactggcgagtggcccatgagcgggatgagctgtggagggcccagattgtggccaccacggtgatgctggagcggaagctgcctcgctgcctgtggcctcgctccgggatctgcggacgggagtatggcctgggagaccgctggttcctgcgggtggaagacaggcaagatctcaaccggcagcggatccaacgctacgcacaggccttccacacccggggctctgaggatttggacaaagactcagtggaaaaactagagctgggctgtcccttcagcccccacctgtcccttcctatgccctcagtgtctcgaagtacctcccgcagcagtgccaattgggaaaggcttcggcaagggaccctgaggagagacctgcgtgggataatcaacaggggtctggaggacggggagagctgggaatatcagatctgactgcgtgttctcacttcgcttcctggaacttgctctcattttcctgggtgcatcaaacaaaacaaaaaccaaacacccagaggtctcatctcccaggccccaggggagaaagaggagtagcatgaacgccaaggaatgtacgttgagaatcactgctccaggcctgcattactccttcagctctggggcagaggaagcccagcccaagcacggggctggcagggcgtgaggaactctcctgtggcctgctcatcacccttccgacaggagcactgcatgtcagagcactttaaaaacaggccagcctgcttgggcgctcggtctccaccccagggtcataagtggggagagagcccttcccagggcacccaggcaggtgcagggaagtgcagagcttgtggaaagcgtgtgagtgagggagacaggaacggctctgggggtgggaagtggggctaggtcttgccaactccatcttcaataaagtcgttttcggatccctg

SEQ ID NO: 548001 - DNA, 2911 bp, Homo sapiens
  misc_feature (444)..(444): n is a, c, g, or t
  misc_feature (454)..(454): n is a, c, g, or t
caaactcacagccctctccaaactggctggggctgctgggagactcccaaggaactcgtcaggaaggcaggagacaggagacgggacctctacagggagacggtgggccggcccttgggggggctgatgtggccccaaggctgagtcccgtcagggtctggcctcggcctcaggcccccaaggagccggccctacaccccatgggtttgtcactgcccaaggagaaagggctaattctctgcctatggagcaagttctgcagatggttccagagacgggagtcctgggcccagagccgagatgagcagaacctgctgcagcagaagaggatctgggagtctcctctccttctagctgccaaagataatgatgtccaggccctgaacaagttgctcaagtatgaggattgcaaggtgcaccagagagaagccatataacccaccnctctgtaaangccaggagccatgggggaaacagcgctacacatagcagccctctatgacaacctggaggccgccatggtgctgatggaggctgccccggagctggtctttgagcccatgacatctgagctctatgagggtcagactgcactgcacatcgctgttgtgaaccagaacatgaacctggtgcgagccctgcttgcccgcagggccagtgtctctgccagagccacaggcactgccttccgccgtagtccctgcaacctcatctactttggggagcaccctttgtcctttgctgcctgtgtgaacagtgaggagatcgtgcggctgctcattgagcatggagctgacatccgggcccaggactccctgggaaacacagtgttacacatcctcatcctccagcccaacaaaacctttgcctgccagatgtacaacctgttgctgtcctacgacagacatggggaccacctgcagcccctggacctcgtgcccaatcaccagggtctcacccctttcaagctggctggagtggagggtaacactgtgatgtttcagcacctgatgcagaagcggaagcacacccagtggacgtatggaccactgacctcgactctctatgacctcacagagatcgactcctcaggggatgagcagtccctgctggaacttatcatcaccaccaagaagcgggaggctcgccagatcctggaccagacgccggtgaaggagctggtgagcctcaagtggaagcggtacgggcggccgtacttctgcatgctgggtgccatatatctgctgtacatcatctgcttcaccatgtgctgcatctaccgccccctcaagcccaggaccaataaccgcacgagcccccgggacaacaccctcttacagcagaagctacttcaggaagcctacatgacccctaaggacgatatccggctggtcggggagctggtgactgtcattggggctatcatcatcctgctggtagaggttccagacatcttcagaatgggggtcactcgcttctttggacagaccatccttgggggcccattccatgtcctcatcatcacctatgccttcatggtgctggtgaccatggtgatgcggctcatcagtgccagcggggaggtggtacccatgtcctttgcactcgtgctgggctggtgcaacgtcatgtacttcgcccgaggattccagatgctaggccccttcaccatcatgattcagaagatgatttttggcgacctgatgcgattctgctggctgatggctgtggtcatcctgggctttgcttcagccttctatatcatcttccagacagaggaccccgaggagctaggccacttctacgactaccccatggccctgttcagcaccttcgagctgttccttaccatcatcgatggcccagccaactacaacgtggacctgcccttcatgtacagcatcacctatgctgcctttgccatcatcgccacactgctcatgctcaacctcctcattgccatgatgggcgacactcactggcgagtggcccatgagcgggatgagctgtggagggcccagattgtggccaccacggtgatgctggagcggaagctgcctcgctgcctgtggcctcgctccgggatctgcggacgggagtatggcctgggagaccgctggttcctgcgggtggaagacaggcaagatctcaaccggcagcggatccaacgctacgcacaggccttccacacccggggctctgaggatttggacaaagactcagtggaaaaactagagctgggctgtcccttcagcccccacctgtcccttcctatgccctcagtgtctcgaagtacctcccgcagcagtgccaattgggaaaggcttcggcaagggaccctgaggagagacctgcgtgggataatcaacaggggtctggaggacggggagagctgggaatatcagatctgactgcgtgttctcacttcgcttcctggaacttgctctcattttcctgggtgcatcaaacaaaacaaaaaccaaacacccagaggtctcatctcccaggccccaggggagaaagaggagtagcatgaacgccaaggaatgtacgttgagaatcactgctccaggcctgcattactccttcagctctggggcagaggaagcccagcccaagcacggggctggcagggcgtgaggaactctcctgtggcctgctcatcacccttccgacaggagcactgcatgtcagagcactttaaaaacaggccagcctgcttgggcgctcggtctccaccccagggtcataagtggggagagagcccttcccagggcacccaggcaggtgcagggaagtgcagagcttgtggaaagcgtgtgagtgagggagacaggaacggctctgggggtgggaagtggggctaggtcttgccaactccatcttcaataaagtcgttttcggatccctg

SEQ ID NO: 548002 - DNA, 120 bp, Homo sapiens
ggtgtcatcgatgcataagccagttttttgggtgtgtggtttctttttttaattttcacaggcacaggatctgctgtgcccaggctggtctcaaactccaggcctcaagcagttctccca

SEQ ID NO: 548003 - DNA, 3191 bp, Homo sapiens
caaactcacagccctctccaaactggctggggctgctgggagactcccaaggaactcgtcaggaaggcaggagacaggagacgggacctctacagggagacggtgggccggcccttgggggggctgatgtggccccaaggctgagtcccgtcagggtctggcctcggcctcaggcccccaaggagccggccctacaccccatgggtttgtcactgcccaaggagaaagggctaattctctgcctatggagcaagttctgcagatggttccagagacgggagtcctgggcccagagccgagatgagcagaacctgctgcagcagaagaggatctgggagtctcctctccttctagctgccaaagataatgatgtccaggccctgaacaagttgctcaagtatgaggattgcaaggtgcaccagagaggagccatgggggaaacagcgctacacatagcagccctctatgacaacctggaggccgccatggtgctgatggaggctgccccggagctggtctttgagcccatgacatctgagctctatgagggtcagactgcactgcacatcgctgttgtgaaccagaacatgaacctggtgcgagccctgcttgcccgcagggccagtgtctctgccagagccacaggcactgccttccgccgtagtccctgcaacctcatctactttggggagcaccctttgtcctttgctgcctgtgtgaacagtgaggagatcgtgcggctgctcattgagcatggagctgacatccgggcccaggactccctgggaaacacagtgttacacatcctcatcctccagcccaacaaaacctttgcctgccagatgtacaacctgttgctgtcctacgacagacatggggaccacctgcagcccctggacctcgtgcccaatcaccagggtctcacccctttcaagctggctggagtggagggtaacactgtgatgtttcagcacctgatgcagaagcggaagcacacccagtggacgtatggaccactgacctcgactctctatgacctcacagagatcgactcctcaggggatgagcagtccctgctggaacttatcatcaccaccaagaagcgggaggctcgccagatcctggaccagacgccggtgaaggagctggtgagcctcaagtggaagcggtacgggcggccgtacttctgcatgctgggtgccatatatctgctgtacatcatctgcttcaccatgtgctgcatctaccgccccctcaagcccaggaccaataaccgcacgagcccccgggacaacaccctcttacagcagaagctacttcaggaagcctacatgacccctaaggacgatatccggctggtcggggagctggtgactgtcattggggctatcatcatcctgctggtagaggttccagacatcttcagaatgggggtcactcgcttctttggacagaccatccttgggggcccattccatgtcctcatcatcacctatgccttcatggtgctggtgaccatggtgatgcggctcatcagtgccagcggggaggtggtacccatgtcctttgcactcgtgctgggctggtgcaacgtcatgtacttcgcccgaggattccagatgctaggccccttcaccatcatgattcagaagatgatttttggcgacctgatgcgattctgctggctgatggctgtggtcatcctgggctttgcttcagccttctatatcatcttccagacagaggaccccgaggagctaggccacttctacgactaccccatggccctgttcagcaccttcgagctgttccttaccatcatcgatggcccagccaactacaacgtggacctgcccttcatgtacagcatcacctatgctgcctttgccatcatcgccacactgctcatgctcaacctcctcattgccatgatgggcgacactcactggcgagtggcccatgagcgggatgagctgtggagggcccagattgtggccaccacggtgatgctggagcggaagctgcctcgctgcctgtggcctcgctccgggatctgcggacgggagtatggcctgggagaccgctggttcctgcgggtggaagacaggcaagatctcaaccggcagcggatccaacgctacgcacaggccttccacacccggggctctgaggatttggacaaagactcagtggaaaaactagagctgggctgtcccttcagcccccacctgtcccttcctatgccctcagtgtctcgaagtacctcccgcagcagtgccaattgggaaaggcttcggcaagggaccctgaggagagacctgcgtgggataatcaacaggggtctggaggacggggagagctgggaatatcagatctgactgcgtgttctcacttcgcttcctggaacttgctctcattttcctgggtgcatcaaacaaaacaaaaaccaaacacccagaggtctcatctcccaggccccaggggagaaagaggagtagcatgaacgccaaggaatgtacgttgagaatcactgctccaggcctgcattactccttcagctctggggcagaggaagcccagcccaagcacggggctggcagggcgtgaggaactctcctgtggcctgctcatcacccttccgacaggagcactgcatgtcagagcactttaaaaacaggccagcctgcttgggcgctcggtctccaccccagggtcataagtggggagagagcccttcccagggcacccaggcaggtgcagggaagtgcagagcttgtggaaagcgtgtgagtgagggagacaggaacggctctgggggtgggaagtggggctaggtcttgccaactccatcttcaataaagtcgttttcggatccctgcccaaaaaaaaaaaaagaaacacgataacaaacgaaagacaagcagagaaccaagcagccatacgaagagccacaaccaacgccgaaccagaacaaactgcaagaccatcaacaaggcggcgcgcggccgcataatgaatcaaccagcgggggaggcagggaggcggccgccccagtctcagaagcaacagggcgccccacgggaggcggataataagaagcacaggggcacataaaaaagccgggagagcaacacgcgtgggcgtgagaagacaccgcgggcggggacaagagacacccacgaaagagaccg

SEQ ID NO: 548004 - DNA, 1230 bp, Homo sapiens
  misc_feature (258)..(258): n is a, c, g, or t
  misc_feature (264)..(264): n is a, c, g, or t
tttattttctccaggaatatatattgatattctaagtgggatgtttatatttataagtggcctttatgtctgtagggtcaaaatatctgggagcccttaaaagccctttctatttgctttctctggtgcctgtgctcctgggaatggggcttctgcttcctgtctttctcctgcctctggcctggctgcgtcatggatgttgggtcattgggtaaagaattgttggtctcaagctctatcaactctctcccactgaanaaggtnaacaaaggctgccctacccctacctctgtctgcgcccagcctcatctctgacttctccttttgttcccatacgcagattgtggccaccacggtgatgctggagcggaagctgcctcgctgcctgtggcctcgctccgggatctgcggacgggagtatggcctgggagaccgctggttcctgcgggtggaagacaggcaagatctcaaccggcagcggatccaacgctacgcacaggccttccacacccggggctctgaggatttggacaaagactcagtggaaaaactagagctgggctgtcccttcagcccccacctgtcccttcctatgccctcagtgtctcgaagtacctcccgcagcagtgccaattgggaaaggcttcggcaagggaccctgaggagagacctgcgtgggataatcaacaggggtctggaggacggggagagctgggaatatcagatctgactgcgtgttctcacttcgcttcctggaacttgctctcattttcctgggtgcatcaaacaaaacaaaaaccaaacacccagaggtctcatctcccaggccccaggggagaaagaggagtagcatgaacgccaaggaatgtacgttgagaatcactgctccaggcctgcattactccttcagctctggggcagaggaagcccagcccaagcacggggctggcagggcgtgaggaactctcctgtggcctgctcatcacccttccgacaggagcactgcatgtcagagcactttaaaaacaggccagcctgcttgggcgctcggtctccaccccagggtcataagtggggagagagcccttcccagggcacccaggcaggtgcagggaagtgcagagcttgtggaaagcgtgtgagtgagggagacaggaacggctctgggggtgggaagtggggctaggtcttgccaactccatcttcaataaagtcgttttcggatccctg

SEQ ID NO: 548005 - DNA, 183 bp, Homo sapiens
agtgagggtcatacgtttaatcccgtgcgacgttgggaggcaagggaggaggatgagtgaggccaggagttttgagagggggtctctacaaaaaataaaaataaaattagcagggtgtagtagtgcatgcttgtattcccagctactgaggaggctgagaagggaggattgcttgttccgctg

SEQ ID NO: 548006 - DNA, 2048 bp, Homo sapiens
tgatggataatttgggaaagacacaggggatctgagcctcctactctttttttctcttctctgtctcccttccgtgtcagtcctgactgcccatcacttgaacgcctgccccctgaaatgccaggggcctagagaagaggaagagatgggcagcagctggatcccctgggaatcctgaacacccgagagctccctgttctccatcccaggctacccctgagggaaagagactggggtgcatatgggagggaccccctgcaggatcctggggacagacccgtgactgacagctgtctctgggccaggtcagactgcactgcacatcgctgttgtgaaccagaacatgaacctggtgcgagccctgcttgcccgcagggccagtgtctctgccagagccacaggcactgccttccgccgtagtccctgcaacctcatctactttggggagcaccctttgtcctttgctgcctgtgtgaacagtgaggagatcgtgcggctgctcattgagcatggagctgacatccgggcccaggactccctgggaaacacagtgttacacatcctcatcctccagcccaacaaaacctttgcctgccagatgtacaacctgttgctgtcctacgacagacatggggaccacctgcagcccctggacctcgtgcccaatcaccagggtctcacccctttcaagctggctggagtggagggtaacactgtgatgtttcagcacctgatgcagaagcggaagcacacccagtggacgtatggaccactgacctcgactctctatgacctcacagagatcgactcctcaggggatgagcagtccctgctggaacttatcatcaccaccaagaagcgggaggctcgccagatcctggaccagacgccggtgaaggagctggtgagcctcaagtggaagcggtacgggcggccgtacttctgcatgctgggtgccatatatctgctgtacatcatctgcttcaccatgtgctgcatctaccgccccctcaagcccaggaccaataaccgcacgagcccccgggacaacaccctcttacagcagaagctacttcaggaagcctacatgacccctaaggacgatatccggctggtcggggagctggtgactgtcattggggctatcatcatcctgctggtagaggttccagacatcttcagaatgggggtcactcgcttctttggacagaccatccttgggggcccattccatgtcctcatcatcacctatgccttcatggtgctggtgaccatggtgatgcggctcatcagtgccagcggggaggtggtacccatgtcctttgcactcgtgctgggctggtgcaacgtcatgtacttcgcccgaggattccagatgctaggccccttcaccatcatgattcagaagatgatttttggcgacctgatgcgattctgctggctgatggctgtggtcatcctgggctttgcttcagccttctatatcatcttccagacagaggaccccgaggagctaggccacttctacgactaccccatggccctgttcagcaccttcgagctgttccttaccatcatcgatggcccagccaactacaacgtggacctgcccttcatgtacagcatcacctatgctgcctttgccatcatcgccacactgctcatgctcaacctcctcattgccatgatgggcgacactcactggcgagtggcccatgagcgggatgagctgtggagggcccagattgtggccaccacggtgatgctggagcggaagctgcctcgctgcctgtggcctcgctccgggatctgcggacgggagtatggcctgggagaccgctggttcctgcggcctgcttgggcgctcggtctccaccccagggtcataagtggggagagagcccttcccagggcacccaggcaggtgcagggaagtgcagagcttgtggaaagcgtgtgagtgagggagacaggaacggctctgggggtgggaagtggggctaggtcttgccaactccatcttcaataaagtcgttttcggatccctg

SEQ ID NO: 548007 - DNA, 173 bp, Homo sapiens
ggtccaattcttacaggaaaagaagttgtgaacagagtaaactgacaacctacaggatgggagaaactattcacaaactatgcatccaacaaaggtctagtacccagaatctacaacttaattcaataagcaaaaaacaaccccattaaaaagtggtcagtgtagaaattgaa

SEQ ID NO: 548008 - DNA, 362 bp, Homo sapiens
tctgggagaaacacccaagaatgatcaataaaaaaataaaaaaaaaaaaaaaaaactcgaggccttctccccctactccagtggggtaaagctggatggaatggactgattgacagcctgactcagaggcccagaggaggaagcccttttctttttcctaagggagggttgagaggtccgaagactgaggaacaaggagagaaggcagaagctccctgaggcacactctaagtggacatgctacggccacgctagaggacagctccagatgggtctgcaccatcatctggacatcaagtgctttataatctcatgaagatttacagtttctacaattatcccaaaataaaaagtttactcac

SEQ ID NO: 548009 - DNA, 2132 bp, Homo sapiens
tgatggataatttgggaaagacacaggggatctgagcctcctactctttttttctcttctctgtctcccttccgtgtcagtcctgactgcccatcacttgaacgcctgccccctgaaatgccaggggcctagagaagaggaagagatgggcagcagctggatcccctgggaatcctgaacacccgagagctccctgttctccatcccaggctacccctgagggaaagagactggggtgcatatgggagggaccccctgcaggatcctggggacagacccgtgactgacagctgtctctgggccaggtcagactgcactgcacatcgctgttgtgaaccagaacatgaacctggtgcgagccctgcttgcccgcagggccagtgtctctgccagagccacaggcactgccttccgccgtagtccctgcaacctcatctactttggggagcaccctttgtcctttgctgcctgtgtgaacagtgaggagatcgtgcggctgctcattgagcatggagctgacatccgggcccaggactccctgggaaacacagtgttacacatcctcatcctccagcccaacaaaacctttgcctgccagatgtacaacctgttgctgtcctacgacagacatggggaccacctgcagcccctggacctcgtgcccaatcaccagggtctcacccctttcaagctggctggagtggagggtaacactgtgatgtttcagcacctgatgcagaagcggaagcacacccagtggacgtatggaccactgacctcgactctctatgacctcacagagatcgactcctcaggggatgagcagtccctgctggaacttatcatcaccaccaagaagcgggaggctcgccagatcctggaccagacgccggtgaaggagctggtgagcctcaagtggaagcggtacgggcggccgtacttctgcatgctgggtgccatatatctgctgtacatcatctgcttcaccatgtgctgcatctaccgccccctcaagcccaggaccaataaccgcacgagcccccgggacaacaccctcttacagcagaagctacttcaggaagcctacatgacccctaaggacgatatccggctggtcggggagctggtgactgtcattggggctatcatcatcctgctggtagaggttccagacatcttcagaatgggggtcactcgcttctttggacagaccatccttgggggcccattccatgtcctcatcatcacctatgccttcatggtgctggtgaccatggtgatgcggctcatcagtgccagcggggaggtggtacccatgtcctttgcactcgtgctgggctggtgcaacgtcatgtacttcgcccgaggattccagatgctaggccccttcaccatcatgattcagaagatgatttttggcgacctgatgcgattctgctggctgatggctgtggtcatcctgggctttgcttcagccttctatatcatcttccagacagaggaccccgaggagctaggccacttctacgactaccccatggccctgttcagcaccttcgagctgttccttaccatcatcgatggcccagccaactacaacgtggacctgcccttcatgtacagcatcacctatgctgcctttgccatcatcgccacactgctcatgctcaacctcctcattgccatgatgggcgacactcactggcgagtggcccatgagcgggatgagctgtggagggcccagattgtggccaccacggtgatgctggagcggaagctgcctcgctgcctgtggcctcgctccgggatctgcggacgggagtatggcctgggagaccgctggttcctgcggtgagtgatatgcgggggtaggtgtcccctgagaagcctcatcggcagggtatccccctgctcagacagcttccggctcctgggttccctgtggaggcctgtgtgctccctaggctctatgcttgttgattgagctggtgaggaaggggtcccgtttggagctcagacttcccaaagcatccagggagtctgtggcagagcctgctgctttctgaggcctagctgccaaggggccagtgacccaggcatccaccatggctgcagaaaagggaaaaggccag

SEQ ID NO: 548010 - DNA, 250 bp, Homo sapiens
acgtgcttgagaggctgaggcagaataatctcttggcccggaaggcggaggttgcagtgagctgagatcgtgccactgcactccagcctgagtgacaggagttaagccctgtctcagaaaaaaaaaaaacaaaatcccaaaaagtacttaaagtttcattaacttaggctaggagaaagacttggttctcaaaataatacactttaagattaatttgggtagaattagagttccaccctttattcatttg

SEQ ID NO: 548011 - DNA, 162 bp, Homo sapiens
aatttacctcttgaaattgcatgctctatcatatatcccttaagtggacacatacagtgccatgttgatgtgcctctcagtcttattgaaaggctgccccacagccatgcctcctggtctctgcaatgcctcaagggagtagctctcaaccacagatagctg

SEQ ID NO: 548012 - DNA, 315 bp, Homo sapiens
cctagaggatccccagaggcacaaggaggttagagaaagaccatctggtgggggcaggatagtgtgtctgagctcagactccttgggcagggcttgctgtggcctctgggcgatgggagtggtggttaacaggccaatggagttacgttctaagggagattatggctgcctctgctgcttcatacacatcaccagggaaataggggaaagccggcagtgacagaccacagccagcaaggccagtctcactcctgcagtgcttccccaacagccaacagaaccaaatttatatccatgcctccttggtgcctctgg

SEQ ID NO: 548013 - DNA, 777 bp, Homo sapiens
atggtaacaaaacactgtaactctggtaaatgtttctgtcgtgatggttaacattccacagattctacctttggtgtttgttttttttttttacaatggtttaaagccatttcatgtcccagttgtaagataaggaactgtgataatagcggttcatcatggtcttcaggagagctttccagagtggatcatttcctctcatggtactctgtcagtgtggccacgtaggtttcggtcggttggaagtgctttcttgtggagacggagtctcatctcggttaacccaggctgcaatgcagtgcgcaattcttggtcagttaaacctcacatttccgtggtatcaaggcgaattcccagtgctgtgcctcccgagatagctgggatcacggcgcacacgaccaccacgcccagctagtctgggattcaacgagagacggggttcaccgggcaggcccagtggccaggtaggcttcacacgcagggggcgtgaacaaggcacagcgaggtatgaggtcgacccggggaagtcatcggctaaatagacggggcataaagttccaagcaaggctgcgtcattctcttctggaccttcgtcttcagccggtaacatatcagtgttcgatgccagttgattttacacaatctgttgtcccgtggaatttaccttaaccctataaactgggacaattttcggctgcctccaccgggggacaggggagagccacctccacagggggccccgttcaaactcattataatttgcaaccgcctgaccgc

SEQ ID NO: 548014 - DNA, 846 bp, Homo sapiens
cggtttcctgcttcaacagtgcttgaacggaacccggtgctcgacccctccgacccccgccggccgcttcgagcctgagccctttgcaacttcgtcgttccgccgctccagcgtcgccaccgcgcctcgccccgccgccaccatgaccaccgcgtctccctcgcaagtgcgccagaactaccaccaggacgcggaggctgccatcaaccgccagatcaacctggagttgtatgcctcctacgtctatctgtctatgtcttgttattttgaccgagatgatgtggctctgaagaactttgccaaatactttctccaccaatctcatgaggagagggagcatgccgagaaactgatgaagctgcagaaccagcgaggtggccgaatcttcctgcaggatataaagaaaccagaccgtgatgactgggagagcgggctgaatgcaatggagtgtgcactgcacttggaaaagagtgtgaatcagtcactactggaactgcacaaactggctactgacaagaatgatccccacttatgtgacttcattgagacgtattatctgagtgaacaggtgaaatccattaaagaactgggtgaccacgtgaccaacttacgcaagatgggtgcccctgaagctggcatggcagaatatctctttgacaagcacaccctgggacacggtgatgagagctaagctgacttccccaaagccacgtgactttactggtcactgaggcagtgcatgcatgtcaggctgccttcatcttttctataagttgcaccaaaacatctgcttaagttctttaatttgtaccatttcttcaaataaagaattttggtacccaagaa

SEQ ID NO: 548015 - DNA, 545 bp, Homo sapiens
cagaggaccgccagtaagatgatgagaagtataggcactggtgcatcatatagcatattctctctgctgctaacacaatctgctattgtaagcatgctgtatccccttatgtttattgatagcctaaacctcggtattactactgcgcctccaagaatgggcattgaagaaaggcacctgctcactctgcacatttgctcctgtagtgagaagtctcctgttacacatattctgaagcagaatatgtgtgcctttttacaagagaagagctgagagacaggaactggtcctagaatattatactccagattcttttacacattatttctcttttaaggattagtgtcttgtatctgaaggctttgtttcccataaatgaggtatttacttactcagttaacttattccctggcagagaatattttgaatttacttttgataggcagtgcataaaacttctggtcctttttcacattctcactttccttatagtgatcagcaaggagtctttgttgactctttttgaatttcttggacataggtca

SEQ ID NO: 548016 - DNA, 252 bp, Homo sapiens
  misc_feature (129)..(129): n is a, c, g, or t
  misc_feature (143)..(143): n is a, c, g, or t
ttagagatcctgttgctagctggtatatgtactttaaaatatgttctggcggcagatggtcatgctgtatccagcattgggaggcgaggaggcagatcactgaggtcgggggttcgagaacatgctgancaacatgaagaaancccatctctactaaaaatacaaaaaaattaaccaggcgtggtggcacatgcctgtaatcccagctactcaggatgctgaggcaggataatcgcttgatcccgggaggcg

SEQ ID NO: 548017 - DNA, 363 bp, Homo sapiens
  misc_feature (90)..(90): n is a, c, g, or t
  misc_feature (148)..(148): n is a, c, g, or t
  misc_feature (158)..(158): n is a, c, g, or t
  misc_feature (349)..(350): n is a, c, g, or t
  misc_feature (352)..(352): n is a, c, g, or t
  misc_feature (362)..(362): n is a, c, g, or t
gcttgccttggtgggaccctgaacgaagttggtggcatgggaaggatgtgggtctcctagtgccttgccctggcttagctgcaggagaanatggctgctttcacttccccccattgagctctgctccctctgagccctggtcttttgnccttttttantttggtctcccaagatgaatgctcatctttggagggtgcccaggtagaagctagggaggggagtgtcttctctctcccaggtttcaccttccagtgtgcagaagttagaagggtctggcgggggcagtgccttacacatgcttgattcccacgctaccccctgcctgggaggtgtgtggaataaattatanntncttcaaggcna

SEQ ID NO: 548018 - DNA, 391 bp, Homo sapiens
  misc_feature (226)..(226): n is a, c, g, or t
  misc_feature (281)..(281): n is a, c, g, or t
  misc_feature (294)..(294): n is a, c, g, or t
  misc_feature (307)..(307): n is a, c, g, or t
  misc_feature (322)..(322): n is a, c, g, or t
  misc_feature (383)..(383): n is a, c, g, or t
aacaagaaacgaataaatctctgccataggagttttagccaattcagaggacttgctgcctacaatttggaaaattcctttggatttgaccaaaatcaggaagagacgggagaaaagtgaaacaacaataaagccccaggcataaacaaacaaaaagagttaagcaaaacaagaaatgcacaattcatatgattactgagtgttctaatggtaaggagaaactaanagcagaaattaaaagcagctggtgagtaatcttaaatttttaggtcatttaaggnaaaatttttaagnccaaacctctaanttccggctaccttancctgggaaaccaaggctccaggcttggtgattcggtcctctggccatcctttagaaggctnggaaacca

SEQ ID NO: 548019 - DNA, 390 bp, Homo sapiens
gccccgtgatgcttacagtgtactgtggatacgggggattccctttccccattcagttgactatgtctctctgcattggctgtaaactattcttggtgaggactacttttgccaagtgtactctttccccagtctcattattgtctaatgaatgatccattactgttgcccttttccttgactattacactgtctgtaggatacgcatagaatgcttgtcttgtacttcattcgctaagcctcaatagagagtatacagtcctcaagaattcctctttttgttcatgatctcattgattacccccaggtattgtcttttgacgatccagcagtctaaggtattgagaggtattactggaatttcgagatcttactataattcagaactaa

SEQ ID NO: 548020 - DNA, 145 bp, Homo sapiens
gaatattccgatggggatggagactatgtgatgagctgttgccgtaatgatgagactctgactaaaggcataatacggtggatgggggtgggaaaacacaggatttctgcaattccttctcaaagccattaacaataaacacaga

SEQ ID NO: 548021 - DNA, 6887 bp, Homo sapiens
ttggctactagtctacgctggaatacgattgctccacggttggctactagtccacaggttggctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataaggaaaggttaaaaaaagtaaaaggaactcggcaaatcttaccccgcctgtttaccaaaaacatcacctctagcatcaccagtattagaggcaccgcctgcccagtgacacatgtttaacggccgcggtaccctaaccgtgcaaaggtagcataatcacttgttccttaattagggacctgtatgaatggctccacgagggttcagctgtctcttacttttaaccagtgaaattgacctgcccgtgaagaggcgggcatgacacagcaagacgagaagaaaggcaaagaaggcttcaactctgattgaaaatgagtggagaatcaaacaaagttgagaacagatatgatataggtacagtgagatacttgaaactagaatttgatagttgatagttatagaagctcaattaaatcatcttgaagtggaattagacaaagcatctacattttaatggagaaccagtattacagtgaccaggtaactcggcatggtattatcacttaaaaatttttcctaaataccatgaagtcggtagaagacctttgcatcagaccatgttctttgaagcttaaaaaagtccctgactgactaggaaagacagcacagtgctccaaaaagaaaccctgcagagatgtattaataccaaaaactccatttgaccctggacaggcccaggattcgggattcttcacaatgaggggaatggaccaggtttcttccaagcaaaacattctatcgttttgttgacaatgaattaaattgaaattgtttagaacaatcccaattttggtggggaaggaaaggaggataagttaagcaagataaagaaagctcacagaaacttcatgcagaggtacagcattaaagttctttgtttcctaattaatgttgtatgcagaagtattctgtaaactaaattttcctgacagaaaagttcccacatcctcaacagatgagaatgattgcattatttgggatccttgatcaatacgaaccacatactgtcccttctcaaagactaagttccttatttttcacccaaatcctatatattgaaagacaaccaaggtgctaaatgttaaccactagtcaagttaggaatgtctgaagaaaatatattaaccttgacataaagaagatgtttttggtcaaatttcagacatgtattattataaattaataactggctccatccaccaggttaaagatgaagggagggcctaagatgtctctagagtttatatacacacaagtgagtgtcactgttttgttttgtttttgacctagttttattaaatattgcttccttggggtgtgtttataacaactcccagaacatttcatgtaaggattcaaagcggtcatattaaaatacagcttcaatataaagtttatcacagttttacagtattcaaaaatgacagacctgccttaaaaaacaaaacaaaaaccaaaaaaggactattacacccaaaacataagaaaacaattaaataaacaagtttggcattttcataactttatagtataaaacagaatattaaatttattactggcaaacggacactgatttatttcctttgaaatgtgtcccatttaaacacactatacaagttcattatacaaaagatggatgatcattttgatgaaagaagtgcaccctgaaaatttttgccagtttagaatatttagctcttaaagtttaaaaaaaaagtccttttccttttttaaactgaaggctgaattcagattttttttgttgtctcatctgtcagccttcctggtttaaaaacaatagtgtctatggacgcccaccagggggcagtgtaagattagccattaaatcacgaacagctgcaaatattgtgcattcaccttgtcgtggtggattcatctctgcaaacctcttcagaatgttgctgaccatcatgggagcagcaacagaagagttctgctgtctgggaatgtctgcctgctgggttgtacctgaagccatgtcataaatgattggaactataatactaacaggttcttggggagggaccgatgttttctgagttagttgaagaaaaaatagcattttggatttcagcaccacagcaggcgtcccaggaggtgcaatcggcggcgcgctgggagggatcgtcaggcaaaactgaacattccattttagctgtgttgcttggtcagggaacagctccagcttcataatgtgcacacaatccctgaggatgtgtgtaggagctcctaatagcttggtgaaggctattaacgtattagctttaaatggtggtcctgcaactcttgtttcaaagaatttctccaaaacttgaagttcatcaggtttccactgtcctgcattttcaggtgtcacttttagctgaagcgtttggttggttttgggactaagagctactctgcatttcagtgcatcagtcttaaacatgatcactccgggttcattagaatttatcagctgcagcgtttcttgttgaataattctttgaagatgtcgtctcatgatgactgatccaaggaatctctcaagtggagaacaaaggtaactacctgccaggccgggcacaaggcctggagttggagagggcagcagtaaaatgttcaaggcactgtgagtgaggatggtaggtatggatgccgcccaagagcgctgaggtagtttacgaggtggaggcatgtttgttggcattgtttgagaacttgttccagctcgaggggaatgagaagcatctggaaccggagaatgtagtgaggggttggctggtgacattccaggcatgcgtgctgctggtgaggggccagacacttgaggagatcctggccagttccctgctcgtccacttggtgacaccatagtgtatggggaactagggtcaagagttccatgtggactagcaaaactggcccctggtcctattgagattccatgcgaggatgggggaggagttggaacaaatgacgctggtgatggggctctcaaagccccactgggggagctggcagcatgcagatttcctggagactgtgtgtgcatcattgagggagactgattgactgtgctatgataagatgtagggggtgaagtaagaggataagcacctgatgttcctggctgctttggaaatggctgttgctggggtggtggctggagctgcgatattaaagaatccatcatatctcctcctataggagaagggggattatcgtcctcatttacagaccttcttcgagcatcctgattgctgtcaacaaacatattcaggaacgtctgtaataactgaaccacatttggtgttttgttgaacatttcttgaagctgatggagaatggtattgtgacagttactgcaacctgagtttgggccaacagttcccaaagaaatgtggaatttttgatggatcgaattccattggatactaattgagcttcccttggtggttccataacacaagataagttttcggtaattataaacacgaacttctgagaaaatatttagatgagcaggtatgtctggtagagaacgtgcaaattccaacacacactcatataatcgtgcaatgctattccagtcattaagaaacatttcaaccacctttctaccaccaacaggctcagacaacagattttcatatgtcaggtaaacgtgccgggatggtccttgctccctagtagaagtgccattaagtggacaatttgcaaacactaactctgctacccaagtgcggttatttctaccttgtaatcggaaagtgcaatcaagaagagagcggtccagagccttttgggtttcctcagttatacccttacagggaggaatttttaataagcgaattgcatggctgaagccatcaccttccacttgcactccttgatgtggaatctccagattggacaactccaaccgaagtcctacaaatggcatatttgtatcacacatagcgacgaagtgggctaaaactttattgaaggcacacatttctcctgctcgttttgttttcttggattctactggacatggatcatcagacaacttgcgcttggcattggttctggtctgtttcccggtttttgtacgaaaaaccaagtcctgaatgttttccttgaactgctgcagcagcaatgccattgcagggctgtcttcacgatctgcagcattcacagacataaagtagtacttgtacgacagttgtgtgggtttattgggaacctccaacatctccacaacaatgtagtattgtggaaggcgggtaagtttaatgaacagtttattcttagaaaggtttccaataggatgagttgagtaattggaaagctgcaatgtttcactgcttatcgtaggcagatgttttatagactgcttgcaacgctgttgtccaagccaaaacttaagttgctgaatccagggtatgattcgtttcatatcatcattcacagacttctccatgtcatccagagtggcctggtcaagtccataaagcatcaattgaaacattccagaatgtaaatctacaaaaatgtgcagacactctgaattaccacagggctccaagatgggaacaacaagagctgggagtgcagtctctatggaagagttttcattggcattgaagcctctaagaatggccttcagttcttggagcttctgatgagctcttgcatggacactgtcaatcaggagtttttctattgataagtggtcgatcttcatggctctttctactaatttggaatcagaagctggcaaaggaggatcgtgaaaaatctgtaaaggcttggagacatcattctcatcaattttaattgtaactttgtgaacagatgctgttccagtttttctcccaagaacctgttgattccaaactgaaagggagaggcactttccagcatgatacctttccacctgcacaaggtctccccaccgttctcggattaacattagagtttgggaatgtaacacttctaactgaagtgataaacagaaagaatgtaggcagttgtacatatcctgaagaggtttctcatcagcaaagagcctagactgcaccagttgatggatgaagctgatttgcatgctatgaaccaaagctcgcccatctcctgtttccttatcctcaactagaatttctagcttgagaagacgccatggaacatcagggtcatctcccatcacagtcaaggtggcttcaaattctccttcaacacgaaacttcacccggccatttgcaactgtaagatttgctaactgaggaggaagatctgtggttacaagccgatgtctaagaatctgattcagctgatggagtgtggcttgtttttcaattttggtaattgggtctggaggaataattttatccctaatgcaggttggcagccgtgggtaagatccagtagttagtacatcaatggcatatgggatggcaaaactaggcaggcgtgcatggaccagagcatctctagctaacgaggccaggcgatcagcagtgtccacaaacaggatggcttgctgatctaaaaagcttgaaatcatcgcacatttttccactttgccagcattattagcccatttcactaaagctaataatcgaacgaagagttggcgtgtccggctagcaaactgcactatttctattttcctttccacatcagatttccttggcagtaggtccgtcaacaccataagctccgagtaggcccggtgcagcagaaattcaatgagggtgctcagccggtagcccgggctagccgcagctgcagcggccgccgccacggcggctcccgggggaggaggggctggggctgacgggggtccgccgctgcccccgccgccgcctccgggcgggaccagctggtggttctccagctgcactggggccatggcggcgcaggaccgggcttggcgcaacggcacacgatgcggtcctcgagcctcccgggcgctcggtcaccgcgccgaaacgggagcgggcagagtcgccaccgcctaccgccggcaaccctcggccgattaaaccagcctcgtactagcta

SEQ ID NO: 548022 - DNA, 291 bp, Homo sapiens
ggcggaccgccgagggtcttactcgcagaaaagtcccgatggacgaagttgtagagatcgttatggacgaagttgtgaacaacttcgtccaccccgattgcccagtagtatggagattcggcgtgtgcatgcacacgccgaggaaccagaccaaaccaaattagccaggtgtggtggctggcacctgtgttccaactacttgggagactcatgtgacaggaagatcacttgagcccaggagttagaagctgcagtgagccatgatcttgccactgcactccagtgtggacg

SEQ ID NO: 548023 - DNA, 1719 bp, Homo sapiens
ttggctactagtctacgctggaatacgattgctccacggttggctactagtccacaggttggctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataaggaaaggttaaaaaaagtaaaaggaactcggcaaatcttaccccgcctgtttaccaaaaacatcacctctagcatcaccagtattagaggcaccgcctgcccagtgacacatgtttaacggccgcggtaccctaaccgtgcaaaggtagcataatcacttgttccttaattagggacctgtatgaatggctccacgagggttcagctgtctcttacttttaaccagtgaaattgacctgcccgtgaagaggcgggcatgacacagcaagacgagaagaccctatggagctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccgatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttagtattatacccacacccaccccaagaacagggtttgtttaaaaaaaaaaaaaaaaaaaaaagtgcgagagcatcataagacgaggggagagaaaaggtacgaaagaggcacaggccacacggggtcactgccga

SEQ ID NO: 548024 - DNA, 669 bp, Homo sapiens
  misc_feature (115)..(115): n is a, c, g, or t
  misc_feature (164)..(164): n is a, c, g, or t
gggtgatctagaggatccggcgaggtgatggtaatccctgtatgtcctgactataggatggaaaagtgacatcagaggagtacattacttcgttcagaaccatttcacaagtgcnagaatggctttgatatggactatggtgtgacgtcatcctagttctaaangcaagttgctagaacagtattctcaatcatagaggggtgggcttaggtttatctaggtagcacaaggccaacataccgtaggaggtcgaaataccgagcaacagaatggacgacgagtcttgcaccatagctgtcttttgtacgcacgaaagtgctgtctgcgtggaagtgcagagcgcaaatgcatttaagagttcttcagtcatgtcctcggttgctgggccacatgtcaagaggggcagcaacaccaccagccatctgcaccaggctgttgccaaggcaactcagcagccatttgatgtttctgcatttaatgccagttactcagattctggactcttagggatttatactatctcccaggccacagctgctggagatgtaatcaaggctgcctataatcgagtaaaaacaatagctcacggaaacccttccaacacagatttcccagctgccaagaacaagctgaaagctggatactaatgtcagtggagtctctgagtgt

SEQ ID NO: 548025 - DNA, 141 bp, Homo sapiens
tcgtgtaacacggcagtatagctgtttctgattgtaaacgacggcagtatagctgattcctgattgtcacaggactggcgagtcataactgatttcctgatctgtaccggcgggtgagtcattaactgttacctgattgta

SEQ ID NO: 548026 - DNA, 327 bp, Homo sapiens
ctgatcagtatctgttgtgtagtgataagggtggagaggttaacaggagccacttattagtcactgttgattagtcgaatgactggctcgggtgacttcatatgagattgtttgggcgactgctcgcagtgcgcccgatcagggcgtagttcgagtttgatgctcaccctcatcagaggattgagtaaacagctaggctaagaggttgctagaataaataggcaggcctaggttgaggttgaccagggtgttgggtattgggaggggggttcatagtacaatagcgatggtcagagctaaggtcggggccgtcgctgaaaatgctga

SEQ ID NO: 548027 - DNA, 1924 bp, Homo sapiens
  misc_feature (1652)..(1652): n is a, c, g, or t
  misc_feature (1658)..(1658): n is a, c, g, or t
  misc_feature (1664)..(1664): n is a, c, g, or t
  misc_feature (1669)..(1669): n is a, c, g, or t
  misc_feature (1671)..(1671): n is a, c, g, or t
ttggctactagtctacgctggaatacgattgctccacggttggctactagtccacaggttggctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataaggaaaggttaaaaaaagtaaaaggaactcggcaaatcttaccccgcctgtttaccaaaaacatcacctctagcatcaccagtattagaggcaccgcctgcccagtgacacatgtttaacggccgcggtaccctaaccgtgcaaaggtagcataatcacttgttccttaattagggacctgtatgaatggctccacgagggttcagctgtctcttacttttaaccagtgaaattgacctgcccgtgaagaggcgggcatgacacagcaagacgagaagaccctatggagctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccgatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttagtattatacccacacccaccccaagaacagggtttgttaagatggcagagcccggtaatcgcataanacttanaacttnacagncngaggttcaattcctcttcttaacaacaatacccatggacaaactcctactccctcattgtaaccattctaatcgcaatgggaattctaatgctaaccgaagaaaaattctaggctatataaactacgcaaaggcccaagtagtaagacctaagggctatacaacctttgctgacgcataaaatctaacaaaagcctaaaaccgcaactacatacataaatcacgaccgactagtttacatgaaataatagaac

SEQ ID NO: 548028 - DNA, 97 bp, Homo sapiens
gcaccctagagcaaagcgaccaacttcgctcctgcatgcagactttccactcattctttccattgcctatcttttagataaatggttgcaaaaaaga

SEQ ID NO: 548029 - DNA, 896 bp, Homo sapiens
ggggggtgtctcctccgccggttgtgttcctgcggcccttgttgtgttgtcttgagagaccgctgttgtggttccggaggtccccgcgattgtgccgctggcttgtccaccgggttggcaaccctgtcgggggccatgacgccctaccccttggggtgggaattgcccccctcgcccttccgcgcgcatatggttgcctgccctctgggggggacctccggtggcccgcagtagtctcaacttggcgcacgcatggcgtttggaaaagcgcggggattcggcgccgcctcttgtccggtttgatctggtgggtcgttccccctctcccgccggggggctcccagcgccccaggcgcctggaaaaatgtttcttccggggccccccaaggtggggcggggaaatggtccccgtcctccgcccgatgatgttcttcacgccgggtgttattacctccaccacgccgccctcaaagaggggcgtattcaattactccaccggggcggagttagggctggacgccccaatttttgggaatgtctcaactcttgggcggtgatactcattccccggggctttctggacggccgcagttaacaccggtgcgccgaaaattcttccgtaatatcacatctgaagcggtgtaggacccccagaaaatgtcaggatcatccagctgataacaagtggggtgtataacaacagactacacctctccccacttaggttgtcatactgtaggaccgggtaccaaaaagaccccaccaaagcgcactgacaccaggcggttcaccatccgtgcttcaaaccatggtgaatacgtgccatcttgacggctccgccttctgggacttttgaatacttcctaaaaaaaccccccaatccccgcaacaaaaca

SEQ ID NO: 548030 - DNA, 786 bp, Homo sapiens
  misc_feature (35)..(35): n is a, c, g, or t
  misc_feature (135)..(135): n is a, c, g, or t
  misc_feature (177)..(177): n is a, c, g, or t
  misc_feature (233)..(233): n is a, c, g, or t
  misc_feature (261)..(261): n is a, c, g, or t
  misc_feature (281)..(281): n is a, c, g, or t
  misc_feature (284)..(284): n is a, c, g, or t
  misc_feature (297)..(297): n is a, c, g, or t
  misc_feature (342)..(342): n is a, c, g, or t
  misc_feature (364)..(364): n is a, c, g, or t
  misc_feature (399)..(399): n is a, c, g, or t
  misc_feature (402)..(402): n is a, c, g, or t
  misc_feature (447)..(447): n is a, c, g, or t
  misc_feature (457)..(457): n is a, c, g, or t
  misc_feature (464)..(464): n is a, c, g, or t
  misc_feature (466)..(466): n is a, c, g, or t
  misc_feature (474)..(474): n is a, c, g, or t
  misc_feature (656)..(656): n is a, c, g, or t
  misc_feature (705)..(705): n is a, c, g, or t
  misc_feature (726)..(726): n is a, c, g, or t
  misc_feature (781)..(781): n is a, c, g, or t
gtcgtagatgtggggttatagtaattgctaaagcnggttaaaggcacatgacaacataattcctttatacacatccagtcattttatacaagggactgctatcccttaaatggaagagtgaactacttgtttaanatattaacagtgccctatgtacctacaatgaaaccactttcnccaaagactcaaacagattaacattgcaaaatagtacttctgtatcactgacttcngaaaattttaataatttatgcatatgcnagtgaaatataatttattcnggnttcaacaacagtnatacaaagtcccaattttccccagggaaccattcacttcatagcngcaaaaacaccctgtggcgttncgggggggggcggccaggcgttcggcgggcggggngtntaaccattcccgtcaaatttacatgtccggccgggcacggtggtntgggcctgtngtccctncntcttcggnggctgaggcaggaggatcacttgatcccaggagttcaaagacagcctgggcaacatagaagaaccctgtctcttcggaaatcatccaaggagtgtgataaacatgacaacccccataaactgggtaaacaacaacaatggagtgaaaaacgaccacacatgccataaagcaatgttgaagcnaattcctgctgcaataaaggaggcagtggtaatgggtatcaaggctggntacttgacatcatattctccnattccacaataccattccaggtagactatgcagttaaatgcaattgataaactgncaagc

SEQ ID NO: 548031 - DNA, 1675 bp, Homo sapiens
ttggctactagtctacgctggaatacgattgctccacggttggctactagtccacaggttggctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataaggaaaggttaaaaaaagtaaaaggaactcggcaaatcttaccccgcctgtttaccaaaaacatcacctctagcatcaccagtattagaggcaccgcctgcccagtgacacatgtttaacggccgcggtaccctaaccgtgcaaaggtagcataatcacttgttccttaattagggacctgtatgaatggctccacgagggttcagctgtctcttacttttaaccagtgaaattgacctgcccgtgaagaggcgggcatgacacagcaagacgagaagaccctatggagctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccgatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttagtattatacccacacccaccccaagaacagggtttgttaattgtcagttcagtgttttaatctgccgcaggcttatgcgcaggctcgcac

SEQ ID NO: 548032 - DNA, 497 bp, Homo sapiens
  misc_feature (274)..(274): n is a, c, g, or t
tgcaggctctctaacttggacaggctaggcagtcaccaaccgccggtccttgcgggtacccccaaaacctttcacctccccttcgcccttgcttaaccgacgacggggaacctggcctttatcccagtcctccaaagtccagcctcctcggagtggcaataactttctcagaaggtgaacacggtgcagtttaatgaagaggccacagttatccggtccggtgagtctggggcctaagcaggggggcccagggtgctgccctccccctcaaaanttgagctcagcatcatgctggcctcacaggctctatggattccagtatccgctgtggggatggccgctcacggaggcctgagccattgcagacgctggatgaggccagagatggcgtgtccagggtgaaggtgtcagaccacgagatccgggcggggtgagtggagccaggaccgggtctcaccccaggtgctacggggaatcatagctggccccatgctcag

SEQ ID NO: 548033 - DNA, 1568 bp, Homo sapiens
ttggctactagtctacgctggaatacgattgctccacggttggctactagtccacaggttggctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataaggaaaggttaaaaaaagtaaaaggaactcggcaaatcttaccccgcctgtttaccaaaaacatcacctctagcatcaccagtattagaggcaccgcctgcccagtgacacatgtttaacggccgcggtaccctaaccgtgcaaaggtagcataatcacttgttccttaattagggacctgtatgaatggctccacgagggttcagctgtctcttacttttaaccagtgaaattgacctgcccgtgaagaggcgggcatgacacagcaagacgagaagaccctatggagctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccgatggtgcagccgctattaaaggttcgtttgttcaacgattaaagtcctacgtgatctgagttcagaccggagtaatccaggtcggtttctatctacttcaaattcctccctgtacgaaaggacaagagaagaccctatggagctttaatttattaatgcttccgtaa

SEQ ID NO: 548034 - DNA, 361 bp, Homo sapiens
cttaaccacccaagtagctggggccagagatgtgcaccaacacatttggataattaatactttaatcgctttttgatacagagtctcagtctgtcacccaagctgcagtgcaatggttcaatcatggctcactgcagcctcaaagcttcccaggttcaggtgatcttcccacctacagcctcctgagtagctgggactaccgctgctcacaactcacccagttaccttctgtatttattgtagagatggggtctcaccatgttgcccaggctggtctcagagtcctaggcaacatggtgagaccccatctctacaaaacaatacagcaattagctggaattacaggcacataccaccatgc

SEQ ID NO: 548035 - DNA, 175 bp, Homo sapiens
cgtgtgtatctagaggatcctggtcactttctacgcacacccacctgcaaccatcactagttacatgccaggaaaaaaagcctactgatcagtgtatcttagtcacaaaacctgtctataagaaggacctgcccaccccgagaaactgacaaggcccttatcagtgcattctagt

SEQ ID NO: 548036 - DNA, 180 bp, Homo sapiens
agtcgctaccctttactttcattctaacttgcattacagaagccgcggatccagggtcaagtccaggcatctggaaagtgagtcactgtggagagacccacttcaccactctgattcctctgtcttcccagtcctaaccagactcgggaatcatgtgtgatccactcacggagcttttat

SEQ ID NO: 548037 - DNA, 1827 bp, Homo sapiens
ttggctactagtctacgctggaatacgattgctccacggttggctactagtccacaggttggctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataaggaaaggttaaaaaaagtaaaaggaactcggcaaatcttaccccgcctgtttaccaaaaacatcacctctagcatcaccagtattagaggcaccgcctgcccagtgacacatgtttaacggccgcggtaccctaaccgtgcaaaggtagcataatcacttgttccttaattagggacctgtatgaatggctccacgagggttcagctgtctcttacttttaaccagtgaaattgacctgcccgtgaagaggcgggcatgacacagcaagacgagaagaccctatggagctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccgatggtgcagccgctattaaaggttcgtttgttcaacgattaaagtcctacgtgatctgttttctgcctcgtgttctccacggcggtctcctacctatgccgcctcccgtcccgtccgatgggccatgtcaaatttggtctgctgatgatagcggcgacatctcggcctcgcatcactctgacccgtacctcccgcgcgccgcgagcgcagggaatgggtggggtgcagaacagacgatccgtggccatccagtggaggcgtcgctctgtttacagactaatgttatgtcttttcctatatatccgttcgaatttattagtgttttccttactcccctcgctttaggtagttgcagagacggtggtccgttgcctttatcataatcggagatgaagtttattttcttaacttgtactcacccccacg

SEQ ID NO: 548038 - DNA, 7160 bp, Homo sapiens
ttggctactagtctacgctggaatacgattgctccacggttggctactagtccacaggttggctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtacatgaaacatctctctcgcataagcctgcgtagatgtcagattaaaacactgaactgacaattaacagcccaatatctacaatcaaccaacaagtcattattaccctcactgtcaacccaacacaggcatgctcataaggaaaggttaaaaaaagtaaaaggaactcggcaaatcttaccccgcctgtttaccaaaaacatcacctctagcatcaccagtattagaggcaccgcctgcccagtgacacatgtttaacggccgcggtaccctaaccgtgcaaaggtagcataatcacttgttccttaattagggacctgtatgaatggctccacgagggttcagctgtctcttacttttaaccagtgaaattgacctgcccgtgaagaggcgggcatgacacagcaagacgagaagaaaggcaaagaaggcttcaactctgattgaaaatgagtggagaatcaaacaaagttgagaacagatatgatataggtacagtgagatacttgaaactagaatttgatagttgatagttatagaagctcaattaaatcatcttgaagtggaattagacaaagcatctacattttaatggagaaccagtattacagtgaccaggtaactcggcatggtattatcacttaaaaatttttcctaaataccatgaagtcggtagaagacctttgcatcagaccatgttctttgaagcttaaaaaagtccctgactgactaggaaagacagcacagtgctccaaaaagaaaccctgcagagatgtattaataccaaaaactccatttgaccctggacaggcccaggattcgggattcttcacaatgaggggaatggaccaggtttcttccaagcaaaacattctatcgttttgttgacaatgaattaaattgaaattgtttagaacaatcccaattttggtggggaaggaaaggaggataagttaagcaagataaagaaagctcacagaaacttcatgcagaggtacagcattaaagttctttgtttcctaattaatgttgtatgcagaagtattctgtaaactaaattttcctgacagaaaagttcccacatcctcaacagatgagaatgattgcattatttgggatccttgatcaatacgaaccacatactgtcccttctcaaagactaagttccttatttttcacccaaatcctatatattgaaagacaaccaaggtgctaaatgttaaccactagtcaagttaggaatgtctgaagaaaatatattaaccttgacataaagaagatgtttttggtcaaatttcagacatgtattattataaattaataactggctccatccaccaggttaaagatgaagggagggcctaagatgtctctagagtttatatacacacaagtgagtgtcactgttttgttttgtttttgacctagttttattaaatattgcttccttggggtgtgtttataacaactcccagaacatttcatgtaaggattcaaagcggtcatattaaaatacagcttcaatataaagtttatcacagttttacagtattcaaaaatgacagacctgccttaaaaaacaaaacaaaaaccaaaaaaggactattacacccaaaacataagaaaacaattaaataaacaagtttggcattttcataactttatagtataaaacagaatattaaatttattactggcaaacggacactgatttatttcctttgaaatgtgtcccatttaaacacactatacaagttcattatacaaaagatggatgatcattttgatgaaagaagtgcaccctgaaaatttttgccagtttagaatatttagctcttaaagtttaaaaaaaaagtccttttccttttttaaactgaaggctgaattcagattttttttgttgtctcatctgtcagccttcctggtttaaaaacaatagtgtctatggacgcccaccagggggcagtgtaagattagccattaaatcacgaacagctgcaaatattgtgcattcaccttgtcgtggtggattcatctctgcaaacctcttcagaatgttgctgaccatcatgggagcagcaacagaagagttctgctgtctgggaatgtctgcctgctgggttgtacctgaagccatgtcataaatgattggaactataatactaacaggttcttggggagggaccgatgttttctgagttagttgaagaaaaaatagcattttggatttcagcaccacagcaggcgtcccaggaggtgcaatcggcggcgcgctgggagggatcgtcaggcaaaactgaacattccattttagctgtgttgcttggtcagggaacagctccagcttcataatgtgcacacaatccctgaggatgtgtgtaggagctcctaatagcttggtgaaggctattaacgtattagctttaaatggtggtcctgcaactcttgtttcaaagaatttctccaaaacttgaagttcatcaggtttccactgtcctgcattttcaggtgtcacttttagctgaagcgtttggttggttttgggactaagagctactctgcatttcagtgcatcagtcttaaacatgatcactccgggttcattagaatttatcagctgcagcgtttcttgttgaataattctttgaagatgtcgtctcatgatgactgatccaaggaatctctcaagtggagaacaaaggtaactacctgccaggccgggcacaaggcctggagttggagagggcagcagtaaaatgttcaaggcactgtgagtgaggatggtaggtatggatgccgcccaagagcgctgaggtagtttacgaggtggaggcatgtttgttggcattgtttgagaacttgttccagctcgaggggaatgagaagcatctggaaccggagaatgtagtgaggggttggctggtgacattccaggcatgcgtgctgctggtgaggggccagacacttgaggagatcctggccagttccctgctcgtccacttggtgacaccatagtgtatggggaactagggtcaagagttccatgtggactagcaaaactggcccctggtcctattgagattccatgcgaggatgggggaggagttggaacaaatgacgctggtgatggggctctcaaagccccactgggggagctggcagcatgcagatttcctggagactgtgtgtgcatcattgagggagactgattgactgtgctatgataagatgtagggggtgaagtaagaggataagcacctgatgttcctggctgctttggaaatggctgttgctggggtggtggctggagctgcgatattaaagaatccatcatatctcctcctataggagaagggggattatcgtcctcatttacagaccttcttcgagcatcctgattgctgtcaacaaacatattcaggaacgtctttagtcctggtgcaggatagaaaccttcaactagtttgctgttatcaaaaagactataggcaccatcccgtattgccacaacacctcgactccggcagtatatatcaatgcaatacatgttcctgaaggccagtctgatgtgggtggacgactgtggcagaatggagaagcactggtaggcagtattggttctctgggtcaagcccaacatcggcacagtggggagtttgttgatggcatttaatggagcctgagtatcaaacagtacctgtaataactgaaccacatttggtgttttgttgaacatttcttgaagctgatggagaatggtattgtgacagttactgcaacctgagtttgggccaacagttcccaaagaaatgtggaatttttgatggatcgaattccattggatactaattgagcttcccttggtggttccataacacaagataagttttcggtaattataaacacgaacttctgagaaaatatttagatgagcaggtatgtctggtagagaacgtgcaaattccaacacacactcatataatcgtgcaatgctattccagtcattaagaaacatttcaaccacctttctaccaccaacaggctcagacaacagattttcatatgtcaggtaaacgtgccgggatggtccttgctccctagtagaagtgccattaagtggacaatttgcaaacactaactctgctacccaagtgcggttatttctaccttgtaatcggaaagtgcaatcaagaagagagcggtccagagccttttgggtttcctcagttatacccttacagggaggaatttttaataagcgaattgcatggctgaagccatcaccttccacttgcactccttgatgtggaatctccagattggacaactccaaccgaagtcctacaaatggcatatttgtatcacacatagcgacgaagtgggctaaaactttattgaaggcacacatttctcctgctcgttttgttttcttggattctactggacatggatcatcagacaacttgcgcttggcattggttctggtctgtttcccggtttttgtacgaaaaaccaagtcctgaatgttttccttgaactgctgcagcagcaatgccattgcagggctgtcttcacgatctgcagcattcacagacataaagtagtacttgtacgacagttgtgtgggtttattgggaacctccaacatctccacaacaatgtagtattgtggaaggcgggtaagtttaatgaacagtttattcttagaaaggtttccaataggatgagttgagtaattggaaagctgcaatgtttcactgcttatcgtaggcagatgttttatagactgcttgcaacgctgttgtccaagccaaaacttaagttgctgaatccagggtatgattcgtttcatatcatcattcacagacttctccatgtcatccagagtggcctggtcaagtccataaagcatcaattgaaacattccagaatgtaaatctacaaaaatgtgcagacactctgaattaccacagggctccaagatgggaacaacaagagctgggagtgcagtctctatggaagagttttcattggcattgaagcctctaagaatggccttcagttcttggagcttctgatgagctcttgcatggacactgtcaatcaggagtttttctattgataagtggtcgatcttcatggctctttctactaatttggaatcagaagctggcaaaggaggatcgtgaaaaatctgtaaaggcttggagacatcattctcatcaattttaattgtaactttgtgaacagatgctgttccagtttttctcccaagaacctgttgattccaaactgaaagggagaggcactttccagcatgatacctttccacctgcacaaggtctccccaccgttctcggattaacattagagtttgggaatgtaacacttctaactgaagtgataaacagaaagaatgtaggcagttgtacatatcctgaagaggtttctcatcagcaaagagcctagactgcaccagttgatggatgaagctgatttgcatgctatgaaccaaagctcgcccatctcctgtttccttatcctcaactagaatttctagcttgagaagacgccatggaacatcagggtcatctcccatcacagtcaaggtggcttcaaattctccttcaacacgaaacttcacccggccatttgcaactgtaagatttgctaactgaggaggaagatctgtggttacaagccgatgtctaagaatctgattcagctgatggagtgtggcttgtttttcaattttggtaattgggtctggaggaataattttatccctaatgcaggttggcagccgtgggtaagatccagtagttagtacatcaatggcatatgggatggcaaaactaggcaggcgtgcatggaccagagcatctctagctaacgaggccaggcgatcagcagtgtccacaaacaggatggcttgctgatctaaaaagcttgaaatcatcgcacatttttccactttgccagcattattagcccatttcactaaagctaataatcgaacgaagagttggcgtgtccggctagcaaactgcactatttctattttcctttccacatcagatttccttggcagtaggtccgtcaacaccataagctccgagtaggcccggtgcagcagaaattcaatgagggtgctcagccggtagcccgggctagccgcagctgcagcggccgccgccacggcggctcccgggggaggaggggctggggctgacgggggtccgccgctgcccccgccgccgcctccgggcgggaccagctggtggttctccagctgcactggggccatggcggcgcaggaccgggcttggcgcaacggcacacgatgcggtcctcgagcctcccgggcgctcggtcaccgcgccgaaacgggagcgggcagagtcgccaccgcctaccgccggcaaccctcggccgattaaaccagcctcgtactagcta

SEQ ID NO: 548039 - DNA, 7156 bp, Homo sapiens
  misc_feature (725)..(725): n is a, c, g, or t
ttggctactagtctacgctggaatacgattgctccacggttggctactagtccacaggttggctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaacatttctcctccgnataagcctggtcagattaaaacactgaactgacaattaacagcccaatatctacaatcaaccaacaagtcattattaccctcactgtcaacccaacacaggcatgctcataaggaaaggttaaaaaaagtaaaaggaactcggcaaatcttaccccgcctgtttaccaaaaacatcacctctagcatcaccagtattagaggcaccgcctgcccagtgacacatgtttaacggccgcggtaccctaaccgtgcaaaggtagcataatcacttgttccttaattagggacctgtatgaatggctccacgagggttcagctgtctcttacttttaaccagtgaaattgacctgcccgtgaagaggcgggcatgacacagcaagacgagaagaaaggcaaagaaggcttcaactctgattgaaaatgagtggagaatcaaacaaagttgagaacagatatgatataggtacagtgagatacttgaaactagaatttgatagttgatagttatagaagctcaattaaatcatcttgaagtggaattagacaaagcatctacattttaatggagaaccagtattacagtgaccaggtaactcggcatggtattatcacttaaaaatttttcctaaataccatgaagtcggtagaagacctttgcatcagaccatgttctttgaagcttaaaaaagtccctgactgactaggaaagacagcacagtgctccaaaaagaaaccctgcagagatgtattaataccaaaaactccatttgaccctggacaggcccaggattcgggattcttcacaatgaggggaatggaccaggtttcttccaagcaaaacattctatcgttttgttgacaatgaattaaattgaaattgtttagaacaatcccaattttggtggggaaggaaaggaggataagttaagcaagataaagaaagctcacagaaacttcatgcagaggtacagcattaaagttctttgtttcctaattaatgttgtatgcagaagtattctgtaaactaaattttcctgacagaaaagttcccacatcctcaacagatgagaatgattgcattatttgggatccttgatcaatacgaaccacatactgtcccttctcaaagactaagttccttatttttcacccaaatcctatatattgaaagacaaccaaggtgctaaatgttaaccactagtcaagttaggaatgtctgaagaaaatatattaaccttgacataaagaagatgtttttggtcaaatttcagacatgtattattataaattaataactggctccatccaccaggttaaagatgaagggagggcctaagatgtctctagagtttatatacacacaagtgagtgtcactgttttgttttgtttttgacctagttttattaaatattgcttccttggggtgtgtttataacaactcccagaacatttcatgtaaggattcaaagcggtcatattaaaatacagcttcaatataaagtttatcacagttttacagtattcaaaaatgacagacctgccttaaaaaacaaaacaaaaaccaaaaaaggactattacacccaaaacataagaaaacaattaaataaacaagtttggcattttcataactttatagtataaaacagaatattaaatttattactggcaaacggacactgatttatttcctttgaaatgtgtcccatttaaacacactatacaagttcattatacaaaagatggatgatcattttgatgaaagaagtgcaccctgaaaatttttgccagtttagaatatttagctcttaaagtttaaaaaaaaagtccttttccttttttaaactgaaggctgaattcagattttttttgttgtctcatctgtcagccttcctggtttaaaaacaatagtgtctatggacgcccaccagggggcagtgtaagattagccattaaatcacgaacagctgcaaatattgtgcattcaccttgtcgtggtggattcatctctgcaaacctcttcagaatgttgctgaccatcatgggagcagcaacagaagagttctgctgtctgggaatgtctgcctgctgggttgtacctgaagccatgtcataaatgattggaactataatactaacaggttcttggggagggaccgatgttttctgagttagttgaagaaaaaatagcattttggatttcagcaccacagcaggcgtcccaggaggtgcaatcggcggcgcgctgggagggatcgtcaggcaaaactgaacattccattttagctgtgttgcttggtcagggaacagctccagcttcataatgtgcacacaatccctgaggatgtgtgtaggagctcctaatagcttggtgaaggctattaacgtattagctttaaatggtggtcctgcaactcttgtttcaaagaatttctccaaaacttgaagttcatcaggtttccactgtcctgcattttcaggtgtcacttttagctgaagcgtttggttggttttgggactaagagctactctgcatttcagtgcatcagtcttaaacatgatcactccgggttcattagaatttatcagctgcagcgtttcttgttgaataattctttgaagatgtcgtctcatgatgactgatccaaggaatctctcaagtggagaacaaaggtaactacctgccaggccgggcacaaggcctggagttggagagggcagcagtaaaatgttcaaggcactgtgagtgaggatggtaggtatggatgccgcccaagagcgctgaggtagtttacgaggtggaggcatgtttgttggcattgtttgagaacttgttccagctcgaggggaatgagaagcatctggaaccggagaatgtagtgaggggttggctggtgacattccaggcatgcgtgctgctggtgaggggccagacacttgaggagatcctggccagttccctgctcgtccacttggtgacaccatagtgtatggggaactagggtcaagagttccatgtggactagcaaaactggcccctggtcctattgagattccatgcgaggatgggggaggagttggaacaaatgacgctggtgatggggctctcaaagccccactgggggagctggcagcatgcagatttcctggagactgtgtgtgcatcattgagggagactgattgactgtgctatgataagatgtagggggtgaagtaagaggataagcacctgatgttcctggctgctttggaaatggctgttgctggggtggtggctggagctgcgatattaaagaatccatcatatctcctcctataggagaagggggattatcgtcctcatttacagaccttcttcgagcatcctgattgctgtcaacaaacatattcaggaacgtctttagtcctggtgcaggatagaaaccttcaactagtttgctgttatcaaaaagactataggcaccatcccgtattgccacaacacctcgactccggcagtatatatcaatgcaatacatgttcctgaaggccagtctgatgtgggtggacgactgtggcagaatggagaagcactggtaggcagtattggttctctgggtcaagcccaacatcggcacagtggggagtttgttgatggcatttaatggagcctgagtatcaaacagtacctgtaataactgaaccacatttggtgttttgttgaacatttcttgaagctgatggagaatggtattgtgacagttactgcaacctgagtttgggccaacagttcccaaagaaatgtggaatttttgatggatcgaattccattggatactaattgagcttcccttggtggttccataacacaagataagttttcggtaattataaacacgaacttctgagaaaatatttagatgagcaggtatgtctggtagagaacgtgcaaattccaacacacactcatataatcgtgcaatgctattccagtcattaagaaacatttcaaccacctttctaccaccaacaggctcagacaacagattttcatatgtcaggtaaacgtgccgggatggtccttgctccctagtagaagtgccattaagtggacaatttgcaaacactaactctgctacccaagtgcggttatttctaccttgtaatcggaaagtgcaatcaagaagagagcggtccagagccttttgggtttcctcagttatacccttacagggaggaatttttaataagcgaattgcatggctgaagccatcaccttccacttgcactccttgatgtggaatctccagattggacaactccaaccgaagtcctacaaatggcatatttgtatcacacatagcgacgaagtgggctaaaactttattgaaggcacacatttctcctgctcgttttgttttcttggattctactggacatggatcatcagacaacttgcgcttggcattggttctggtctgtttcccggtttttgtacgaaaaaccaagtcctgaatgttttccttgaactgctgcagcagcaatgccattgcagggctgtcttcacgatctgcagcattcacagacataaagtagtacttgtacgacagttgtgtgggtttattgggaacctccaacatctccacaacaatgtagtattgtggaaggcgggtaagtttaatgaacagtttattcttagaaaggtttccaataggatgagttgagtaattggaaagctgcaatgtttcactgcttatcgtaggcagatgttttatagactgcttgcaacgctgttgtccaagccaaaacttaagttgctgaatccagggtatgattcgtttcatatcatcattcacagacttctccatgtcatccagagtggcctggtcaagtccataaagcatcaattgaaacattccagaatgtaaatctacaaaaatgtgcagacactctgaattaccacagggctccaagatgggaacaacaagagctgggagtgcagtctctatggaagagttttcattggcattgaagcctctaagaatggccttcagttcttggagcttctgatgagctcttgcatggacactgtcaatcaggagtttttctattgataagtggtcgatcttcatggctctttctactaatttggaatcagaagctggcaaaggaggatcgtgaaaaatctgtaaaggcttggagacatcattctcatcaattttaattgtaactttgtgaacagatgctgttccagtttttctcccaagaacctgttgattccaaactgaaagggagaggcactttccagcatgatacctttccacctgcacaaggtctccccaccgttctcggattaacattagagtttgggaatgtaacacttctaactgaagtgataaacagaaagaatgtaggcagttgtacatatcctgaagaggtttctcatcagcaaagagcctagactgcaccagttgatggatgaagctgatttgcatgctatgaaccaaagctcgcccatctcctgtttccttatcctcaactagaatttctagcttgagaagacgccatggaacatcagggtcatctcccatcacagtcaaggtggcttcaaattctccttcaacacgaaacttcacccggccatttgcaactgtaagatttgctaactgaggaggaagatctgtggttacaagccgatgtctaagaatctgattcagctgatggagtgtggcttgtttttcaattttggtaattgggtctggaggaataattttatccctaatgcaggttggcagccgtgggtaagatccagtagttagtacatcaatggcatatgggatggcaaaactaggcaggcgtgcatggaccagagcatctctagctaacgaggccaggcgatcagcagtgtccacaaacaggatggcttgctgatctaaaaagcttgaaatcatcgcacatttttccactttgccagcattattagcccatttcactaaagctaataatcgaacgaagagttggcgtgtccggctagcaaactgcactatttctattttcctttccacatcagatttccttggcagtaggtccgtcaacaccataagctccgagtaggcccggtgcagcagaaattcaatgagggtgctcagccggtagcccgggctagccgcagctgcagcggccgccgccacggcggctcccgggggaggaggggctggggctgacgggggtccgccgctgcccccgccgccgcctccgggcgggaccagctggtggttctccagctgcactggggccatggcggcgcaggaccgggcttggcgcaacggcacacgatgcggtcctcgagcctcccgggcgctcggtcaccgcgccgaaacgggagcgggcagagtcgccaccgcctaccgccggcaaccctcggccgattaaaccagcctcgtactagcta

SEQ ID NO: 548040 - DNA, 1410 bp, Homo sapiens
ttggctactagtctacgctggaatacgattgctccacggttggctactagtccacaggttggctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataaggaaaggttaaaaaaagtaaaaggaactcggcaaatcttaccccgcctgtttaccaaaaacatcacctctagcatcaccagtattagaggcaccgcctgcccagtgacacatgtttaacggccgcggtaccctaaccgtgcaaaggtagcataatcacttgttccttaattagggacctgtatgaatggctccacgagggttcagctgtctcttacttttaaccagtgaaattgacctgcccgtgaagaggcgggcatgacacagcaagacgagaagaccctatggagctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctttttggggccattcacattggggttcggcctgttttgggacaggcaccgtttggccacgttttaggtcg

SEQ ID NO: 548041 - DNA, 1440 bp, Homo sapiens
ttggctactagtctacgctggaatacgattgctccacggttggctactagtccacaggttggctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataaggaaaggttaaaaaaagtaaaaggaactcggcaaatcttaccccgcctgtttaccaaaaacatcacctctagcatcaccagtattagaggcaccgcctgcccagtgacacatgtttaacggccgcggtaccctaaccgtgcaaaggtagcataatcacttgttccttaattagggacctgtatgaatggctccacgagggttcagctgtctcttacttttaaccagtgaaattgacctgcccgtgaagaggcgggcatgacacagcaagacgagaagaccctatggagctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctactcgagagtccatatcgacgatcaggtccaagacctcaatcctgcagcaggacattacaatagtcccagccgctaatataggatcagtagctctacga

SEQ ID NO: 548042 - DNA, 510 bp, Homo sapiens
cctaaccagtttgcatgtaacaaggctgtcggtgtatatctgtggaaatgaattggtcatcagtgatagcactgcaatatgatgtaattgatacaattcacttatctcacaaaataagttgctgtttctcctggggggccagggtggttgtatggatcagatctgactttgtccacgtcttctctctgctcaacaaagtgaaggaatcaagccttgtgtgatcaccacagtctgctgtatccagcacgttctcttgtacacgctgggtgcccagtacatccttgcagatgagtgaatggcctgcctttccgtaatacaggctggcgaaagcttccctgcgctcatgtctcagaagagatgctctctgctcccctgcaagttggaatcgtctcccttgggagtagtcgagaggtgacagaggctgctgtgagtggctagaccaaagtctccctgtgaagccacgtgatgactccaccgctccccagagctgcacatggtcgctcagaaagc

SEQ ID NO: 548043 - DNA, 1612 bp, Homo sapiens
  misc_feature (619)..(619): n is a, c, g, or t
  misc_feature (1364)..(1364): n is a, c, g, or t
tccattctacaacacattttttggtccaacccaaaaacttagccaggaccaaaatttagcagcaatgtgctgtgaaacatttcacgtggcagctttggcctttctatacccttagaggctcaaagtatactttgaaaacattgtgccgtgtgtgtgtgccatagagggaggcttccaccacagaggaagagccccaaccgccctatacttctccttctcattctgtggagcacaagagcgacacctgtgtgttatcacgtgtgccacgaggtgtcttataggtgggtgtggagactctctctccagagaggcgagtgtggacaaatttcatctctttataaacctataaatattactatcacagagcgctctgtgcggtctcacaccgacagtgcgcccaaaatatgtgacagaggcgtggccccagtgaatattcacacgctgtggtgtatctctctctggtggacacacatatctcccctttctcagaagagagagccccccacacacactgttgtgtctcaccacacactttctcagatgtgccgccccaagatgagggggacatctccagaggtgtgtctctctgtgggagagatgtgtctcttatcaccctgtnggaaaatataccatttctctttgtggcctctcccttttctcctataagggataagtgacgaccctcccagagtataaaccccacctgggggggagtcgtttgtgaaaacactcccacagagtctcagaggatcactctctcttgggcgtctcacaagagttgggggcccaaagtgtggccaagacttgagagaatattcccataaatatctccccaaacaaaagctctcatatcggggggaaagattaaaaaggtttcaacgagggagggcatatttcgccaaaagatgtttctccccccgacaaatgtgtggtgcaaacaccgaagagtgttccccccggagggtgtaataacatcgtgacctctttccgaggaacgcacaaagaattttttttgtccccccccttttttatctcgtgtagagagacaaaagaaggggtcctaaaggaaatttctttgggagggcaacggggggtgtctcattacccccgagaatgtgttctttcctccccacacaccaaaagagaagtgactactcacccagagaaaaaaggggcgatccacggagctttatacccccaaagttagccgttctagtttgtgagagcccacttctgtgggggcaccgcggcgtatcatgagtgtgacaccacacacgcccccgagtaggggagttgtggtccctcataagagagaaagagaagaacagccccaacggagcgcgggattcttcccacacaagagngatctgtaggaatatctcccagtttgttgaagaaccacaacgtgccgccggcaattaaaggtggtggtcccggaaaagaagaacaaaggacggaggaccacaacttccactcttctgcgagacagagcccccgcgagagagacccccgatgcaaccactcaagagattagtgggagagaccaccagacaagtaactcgaatattgtaggtgaaccccccaacaagccccaggagaggggaggagtgta

SEQ ID NO: 548044 - DNA, 443 bp, Homo sapiens
atgaggcgcgtctgcgtcatgcaggcctgggcacagtggctcatgcctgttatcccagctaattttcggaggctgatcgtgggagagattactttatctcaggagcttgagaccagcctgggctacatagcataacctcctctctacaaataaaaaaaagtagtcgattgtggtggcatatgcctgtagtcccagctactgggaggcagagataggaggattgcttgaccccaggaggtcgaggctgcagtgagccaagattgctccactgcactccagcctgggttacagagcctgaccctgtcttaaaaagcttaagcaaccacaaaaaaatataaaaaaaaaataaacattttttcgccccccaaaagggggcaaaagctttaagggtttccccttaaaaaaggcccctcccaaaagccccttaagggtaaccgccccat

SEQ ID NO: 548045 - DNA, 901 bp, Homo sapiens
gcctcttttccgggctggaaccatggagggtgtggaatagaagaagaaggaggtcctgctgtgccaaagacccttaagaactacgcgaaggaattgcgcatgagtgaaaattaagcgcctgtagaaatgaagtttgaccaaagaagatgcttcgaattggcaaggatggaggcttttctatgaagtggagctaatgcatgtatctacaaggagatataggtagatgtgacagaactgaaatgcgaatggggaggatgggaatgaaaagctgggaatttctatgtaccctgcagaacccaaattgggttgtcatcagcaatcgatagggtatcacatggatgtgagatgcaagaggttcggaaaggtgttgacagtcatttcgttcgcacttcggtgaaatcttacaagggggcatccttttgttgaagcttaaagaaaggctacgattaagcatgctgaggattgtgcgagaccatatgttgccatggggggtaacccgaatcttgaagtgcagtaagatgaactaatctacaagcgtggttttggcacatcatcgttcagaagggaatggtttgaaggatacgcttgtgattgctcgatcgctgagaaatacgggattatctgatgcgaggtgtgattcgtgagattatactgtggaaacgctccaagaggcgatactgactggggcctcaagttgtctctccacgagtgatggacaacaggcccctaggaacggcgaactggacaagggagccgacacaggttaaaaagatagggaccaggatttcaaaggaggaaaaagacggccaaaaacagagaatgggcgccaaacaacaagggcgcaggaaaataaacaggcatcgacaaccggcagcacgggaacgaccacgacgacagtaaa

SEQ ID NO: 548046 - DNA, 903 bp, Homo sapiens
  misc_feature (8)..(8): n is a, c, g, or t
  misc_feature (107)..(107): n is a, c, g, or t
  misc_feature (112)..(112): n is a, c, g, or t
  misc_feature (116)..(116): n is a, c, g, or t
  misc_feature (120)..(120): n is a, c, g, or t
  misc_feature (164)..(164): n is a, c, g, or t
  misc_feature (173)..(173): n is a, c, g, or t
  misc_feature (176)..(176): n is a, c, g, or t
  misc_feature (181)..(181): n is a, c, g, or t
  misc_feature (211)..(213): n is a, c, g, or t
  misc_feature (215)..(217): n is a, c, g, or t
  misc_feature (229)..(229): n is a, c, g, or t
  misc_feature (231)..(232): n is a, c, g, or t
  misc_feature (236)..(236): n is a, c, g, or t
  misc_feature (238)..(239): n is a, c, g, or t
  misc_feature (241)..(241): n is a, c, g, or t
  misc_feature (243)..(243): n is a, c, g, or t
  misc_feature (253)..(253): n is a, c, g, or t
  misc_feature (256)..(256): n is a, c, g, or t
  misc_feature (258)..(258): n is a, c, g, or t
  misc_feature (270)..(270): n is a, c, g, or t
  misc_feature (275)..(275): n is a, c, g, or t
  misc_feature (286)..(286): n is a, c, g, or t
  misc_feature (292)..(292): n is a, c, g, or t
  misc_feature (302)..(302): n is a, c, g, or t
  misc_feature (307)..(307): n is a, c, g, or t
  misc_feature (310)..(310): n is a, c, g, or t
  misc_feature (313)..(313): n is a, c, g, or t
  misc_feature (315)..(316): n is a, c, g, or t
  misc_feature (320)..(320): n is a, c, g, or t
  misc_feature (324)..(325): n is a, c, g, or t
  misc_feature (330)..(330): n is a, c, g, or t
  misc_feature (336)..(336): n is a, c, g, or t
  misc_feature (339)..(339): n is a, c, g, or t
  misc_feature (341)..(342): n is a, c, g, or t
  misc_feature (345)..(345): n is a, c, g, or t
  misc_feature (354)..(354): n is a, c, g, or t
  misc_feature (360)..(360): n is a, c, g, or t
  misc_feature (366)..(366): n is a, c, g, or t
  misc_feature (368)..(369): n is a, c, g, or t
  misc_feature (387)..(388): n is a, c, g, or t
  misc_feature (391)..(391): n is a, c, g, or t
  misc_feature (394)..(394): n is a, c, g, or t
  misc_feature (402)..(402): n is a, c, g, or t
  misc_feature (404)..(405): n is a, c, g, or t
  misc_feature (411)..(411): n is a, c, g, or t
  misc_feature (432)..(433): n is a, c, g, or t
  misc_feature (484)..(484): n is a, c, g, or t
  misc_feature (521)..(521): n is a, c, g, or t
  misc_feature (528)..(528): n is a, c, g, or t
  misc_feature (707)..(707): n is a, c, g, or t
  misc_feature (725)..(725): n is a, c, g, or t
  misc_feature (810)..(810): n is a, c, g, or t
  misc_feature (876)..(876): n is a, c, g, or t
ttgaaganggagatattcagaacccttcaccagattccccccaacttgattatagtggattaatggtgtgctttgtggatgtggttagtaaatgacaccagcttganggatntttntttntgcaccaaaccccattgagttatctggtccccttggctgacgangaaccattnggnggggngcactggcatcatccagagtgtttttcttnnngnnnttgtccaaccgntnnggtngnngngntgcaacagcnttngngccctctcagtntcgcnaaacatttttngtgttntttttttttntttgntgnttntnntttnttgnnatttncacctnatntnntgnttgttgttnaatgcnatcttnanntttttttacatggtaaannagnttnttgttatntnntatttnatagttaatgttgccaaactnntttttcacacattccactgtggccctgcgcaggggtgtgatgttgttagcnatagtttgtgcattttggcccaggacacacaattggnacttgangctctcccctttctgcaggcaatcccctttgttggccatcccaacgatgccaaatggatagacctcacctttcatatcgccctcctccacaatctcaatcattccttggtactcagtctgtgttggatcaacactcctcagggggcgaattactttgccagagtaaatggtgggatcancttcctcagtaatgccantcactgagtgtgttttgttcactttttctgcactgactttgttgcctttgcctttggacaagctatactcgaccatgtcccccanttccaggctatcaacatcaccagagaactcactgtaatggaaaaagatttctttatcatgattggntgtttcaataaatccaaaatattcttt

SEQ ID NO: 548047 - DNA, 446 bp, Homo sapiens
  misc_feature (5)..(5): n is a, c, g, or t
  misc_feature (57)..(57): n is a, c, g, or t
  misc_feature (66)..(66): n is a, c, g, or t
aaaanggtttcctacacaggttaagcatttactcccctcactacttcccaaaagganttgaagatnaccttaaaataaaatgccagattctaaaaacacaagaatttagacaagaaggaaaaggaaagtgaattagaagcccctaaataggcccaagtgcagtggcctcacgtctgtaatcctcagcactttgggaggataatgcggacgggtgacttgaggtcaggagttctagatcaacctgggtgacatagcaagaccacttccctacaaaaaagaatttttttttttaattagcccagtgtggtggtgagtgcctgtagtcccagtcaggagaatgaggtaggggttgatcccaggaggtggaggctgcagcgagctgtgatggtatcactgcattccaacctgggtgacgatgagatcccccatctctattaaaaaaaaaa

SEQ ID NO: 548048 - DNA, 685 bp, Homo sapiens
agcggatcgcaccgagtggacatcccggtctttgtccgtgggtcagtacggcccctggctccaggtgggcgaacattactatgatcctctgtggaagcaaagaagaccagtgtatggcaggaagaaagaatctgaggaaggatctgccgcggaacaaacgcctgataatgatcatgcactacgatagatatggcagcagagactctgacgaggcaccaggcacttgggatggcatgtcgatccgatcatccaggacgagactgaagaaatgagaacattgaatactttagagccgagaaggtacgttcccctcgtgtgacttcgacactcggatagtgctgagatagtaaacgcgacaacgacacttgatgggacaacctagttcccggtgatgaataagcaccaatgacgtgcgatctgagatagtcagtgaagaggaatagttagctggtaagggagaaatgaaggtcaaatacaaaaggatgacctataggaattggaggaaaacatttcatactattactagtaaaggcatgtgagatacactttagagagtaaatttaaaagaccacccattaaataaagatgttaaacttgatcgtttagagaagaaagtagacattttgatagcgcatcacataaatgcaattacccacaaggtagtaacccatacctggaagataca

SEQ ID NO: 548049 - DNA, 219 bp, Homo sapiens
atccagactcgcagcagaagactaataagtatctcagtctatagaactgatttgaatcaaaatctacatatattttgaggtcaatcattccacgcatccccaactgcgctggttatgaaaatatttgaatcatcagacccaagaactgcaaggactgacccttttctgagacaattcctcatccttgggaatgaggaactgtcagaaaaaatacaattt

SEQ ID NO: 548050 - DNA, 415 bp, Homo sapiens
tatgtggttgtcgtccaggtaaaggcttactaaaagtcgtgaaaacttaggcttggattaaggcaacagcgatttccaagagaatagtccagtaaaattcaacaatgtgtgcaagaatgaataagctgttcaagggaaaggtttaagtggctgaatatggcctagggtggccgccttccaatttggctgccatgaactagggtggacctgccagaaagtgtcagccggtataaggcgtgtacggcacaagggcatattgagggcttagaaagtgaagttagggcctgagtggtttctcgaaataatataaccatagaatagtggggaaataaaggggtttttaagctgcttccatgtgaggcaaaaaaaatggggacacacgcgaatttaaaactcctaaaaacgaaaacctatc

SEQ ID NO: 548051 - DNA, 874 bp, Homo sapiens
ggtaggagcctgggccgaggccgcggtgagatgccgcggctggtactgggagggtggcagggagggacggggaaggaagatggcgacgtcgggggcgaacgggcctggttcggccacggcctcggattccattccgcgcaaatttagtgagaagatggcagctgctatgaagcagcgaatcaggccgatggagactggcggtccttcgaggaggtgatcgatggacatcggctccaccccggttacaggccctaaaaaactgcgactggccatacacaaggcagctctcattcatgcgtagggtactactgcccaaatgttaaccgagattggcctctgagccctggaccgagtttccgaggaggccacccctaccactcaacccttttggcattccatctcgagagccacctcggacacccattgggctaggtggaaacccgggtgcacgccgagatccgtcgaagacctggtgctacccatacttcgccggattaccaccccgaccacaaatttgacacgcctcatcccttataagtccatgccctacattatcttccttccccccaagaagttcttagctgggccgaaagcgcaccggtagggcccttgcggcgccaagttctccacttgccagcacgacaaggggggcaacgattgatatatctgagcttacgcattcgatgacacaacctattacaccaggggcaccaaaggcacttcttgaaacctccgtggcccccttttcaacttcacacacgcctggatgaacttgaacagccccacaaggttacccccatgagtaagtagccgctataaccgcaggggacccaccaaacaacccatcacgcagggacattacacttggactcca

SEQ ID NO: 548052 - DNA, 410 bp, Homo sapiens
ggattatgacggatgtggtctacagcactgcagttactggtctgcttccacaggaggaaatgagggtcccggtgccaccccctcccggggatgtagtagagagtcctcgagccccaaacaagctagatggggctgcgtctgcagtgtgacctgtgccccagtgaacaggctgggggcccaacttctccggaacctcagcctccgccgatgttgcaaactctccttcccctgctgggcctcagcaggaactgagctgggcttttccagctccggccaatcctgtgacctgcagtccccacccagcctggaactcagagcagagaggagtcagaaccacagggaggcaggtgacagggtcgtctgcatgtcccttggcttccgcatccagacaaagggcagatctgtgtaca

SEQ ID NO: 548053 - DNA, 329 bp, Homo sapiens
atttttaaaaaaaaaaaccttttttccccccttttgaaagggggggcccccggtttgggtttaccgggttaaaaaaaccccccggggaaaaggtggggggggccccccccccccccccccaagggggggggccccgggggttaaaagggtaaaaaaaaaaaagggggggggggacccccccccttgaaaacccccaaagattaaccggcccggccccggaaagcccctttttagggggggcttggggccccccccaagggaaaagggggggggtttttttttccccccccaaaaaggggaaaaaaccggggggggggggggttttccca

SEQ ID NO: 548054 - DNA, 142 bp, Homo sapiens
cacgaggagctctcggggctcctcacgctgcgggtctgcgctcgccctcgctctccacgccctccgctccggacccggccccgctcccgccatggagaatactgagctgagttagaaggccaaactggccgatcaagccgag

SEQ ID NO: 548055 - DNA, 570 bp, Homo sapiens
agttaccacgtggaattcactggatacgatccaagctccaagagttggtacattggatacataaggaaatgcaaactacaaagaaaaaagtgaaatattcaatccaaaattcaatcccttggtcactgttatctataatggctaaaattgaaagtacaagagggtgctggataaggacttgaggctggacccagctcaaaatgtgggtgcgagctcaggccaccagcctcaaagtcacccacaaagcagagaattatgcaagggacaacagaaaatatttctaagtcctgtggttaccaagaaggtagtcaatgtgggggaagggcaaaaccaagtaactactgaaaccaaagggtgtagcttgtcaaggaatggttccatcttatagactggtatcatcagtttcctggggaacctttgctaaagtggactatgaaagtgatcaattaaggggcagaatcttagagtttaaatgctacagagtggaagagcatgttcgggttgatgcaggacccacagctcactattgaacaatcgtgggtggggatatataatccagacacacggaga

SEQ ID NO: 548056 - DNA, 637 bp, Homo sapiens
  misc_feature (637)..(637): n is a, c, g, or t
gggcccaaaaatcctttttaataatgcagggggccaacattggtgcaatcagtataaaaacaaagttattcctgattttgtataaaggaacacgtcgggggtcaggattttaaagcatcaagatacaagtcccaaggggggggaccaaagacaactcacagtgaagagaaacgcttgagaacaagaaatgtcagagttgtaggacgtggtaacaacccagggtgctgaaacggtcagaggtgcaggtgcagacccaggcttctgcctttgcaagggcaagggggccgttggtggctggctgcaaaggaccagtgccaggcagcggggcaaagagcaccaggggtctcgactttgcagattgggctttgcagaggatttctgttttccacctccccacccctctgacagagactgaggagaccacacacgttgacctcctcttcatagccaggcatatttccactccaacattctgttggggtgtcattcttgaaaaaaaatccttggtggtccttgctcctttcaaacacagtttgcttgttagacccctttcaaaaatgacaggttggtcaggagggcccttaaaggtaggaccacacccagatctgggcctttggggggttatgaatggtatatn

SEQ ID NO: 548057 - DNA, 140 bp, Homo sapiens
aaagaaaacaagttttatttttatcatcagaacattctaataaaaatattatgatgagattagctactttacttctctgagccttgactctgctctgtgaccaggcctgcctgagctgactgcacgatcagctctgagag

SEQ ID NO: 548058 - DNA, 669 bp, Homo sapiens
  misc_feature (296)..(296): n is a, c, g, or t
  misc_feature (359)..(359): n is a, c, g, or t
agccctgggaataaagtcccaggtttacactcgcacccccaccctatatttggacttccaattggaccccggggcccgacattccccacctatccctaaaagggtggaccagcttcactttacccgatatctcggagatcgtgtatatatgggccgcgatgatgccacccacccaaaaattagaaccttccatccaccaccagccagtgctatggagaagagtgcaccagatgtcccaagtggagaaccaggatccccagaggaagcccacatttgtcttaatatgcttgggggancccatttaagagagacccagtttatccccaccatggtgccctattgctgatgagaccacccantgaagagatttcttccagctattcttgagtttccagaaaccgccacaaaatggggtttgaaaagggcccaaaaccctggagaatccaaagattgggaactaagtggaaagccggaagacgccggtcttgatgtgtcctagaattttgccctttctgagattgagcccttgaaggccttccctttctaaagcttatttagccggtgctttctaaagagattcccccctaacgtgataacctggtcttttgtaaccataaatgtaggatatttcctggcacctgccaataaacctaatccttggttccttta

SEQ ID NO: 548059 - DNA, 349 bp, Homo sapiens
cgcatctgcacatccggcatgccactggacacatgacacatagtagcctccatcgcaatcatataccaaatctctgcctcacgaggcataagcctcctcctcagacactcagtcaaatccctcatagcaggcagatgacgtggactaaactagacgcagctacgcaaaatctaagatatattcctcaatgagctcgacataggatgcatttatagctgtacgaccgatacaaagcctgaacgtaaccagccttattaaacctatatatattatcctgaactagaatcgtctaccatactactcaatttaaactccagcagcacgatcctactagtatctctcacttgag

SEQ ID NO: 548060 - DNA, 369 bp, Homo sapiens
agattctaggagtttatataagaggctagtatgttttcattttgagtcagacattcttttctcattctcaaatctgttttaaatgctccaattttaaaaatgccaaataaaattttatcatgcttattgtagtatgcctattgcagttatctttgaatttaggaaaacagttttgtatgatgaaatattgtgcagaatctgtaaatacggtagcttaaaaataaaaaaaaaagtattaattagtatatgattaatccttaaaatgtagaaactatagattgtgttgagtcagaactgttatgtttgtatccaggtttctattcaccacatataccatcttagaatacacacatatctgggagttataat

SEQ ID NO: 548061 - DNA, 796 bp, Homo sapiens
gccccctagcgagaaaaaatttcctgtgaaacgctacaactccccttgggggttgcgcacacacaatgcgggccgggacggccccccgcacactcaaggggagtaaccaaaccgtgagtgggtgcagaaagaaccccccgtcgggaactctcacagacggagatgttagagccactcaccgccgcgctagggcctcacaacgcggaccgagtgaaccctcgcgcccacgcctccatggttaaggtggcctcgtacacccacacacccatgcctgccgcgtggaggtgcagcgcccgtggctcacactccccgcgaagtggggccccagcgcacagctgagctaagccacctctcggctctgcatcgcaccaggcggctgctccgcgtgaggcagccgcagaaaagaggtctcgcacgtcagacacacgccgcgaggcggagggggagaggagggactggaacgggtacgcgcacacgaggactctcagacccccccctacagggctctcccacggcgcacggcgggggacacacacacaaaggacaacgtctgtgggctgtcacacagaaatacacacacaggacccctctatgtgacccatagagaacaaccgcgcgaatcattcacggggacgaaatgggtgcggcaccaccggcaggtaccaccgcctcccgcgcggggggaatcgccggttcacgtgcgacacacccccgaggaagaacaaaagggggggggcacgacctctccacgatgacggatggattcctcacaaaaagaaaccgacccacatagaca

SEQ ID NO: 548062 - DNA, 251 bp, Homo sapiens
tcaaactggaagggatgtctccgagtcccctgcgagaaagatcttatccttaggtctgcggttactagttacgttacgttacgttacgttacgttacgttacgttacgttacgttacgttacgttacgttacgttactttttgagaacaagtctcgctctgttgccgaggctggagtgctttggtgtgaccctggctcactgcaacctccgcctcccggattcaggcggttctcctgcctccctcccacaa

SEQ ID NO: 548063 - DNA, 236 bp, Homo sapiens
tccttcatcatactaccttctccttttctttctccttcttcctttcctcttctccttcttttcttctccttctcccttcttctttcttcttctccttgtacttctcctcctccttctttcctcttttcttcgttcttcttcctcttccctcttttctttcttttcttctgctttcttcttccttttttttttcttcttccttattcttttcttcttggtaggtatgatgaaggacg

SEQ ID NO: 548064 - DNA, 7100 bp, Homo sapiens
  misc_feature (669)..(669): n is a, c, g, or t
ttggctactagtctacgctggaatacgattgctccacggttggctactagtccacaggttggctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaatatagaagaactaatgttagtataagtaacatgaaacatttctcctccgnataagcctggtcagattaaaacactgaactgacaattaacagcccaatatctacaatcaaccaacaagtcattattaccctcactgtcaacccaacacaggcatgctcataaggaaaggttaaaaaaagtaaaaggaactcggcaaatcttaccccgcctgtttaccaaaaacatcacctctagcatcaccagtattagaggcaccgcctgcccagtgacacatgtttaacggccgcggtaccctaaccgtgcaaaggtagcataatcacttgttccttaattagggacctgtatgaatggctccacgagggttcagctgtctcttacttttaaccagtgaaattgacctgcccgtgaagaggcgggcatgacacagcaagacgagaagaaaggcaaagaaggcttcaactctgattgaaaatgagtggagaatcaaacaaagttgagaacagatatgatataggtacagtgagatacttgaaactagaatttgatagttgatagttatagaagctcaattaaatcatcttgaagtggaattagacaaagcatctacattttaatggagaaccagtattacagtgaccaggtaactcggcatggtattatcacttaaaaatttttcctaaataccatgaagtcggtagaagacctttgcatcagaccatgttctttgaagcttaaaaaagtccctgactgactaggaaagacagcacagtgctccaaaaagaaaccctgcagagatgtattaataccaaaaactccatttgaccctggacaggcccaggattcgggattcttcacaatgaggggaatggaccaggtttcttccaagcaaaacattctatcgttttgttgacaatgaattaaattgaaattgtttagaacaatcccaattttggtggggaaggaaaggaggataagttaagcaagataaagaaagctcacagaaacttcatgcagaggtacagcattaaagttctttgtttcctaattaatgttgtatgcagaagtattctgtaaactaaattttcctgacagaaaagttcccacatcctcaacagatgagaatgattgcattatttgggatccttgatcaatacgaaccacatactgtcccttctcaaagactaagttccttatttttcacccaaatcctatatattgaaagacaaccaaggtgctaaatgttaaccactagtcaagttaggaatgtctgaagaaaatatattaaccttgacataaagaagatgtttttggtcaaatttcagacatgtattattataaattaataactggctccatccaccaggttaaagatgaagggagggcctaagatgtctctagagtttatatacacacaagtgagtgtcactgttttgttttgtttttgacctagttttattaaatattgcttccttggggtgtgtttataacaactcccagaacatttcatgtaaggattcaaagcggtcatattaaaatacagcttcaatataaagtttatcacagttttacagtattcaaaaatgacagacctgccttaaaaaacaaaacaaaaaccaaaaaaggactattacacccaaaacataagaaaacaattaaataaacaagtttggcattttcataactttatagtataaaacagaatattaaatttattactggcaaacggacactgatttatttcctttgaaatgtgtcccatttaaacacactatacaagttcattatacaaaagatggatgatcattttgatgaaagaagtgcaccctgaaaatttttgccagtttagaatatttagctcttaaagtttaaaaaaaaagtccttttccttttttaaactgaaggctgaattcagattttttttgttgtctcatctgtcagccttcctggtttaaaaacaatagtgtctatggacgcccaccagggggcagtgtaagattagccattaaatcacgaacagctgcaaatattgtgcattcaccttgtcgtggtggattcatctctgcaaacctcttcagaatgttgctgaccatcatgggagcagcaacagaagagttctgctgtctgggaatgtctgcctgctgggttgtacctgaagccatgtcataaatgattggaactataatactaacaggttcttggggagggaccgatgttttctgagttagttgaagaaaaaatagcattttggatttcagcaccacagcaggcgtcccaggaggtgcaatcggcggcgcgctgggagggatcgtcaggcaaaactgaacattccattttagctgtgttgcttggtcagggaacagctccagcttcataatgtgcacacaatccctgaggatgtgtgtaggagctcctaatagcttggtgaaggctattaacgtattagctttaaatggtggtcctgcaactcttgtttcaaagaatttctccaaaacttgaagttcatcaggtttccactgtcctgcattttcaggtgtcacttttagctgaagcgtttggttggttttgggactaagagctactctgcatttcagtgcatcagtcttaaacatgatcactccgggttcattagaatttatcagctgcagcgtttcttgttgaataattctttgaagatgtcgtctcatgatgactgatccaaggaatctctcaagtggagaacaaaggtaactacctgccaggccgggcacaaggcctggagttggagagggcagcagtaaaatgttcaaggcactgtgagtgaggatggtaggtatggatgccgcccaagagcgctgaggtagtttacgaggtggaggcatgtttgttggcattgtttgagaacttgttccagctcgaggggaatgagaagcatctggaaccggagaatgtagtgaggggttggctggtgacattccaggcatgcgtgctgctggtgaggggccagacacttgaggagatcctggccagttccctgctcgtccacttggtgacaccatagtgtatggggaactagggtcaagagttccatgtggactagcaaaactggcccctggtcctattgagattccatgcgaggatgggggaggagttggaacaaatgacgctggtgatggggctctcaaagccccactgggggagctggcagcatgcagatttcctggagactgtgtgtgcatcattgagggagactgattgactgtgctatgataagatgtagggggtgaagtaagaggataagcacctgatgttcctggctgctttggaaatggctgttgctggggtggtggctggagctgcgatattaaagaatccatcatatctcctcctataggagaagggggattatcgtcctcatttacagaccttcttcgagcatcctgattgctgtcaacaaacatattcaggaacgtctttagtcctggtgcaggatagaaaccttcaactagtttgctgttatcaaaaagactataggcaccatcccgtattgccacaacacctcgactccggcagtatatatcaatgcaatacatgttcctgaaggccagtctgatgtgggtggacgactgtggcagaatggagaagcactggtaggcagtattggttctctgggtcaagcccaacatcggcacagtggggagtttgttgatggcatttaatggagcctgagtatcaaacagtacctgtaataactgaaccacatttggtgttttgttgaacatttcttgaagctgatggagaatggtattgtgacagttactgcaacctgagtttgggccaacagttcccaaagaaatgtggaatttttgatggatcgaattccattggatactaattgagcttcccttggtggttccataacacaagataagttttcggtaattataaacacgaacttctgagaaaatatttagatgagcaggtatgtctggtagagaacgtgcaaattccaacacacactcatataatcgtgcaatgctattccagtcattaagaaacatttcaaccacctttctaccaccaacaggctcagacaacagattttcatatgtcaggtaaacgtgccgggatggtccttgctccctagtagaagtgccattaagtggacaatttgcaaacactaactctgctacccaagtgcggttatttctaccttgtaatcggaaagtgcaatcaagaagagagcggtccagagccttttgggtttcctcagttatacccttacagggaggaatttttaataagcgaattgcatggctgaagccatcaccttccacttgcactccttgatgtggaatctccagattggacaactccaaccgaagtcctacaaatggcatatttgtatcacacatagcgacgaagtgggctaaaactttattgaaggcacacatttctcctgctcgttttgttttcttggattctactggacatggatcatcagacaacttgcgcttggcattggttctggtctgtttcccggtttttgtacgaaaaaccaagtcctgaatgttttccttgaactgctgcagcagcaatgccattgcagggctgtcttcacgatctgcagcattcacagacataaagtagtacttgtacgacagttgtgtgggtttattgggaacctccaacatctccacaacaatgtagtattgtggaaggcgggtaagtttaatgaacagtttattcttagaaaggtttccaataggatgagttgagtaattggaaagctgcaatgtttcactgcttatcgtaggcagatgttttatagactgcttgcaacgctgttgtccaagccaaaacttaagttgctgaatccagggtatgattcgtttcatatcatcattcacagacttctccatgtcatccagagtggcctggtcaagtccataaagcatcaattgaaacattccagaatgtaaatctacaaaaatgtgcagacactctgaattaccacagggctccaagatgggaacaacaagagctgggagtgcagtctctatggaagagttttcattggcattgaagcctctaagaatggccttcagttcttggagcttctgatgagctcttgcatggacactgtcaatcaggagtttttctattgataagtggtcgatcttcatggctctttctactaatttggaatcagaagctggcaaaggaggatcgtgaaaaatctgtaaaggcttggagacatcattctcatcaattttaattgtaactttgtgaacagatgctgttccagtttttctcccaagaacctgttgattccaaactgaaagggagaggcactttccagcatgatacctttccacctgcacaaggtctccccaccgttctcggattaacattagagtttgggaatgtaacacttctaactgaagtgataaacagaaagaatgtaggcagttgtacatatcctgaagaggtttctcatcagcaaagagcctagactgcaccagttgatggatgaagctgatttgcatgctatgaaccaaagctcgcccatctcctgtttccttatcctcaactagaatttctagcttgagaagacgccatggaacatcagggtcatctcccatcacagtcaaggtggcttcaaattctccttcaacacgaaacttcacccggccatttgcaactgtaagatttgctaactgaggaggaagatctgtggttacaagccgatgtctaagaatctgattcagctgatggagtgtggcttgtttttcaattttggtaattgggtctggaggaataattttatccctaatgcaggttggcagccgtgggtaagatccagtagttagtacatcaatggcatatgggatggcaaaactaggcaggcgtgcatggaccagagcatctctagctaacgaggccaggcgatcagcagtgtccacaaacaggatggcttgctgatctaaaaagcttgaaatcatcgcacatttttccactttgccagcattattagcccatttcactaaagctaataatcgaacgaagagttggcgtgtccggctagcaaactgcactatttctattttcctttccacatcagatttccttggcagtaggtccgtcaacaccataagctccgagtaggcccggtgcagcagaaattcaatgagggtgctcagccggtagcccgggctagccgcagctgcagcggccgccgccacggcggctcccgggggaggaggggctggggctgacgggggtccgccgctgcccccgccgccgcctccgggcgggaccagctggtggttctccagctgcactggggccatggcggcgcaggaccgggcttggcgcaacggcacacgatgcggtcctcgagcctcccgggcgctcggtcaccgcgccgaaacgggagcgggcagagtcgccaccgcctaccgccggcaaccctcggccgattaaaccagcctcgtactagcta

SEQ ID NO: 548065 - DNA, 1352 bp, Homo sapiens
ttggctactagtctacgctggaatacgattgctccacggttggctactagtccacaggttggctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataaggaaaggttaaaaaaagtaaaaggaactcggcaaatcttaccccgcctgtttaccaaaaacatcacctctagcatcaccagtattagaggcaccgcctgcccagtgacacatgtttaacggccgcggtaccctaaccgtgcaaaggtagcataatcacttgttccttaattagggacctgtatgaatggctccacgagggttcagctgtctcttacttttaaccagtgaaattgacctgcccgtgaagaggcgggcatgacacagcaagacgagaagaccctatggagctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactcctcttatactactactattcctctaatctcttaccaccagcggcacgatgatatcatggggtcatcagcagcagcact

SEQ ID NO: 548066 - DNA, 3280 bp, Homo sapiens
ttggctactagtctacgctggaatacgattgctccacggttggctactagtccacaggttggctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataaggaaaggttaaaaaaagtaaaaggaactcggcaaatcttaccccgcctgtttaccaaaaacatcacctctagcatcaccagtattagaggcaccgcctgcccagtgacacatgtttaacggccgcggtaccctaaccgtgcaaaggtagcataatcacttgttccttaattagggacctgtatgaatggctccacgagggttcagctgtctcttacttttaaccagtgaaattgacctgcccgtgaagaggcgggcatgacacagcaagacgagaagaaaggcaaagaaggcttcaactctgattgaaaatgagtggagaatcaaacaaagttgagaacagatatgatataggtacagtgagatacttgaaactagaatttgatagttgatagttatagaagctcaattaaatcatcttgaagtggaattagacaaagcatctacattttaatggagaaccagtattacagtgaccaggtaactcggcatggtattatcacttaaaaatttttcctaaataccatgaagtcggtagaagacctttgcatcagaccatgttctttgaagcttaaaaaagtccctgactgactaggaaagacagcacagtgctccaaaaagaaaccctgcagagatgtattaataccaaaaactccatttgaccctggacaggcccaggattcgggattcttcacaatgaggggaatggaccaggtttcttccaagcaaaacattctatcgttttgttgacaatgaattaaattgaaattgtttagaacaatcccaattttggtggggaaggaaaggaggataagttaagcaagataaagaaagctcacagaaacttcatgcagaggtacagcattaaagttctttgtttcctaattaatgttgtatgcagaagtattctgtaaactaaattttcctgacagaaaagttcccacatcctcaacagatgagaatgattgcattatttgggatccttgatcaatacgaaccacatactgtcccttctcaaagactaagttccttatttttcacccaaatcctatatattgaaagacaaccaaggtgctaaatgttaaccactagtcaagttaggaatgtctgaagaaaatatattaaccttgacataaagaagatgtttttggtcaaatttcagacatgtattattataaattaataactggctccatccaccaggttaaagatgaagggagggcctaagatgtctctagagtttatatacacacaagtgagtgtcactgttttgttttgtttttgacctagttttattaaatattgcttccttggggtgtgtttataacaactcccagaacatttcatgtaaggattcaaagcggtcatattaaaatacagcttcaatataaagtttatcacagttttacagtattcaaaaatgacagacctgccttaaaaaacaaaacaaaaaccaaaaaaggactattacacccaaaaaaaaaaaaaaaaaaaaaaaaaaaaaaaaaaaaaaaaaaaaaaaagagagagagagagagagagagagagaaagaagaagagaagaagagagagggaggaggagagagagaagaggggagggggggggaggaaaaataaaaataatacatatataaatataataaaaacaacacaacaaccatacaaactacactaaaacacacataaaaaatacataacacaatcaataatataaaactgacacaacatcacatacaaacacacactctatcacatatccagacacatcaatactcaagacaaaaatcaataactactccctacacgaaaatatcactcttctcaccatacaatctaatctacttattaccactccacacacgctactaatcaagcacaacaatacactaatcataagaacggagagagcaagcatgcgggcgcaaccaattagcgatacggcggggaaagacggaagaagagtgatccgcgcaggagacagaagccacaagcgagaggagaagacagagagtgaagagagagaagaagaaaaagcgagggaaaggaaaaaagaataaaggcaacgagcagggagcactataggacggagaccaagatcggaagagagcagaagagagacgtcgaaaaataaacggactacagccagcacaagagaagaggagagcgaaagcagaaagcagaggagccaggaggaacaggacaacaaggcgagcaccgacggccggaaacggaccaagacgacgagggagacatcaaagagggcggagcaaggtaacgacacgcgcgacaatagcgagagacaagagagaacggcacagatacacactaacaatcacaatgaagaaaggggcaaaggcaaacaggacaagcgcatagaaagaaacagaagaacaagccgaaaatgaagagcagacaagacgacgcgcgcgatagacaacagaggt

SEQ ID NO: 548067 - DNA, 7157 bp, Homo sapiens
  misc_feature (606)..(606): n is a, c, g, or t
ttggctactagtctacgctggaatacgattgctccacggttggctactagtccacaggttggctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaanacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataaggaaaggttaaaaaaagtaaaaggaactcggcaaatcttaccccgcctgtttaccaaaaacatcacctctagcatcaccagtattagaggcaccgcctgcccagtgacacatgtttaacggccgcggtaccctaaccgtgcaaaggtagcataatcacttgttccttaattagggacctgtatgaatggctccacgagggttcagctgtctcttacttttaaccagtgaaattgacctgcccgtgaagaggcgggcatgacacagcaagacgagaagaaaggcaaagaaggcttcaactctgattgaaaatgagtggagaatcaaacaaagttgagaacagatatgatataggtacagtgagatacttgaaactagaatttgatagttgatagttatagaagctcaattaaatcatcttgaagtggaattagacaaagcatctacattttaatggagaaccagtattacagtgaccaggtaactcggcatggtattatcacttaaaaatttttcctaaataccatgaagtcggtagaagacctttgcatcagaccatgttctttgaagcttaaaaaagtccctgactgactaggaaagacagcacagtgctccaaaaagaaaccctgcagagatgtattaataccaaaaactccatttgaccctggacaggcccaggattcgggattcttcacaatgaggggaatggaccaggtttcttccaagcaaaacattctatcgttttgttgacaatgaattaaattgaaattgtttagaacaatcccaattttggtggggaaggaaaggaggataagttaagcaagataaagaaagctcacagaaacttcatgcagaggtacagcattaaagttctttgtttcctaattaatgttgtatgcagaagtattctgtaaactaaattttcctgacagaaaagttcccacatcctcaacagatgagaatgattgcattatttgggatccttgatcaatacgaaccacatactgtcccttctcaaagactaagttccttatttttcacccaaatcctatatattgaaagacaaccaaggtgctaaatgttaaccactagtcaagttaggaatgtctgaagaaaatatattaaccttgacataaagaagatgtttttggtcaaatttcagacatgtattattataaattaataactggctccatccaccaggttaaagatgaagggagggcctaagatgtctctagagtttatatacacacaagtgagtgtcactgttttgttttgtttttgacctagttttattaaatattgcttccttggggtgtgtttataacaactcccagaacatttcatgtaaggattcaaagcggtcatattaaaatacagcttcaatataaagtttatcacagttttacagtattcaaaaatgacagacctgccttaaaaaacaaaacaaaaaccaaaaaaggactattacacccaaaacataagaaaacaattaaataaacaagtttggcattttcataactttatagtataaaacagaatattaaatttattactggcaaacggacactgatttatttcctttgaaatgtgtcccatttaaacacactatacaagttcattatacaaaagatggatgatcattttgatgaaagaagtgcaccctgaaaatttttgccagtttagaatatttagctcttaaagtttaaaaaaaaagtccttttccttttttaaactgaaggctgaattcagattttttttgttgtctcatctgtcagccttcctggtttaaaaacaatagtgtctatggacgcccaccagggggcagtgtaagattagccattaaatcacgaacagctgcaaatattgtgcattcaccttgtcgtggtggattcatctctgcaaacctcttcagaatgttgctgaccatcatgggagcagcaacagaagagttctgctgtctgggaatgtctgcctgctgggttgtacctgaagccatgtcataaatgattggaactataatactaacaggttcttggggagggaccgatgttttctgagttagttgaagaaaaaatagcattttggatttcagcaccacagcaggcgtcccaggaggtgcaatcggcggcgcgctgggagggatcgtcaggcaaaactgaacattccattttagctgtgttgcttggtcagggaacagctccagcttcataatgtgcacacaatccctgaggatgtgtgtaggagctcctaatagcttggtgaaggctattaacgtattagctttaaatggtggtcctgcaactcttgtttcaaagaatttctccaaaacttgaagttcatcaggtttccactgtcctgcattttcaggtgtcacttttagctgaagcgtttggttggttttgggactaagagctactctgcatttcagtgcatcagtcttaaacatgatcactccgggttcattagaatttatcagctgcagcgtttcttgttgaataattctttgaagatgtcgtctcatgatgactgatccaaggaatctctcaagtggagaacaaaggtaactacctgccaggccgggcacaaggcctggagttggagagggcagcagtaaaatgttcaaggcactgtgagtgaggatggtaggtatggatgccgcccaagagcgctgaggtagtttacgaggtggaggcatgtttgttggcattgtttgagaacttgttccagctcgaggggaatgagaagcatctggaaccggagaatgtagtgaggggttggctggtgacattccaggcatgcgtgctgctggtgaggggccagacacttgaggagatcctggccagttccctgctcgtccacttggtgacaccatagtgtatggggaactagggtcaagagttccatgtggactagcaaaactggcccctggtcctattgagattccatgcgaggatgggggaggagttggaacaaatgacgctggtgatggggctctcaaagccccactgggggagctggcagcatgcagatttcctggagactgtgtgtgcatcattgagggagactgattgactgtgctatgataagatgtagggggtgaagtaagaggataagcacctgatgttcctggctgctttggaaatggctgttgctggggtggtggctggagctgcgatattaaagaatccatcatatctcctcctataggagaagggggattatcgtcctcatttacagaccttcttcgagcatcctgattgctgtcaacaaacatattcaggaacgtctttagtcctggtgcaggatagaaaccttcaactagtttgctgttatcaaaaagactataggcaccatcccgtattgccacaacacctcgactccggcagtatatatcaatgcaatacatgttcctgaaggccagtctgatgtgggtggacgactgtggcagaatggagaagcactggtaggcagtattggttctctgggtcaagcccaacatcggcacagtggggagtttgttgatggcatttaatggagcctgagtatcaaacagtacctgtaataactgaaccacatttggtgttttgttgaacatttcttgaagctgatggagaatggtattgtgacagttactgcaacctgagtttgggccaacagttcccaaagaaatgtggaatttttgatggatcgaattccattggatactaattgagcttcccttggtggttccataacacaagataagttttcggtaattataaacacgaacttctgagaaaatatttagatgagcaggtatgtctggtagagaacgtgcaaattccaacacacactcatataatcgtgcaatgctattccagtcattaagaaacatttcaaccacctttctaccaccaacaggctcagacaacagattttcatatgtcaggtaaacgtgccgggatggtccttgctccctagtagaagtgccattaagtggacaatttgcaaacactaactctgctacccaagtgcggttatttctaccttgtaatcggaaagtgcaatcaagaagagagcggtccagagccttttgggtttcctcagttatacccttacagggaggaatttttaataagcgaattgcatggctgaagccatcaccttccacttgcactccttgatgtggaatctccagattggacaactccaaccgaagtcctacaaatggcatatttgtatcacacatagcgacgaagtgggctaaaactttattgaaggcacacatttctcctgctcgttttgttttcttggattctactggacatggatcatcagacaacttgcgcttggcattggttctggtctgtttcccggtttttgtacgaaaaaccaagtcctgaatgttttccttgaactgctgcagcagcaatgccattgcagggctgtcttcacgatctgcagcattcacagacataaagtagtacttgtacgacagttgtgtgggtttattgggaacctccaacatctccacaacaatgtagtattgtggaaggcgggtaagtttaatgaacagtttattcttagaaaggtttccaataggatgagttgagtaattggaaagctgcaatgtttcactgcttatcgtaggcagatgttttatagactgcttgcaacgctgttgtccaagccaaaacttaagttgctgaatccagggtatgattcgtttcatatcatcattcacagacttctccatgtcatccagagtggcctggtcaagtccataaagcatcaattgaaacattccagaatgtaaatctacaaaaatgtgcagacactctgaattaccacagggctccaagatgggaacaacaagagctgggagtgcagtctctatggaagagttttcattggcattgaagcctctaagaatggccttcagttcttggagcttctgatgagctcttgcatggacactgtcaatcaggagtttttctattgataagtggtcgatcttcatggctctttctactaatttggaatcagaagctggcaaaggaggatcgtgaaaaatctgtaaaggcttggagacatcattctcatcaattttaattgtaactttgtgaacagatgctgttccagtttttctcccaagaacctgttgattccaaactgaaagggagaggcactttccagcatgatacctttccacctgcacaaggtctccccaccgttctcggattaacattagagtttgggaatgtaacacttctaactgaagtgataaacagaaagaatgtaggcagttgtacatatcctgaagaggtttctcatcagcaaagagcctagactgcaccagttgatggatgaagctgatttgcatgctatgaaccaaagctcgcccatctcctgtttccttatcctcaactagaatttctagcttgagaagacgccatggaacatcagggtcatctcccatcacagtcaaggtggcttcaaattctccttcaacacgaaacttcacccggccatttgcaactgtaagatttgctaactgaggaggaagatctgtggttacaagccgatgtctaagaatctgattcagctgatggagtgtggcttgtttttcaattttggtaattgggtctggaggaataattttatccctaatgcaggttggcagccgtgggtaagatccagtagttagtacatcaatggcatatgggatggcaaaactaggcaggcgtgcatggaccagagcatctctagctaacgaggccaggcgatcagcagtgtccacaaacaggatggcttgctgatctaaaaagcttgaaatcatcgcacatttttccactttgccagcattattagcccatttcactaaagctaataatcgaacgaagagttggcgtgtccggctagcaaactgcactatttctattttcctttccacatcagatttccttggcagtaggtccgtcaacaccataagctccgagtaggcccggtgcagcagaaattcaatgagggtgctcagccggtagcccgggctagccgcagctgcagcggccgccgccacggcggctcccgggggaggaggggctggggctgacgggggtccgccgctgcccccgccgccgcctccgggcgggaccagctggtggttctccagctgcactggggccatggcggcgcaggaccgggcttggcgcaacggcacacgatgcggtcctcgagcctcccgggcgctcggtcaccgcgccgaaacgggagcgggcagagtcgccaccgcctaccgccggcaaccctcggccgattaaaccagcctcgtactagcta

SEQ ID NO: 548068 - DNA, 7109 bp, Homo sapiens
ttggctactagtctacgctggaatacgattgctccacggttggctactagtccacaggttggctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaatcccaaacatataactgaactcctcacacccaattggaccaatctatcaccctatagaagaactaatgttagtataagtacatgaaacatctctctcgcataagcctgcgtagatgtcagattaaaacactgaactgacaattaacagcccaatatctacaatcaaccaacaagtcattattaccctcactgtcaacccaacacaggcatgctcataaggaaaggttaaaaaaagtaaaaggaactcggcaaatcttaccccgcctgtttaccaaaaacatcacctctagcatcaccagtattagaggcaccgcctgcccagtgacacatgtttaacggccgcggtaccctaaccgtgcaaaggtagcataatcacttgttccttaattagggacctgtatgaatggctccacgagggttcagctgtctcttacttttaaccagtgaaattgacctgcccgtgaagaggcgggcatgacacagcaagacgagaagaaaggcaaagaaggcttcaactctgattgaaaatgagtggagaatcaaacaaagttgagaacagatatgatataggtacagtgagatacttgaaactagaatttgatagttgatagttatagaagctcaattaaatcatcttgaagtggaattagacaaagcatctacattttaatggagaaccagtattacagtgaccaggtaactcggcatggtattatcacttaaaaatttttcctaaataccatgaagtcggtagaagacctttgcatcagaccatgttctttgaagcttaaaaaagtccctgactgactaggaaagacagcacagtgctccaaaaagaaaccctgcagagatgtattaataccaaaaactccatttgaccctggacaggcccaggattcgggattcttcacaatgaggggaatggaccaggtttcttccaagcaaaacattctatcgttttgttgacaatgaattaaattgaaattgtttagaacaatcccaattttggtggggaaggaaaggaggataagttaagcaagataaagaaagctcacagaaacttcatgcagaggtacagcattaaagttctttgtttcctaattaatgttgtatgcagaagtattctgtaaactaaattttcctgacagaaaagttcccacatcctcaacagatgagaatgattgcattatttgggatccttgatcaatacgaaccacatactgtcccttctcaaagactaagttccttatttttcacccaaatcctatatattgaaagacaaccaaggtgctaaatgttaaccactagtcaagttaggaatgtctgaagaaaatatattaaccttgacataaagaagatgtttttggtcaaatttcagacatgtattattataaattaataactggctccatccaccaggttaaagatgaagggagggcctaagatgtctctagagtttatatacacacaagtgagtgtcactgttttgttttgtttttgacctagttttattaaatattgcttccttggggtgtgtttataacaactcccagaacatttcatgtaaggattcaaagcggtcatattaaaatacagcttcaatataaagtttatcacagttttacagtattcaaaaatgacagacctgccttaaaaaacaaaacaaaaaccaaaaaaggactattacacccaaaacataagaaaacaattaaataaacaagtttggcattttcataactttatagtataaaacagaatattaaatttattactggcaaacggacactgatttatttcctttgaaatgtgtcccatttaaacacactatacaagttcattatacaaaagatggatgatcattttgatgaaagaagtgcaccctgaaaatttttgccagtttagaatatttagctcttaaagtttaaaaaaaaagtccttttccttttttaaactgaaggctgaattcagattttttttgttgtctcatctgtcagccttcctggtttaaaaacaatagtgtctatggacgcccaccagggggcagtgtaagattagccattaaatcacgaacagctgcaaatattgtgcattcaccttgtcgtggtggattcatctctgcaaacctcttcagaatgttgctgaccatcatgggagcagcaacagaagagttctgctgtctgggaatgtctgcctgctgggttgtacctgaagccatgtcataaatgattggaactataatactaacaggttcttggggagggaccgatgttttctgagttagttgaagaaaaaatagcattttggatttcagcaccacagcaggcgtcccaggaggtgcaatcggcggcgcgctgggagggatcgtcaggcaaaactgaacattccattttagctgtgttgcttggtcagggaacagctccagcttcataatgtgcacacaatccctgaggatgtgtgtaggagctcctaatagcttggtgaaggctattaacgtattagctttaaatggtggtcctgcaactcttgtttcaaagaatttctccaaaacttgaagttcatcaggtttccactgtcctgcattttcaggtgtcacttttagctgaagcgtttggttggttttgggactaagagctactctgcatttcagtgcatcagtcttaaacatgatcactccgggttcattagaatttatcagctgcagcgtttcttgttgaataattctttgaagatgtcgtctcatgatgactgatccaaggaatctctcaagtggagaacaaaggtaactacctgccaggccgggcacaaggcctggagttggagagggcagcagtaaaatgttcaaggcactgtgagtgaggatggtaggtatggatgccgcccaagagcgctgaggtagtttacgaggtggaggcatgtttgttggcattgtttgagaacttgttccagctcgaggggaatgagaagcatctggaaccggagaatgtagtgaggggttggctggtgacattccaggcatgcgtgctgctggtgaggggccagacacttgaggagatcctggccagttccctgctcgtccacttggtgacaccatagtgtatggggaactagggtcaagagttccatgtggactagcaaaactggcccctggtcctattgagattccatgcgaggatgggggaggagttggaacaaatgacgctggtgatggggctctcaaagccccactgggggagctggcagcatgcagatttcctggagactgtgtgtgcatcattgagggagactgattgactgtgctatgataagatgtagggggtgaagtaagaggataagcacctgatgttcctggctgctttggaaatggctgttgctggggtggtggctggagctgcgatattaaagaatccatcatatctcctcctataggagaagggggattatcgtcctcatttacagaccttcttcgagcatcctgattgctgtcaacaaacatattcaggaacgtctttagtcctggtgcaggatagaaaccttcaactagtttgctgttatcaaaaagactataggcaccatcccgtattgccacaacacctcgactccggcagtatatatcaatgcaatacatgttcctgaaggccagtctgatgtgggtggacgactgtggcagaatggagaagcactggtaggcagtattggttctctgggtcaagcccaacatcggcacagtggggagtttgttgatggcatttaatggagcctgagtatcaaacagtacctgtaataactgaaccacatttggtgttttgttgaacatttcttgaagctgatggagaatggtattgtgacagttactgcaacctgagtttgggccaacagttcccaaagaaatgtggaatttttgatggatcgaattccattggatactaattgagcttcccttggtggttccataacacaagataagttttcggtaattataaacacgaacttctgagaaaatatttagatgagcaggtatgtctggtagagaacgtgcaaattccaacacacactcatataatcgtgcaatgctattccagtcattaagaaacatttcaaccacctttctaccaccaacaggctcagacaacagattttcatatgtcaggtaaacgtgccgggatggtccttgctccctagtagaagtgccattaagtggacaatttgcaaacactaactctgctacccaagtgcggttatttctaccttgtaatcggaaagtgcaatcaagaagagagcggtccagagccttttgggtttcctcagttatacccttacagggaggaatttttaataagcgaattgcatggctgaagccatcaccttccacttgcactccttgatgtggaatctccagattggacaactccaaccgaagtcctacaaatggcatatttgtatcacacatagcgacgaagtgggctaaaactttattgaaggcacacatttctcctgctcgttttgttttcttggattctactggacatggatcatcagacaacttgcgcttggcattggttctggtctgtttcccggtttttgtacgaaaaaccaagtcctgaatgttttccttgaactgctgcagcagcaatgccattgcagggctgtcttcacgatctgcagcattcacagacataaagtagtacttgtacgacagttgtgtgggtttattgggaacctccaacatctccacaacaatgtagtattgtggaaggcgggtaagtttaatgaacagtttattcttagaaaggtttccaataggatgagttgagtaattggaaagctgcaatgtttcactgcttatcgtaggcagatgttttatagactgcttgcaacgctgttgtccaagccaaaacttaagttgctgaatccagggtatgattcgtttcatatcatcattcacagacttctccatgtcatccagagtggcctggtcaagtccataaagcatcaattgaaacattccagaatgtaaatctacaaaaatgtgcagacactctgaattaccacagggctccaagatgggaacaacaagagctgggagtgcagtctctatggaagagttttcattggcattgaagcctctaagaatggccttcagttcttggagcttctgatgagctcttgcatggacactgtcaatcaggagtttttctattgataagtggtcgatcttcatggctctttctactaatttggaatcagaagctggcaaaggaggatcgtgaaaaatctgtaaaggcttggagacatcattctcatcaattttaattgtaactttgtgaacagatgctgttccagtttttctcccaagaacctgttgattccaaactgaaagggagaggcactttccagcatgatacctttccacctgcacaaggtctccccaccgttctcggattaacattagagtttgggaatgtaacacttctaactgaagtgataaacagaaagaatgtaggcagttgtacatatcctgaagaggtttctcatcagcaaagagcctagactgcaccagttgatggatgaagctgatttgcatgctatgaaccaaagctcgcccatctcctgtttccttatcctcaactagaatttctagcttgagaagacgccatggaacatcagggtcatctcccatcacagtcaaggtggcttcaaattctccttcaacacgaaacttcacccggccatttgcaactgtaagatttgctaactgaggaggaagatctgtggttacaagccgatgtctaagaatctgattcagctgatggagtgtggcttgtttttcaattttggtaattgggtctggaggaataattttatccctaatgcaggttggcagccgtgggtaagatccagtagttagtacatcaatggcatatgggatggcaaaactaggcaggcgtgcatggaccagagcatctctagctaacgaggccaggcgatcagcagtgtccacaaacaggatggcttgctgatctaaaaagcttgaaatcatcgcacatttttccactttgccagcattattagcccatttcactaaagctaataatcgaacgaagagttggcgtgtccggctagcaaactgcactatttctattttcctttccacatcagatttccttggcagtaggtccgtcaacaccataagctccgagtaggcccggtgcagcagaaattcaatgagggtgctcagccggtagcccgggctagccgcagctgcagcggccgccgccacggcggctcccgggggaggaggggctggggctgacgggggtccgccgctgcccccgccgccgcctccgggcgggaccagctggtggttctccagctgcactggggccatggcggcgcaggaccgggcttggcgcaacggcacacgatgcggtcctcgagcctcccgggcgctcggtcaccgcgccgaaacgggagcgggcagagtcgccaccgcctaccgccggcaaccctcggccgattaaaccagcctcgtactagcta

SEQ ID NO: 548069 - DNA, 200 bp, Homo sapiens
aaaaaattccccccggggacctttaacccccgggggggttttccccttttccctttttaaaaaacccccccggggggggggggggggggcggcccccccccccgggggggaaatttggttttcccccggccgggttttgggggatgggggtttttttttttgggggggggttttttttttttaagggcccccccccccca

SEQ ID NO: 548070 - DNA, 405 bp, Homo sapiens
  misc_feature (405)..(405): n is a, c, g, or t
ctcattggaggacatgttactgccggtgaacgggctgatggtactgtacgtggacctgtcctgattcatgggcctcaagcggctcaagcttggccagaacggactgaggcaccttgccgcctggacactggctgagtcactggaggagctggacctgcgagtgaacaggtttagccttgcgccagaccgtgacttgggtggcccggagaccagcctccggcgcctctacgtgctgcgggatccactcaagtcctgcgccaatgactagctggctgaccagctggaccaaggccgtgaagacgtggacgccacccatgacctgaactggcggttcagctgccagtacgaggtgcacctgagtcacgggcgtgccgagcactgacaggaggggatagctggcctgcn

SEQ ID NO: 548071 - DNA, 7106 bp, Homo sapiens
ttggctactagtctacgctggaatacgattgctccacggttggctactagtccacaggttggctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaggaaaatccacacatagtactgtataagtaacatgaaacatctctctcgcataagcctgcgtagatgtcagattaaaacactgaactgacaattaacagcccaatatctacaatcaaccaacaagtcattattaccctcactgtcaacccaacacaggcatgctcataaggaaaggttaaaaaaagtaaaaggaactcggcaaatcttaccccgcctgtttaccaaaaacatcacctctagcatcaccagtattagaggcaccgcctgcccagtgacacatgtttaacggccgcggtaccctaaccgtgcaaaggtagcataatcacttgttccttaattagggacctgtatgaatggctccacgagggttcagctgtctcttacttttaaccagtgaaattgacctgcccgtgaagaggcgggcatgacacagcaagacgagaagaaaggcaaagaaggcttcaactctgattgaaaatgagtggagaatcaaacaaagttgagaacagatatgatataggtacagtgagatacttgaaactagaatttgatagttgatagttatagaagctcaattaaatcatcttgaagtggaattagacaaagcatctacattttaatggagaaccagtattacagtgaccaggtaactcggcatggtattatcacttaaaaatttttcctaaataccatgaagtcggtagaagacctttgcatcagaccatgttctttgaagcttaaaaaagtccctgactgactaggaaagacagcacagtgctccaaaaagaaaccctgcagagatgtattaataccaaaaactccatttgaccctggacaggcccaggattcgggattcttcacaatgaggggaatggaccaggtttcttccaagcaaaacattctatcgttttgttgacaatgaattaaattgaaattgtttagaacaatcccaattttggtggggaaggaaaggaggataagttaagcaagataaagaaagctcacagaaacttcatgcagaggtacagcattaaagttctttgtttcctaattaatgttgtatgcagaagtattctgtaaactaaattttcctgacagaaaagttcccacatcctcaacagatgagaatgattgcattatttgggatccttgatcaatacgaaccacatactgtcccttctcaaagactaagttccttatttttcacccaaatcctatatattgaaagacaaccaaggtgctaaatgttaaccactagtcaagttaggaatgtctgaagaaaatatattaaccttgacataaagaagatgtttttggtcaaatttcagacatgtattattataaattaataactggctccatccaccaggttaaagatgaagggagggcctaagatgtctctagagtttatatacacacaagtgagtgtcactgttttgttttgtttttgacctagttttattaaatattgcttccttggggtgtgtttataacaactcccagaacatttcatgtaaggattcaaagcggtcatattaaaatacagcttcaatataaagtttatcacagttttacagtattcaaaaatgacagacctgccttaaaaaacaaaacaaaaaccaaaaaaggactattacacccaaaacataagaaaacaattaaataaacaagtttggcattttcataactttatagtataaaacagaatattaaatttattactggcaaacggacactgatttatttcctttgaaatgtgtcccatttaaacacactatacaagttcattatacaaaagatggatgatcattttgatgaaagaagtgcaccctgaaaatttttgccagtttagaatatttagctcttaaagtttaaaaaaaaagtccttttccttttttaaactgaaggctgaattcagattttttttgttgtctcatctgtcagccttcctggtttaaaaacaatagtgtctatggacgcccaccagggggcagtgtaagattagccattaaatcacgaacagctgcaaatattgtgcattcaccttgtcgtggtggattcatctctgcaaacctcttcagaatgttgctgaccatcatgggagcagcaacagaagagttctgctgtctgggaatgtctgcctgctgggttgtacctgaagccatgtcataaatgattggaactataatactaacaggttcttggggagggaccgatgttttctgagttagttgaagaaaaaatagcattttggatttcagcaccacagcaggcgtcccaggaggtgcaatcggcggcgcgctgggagggatcgtcaggcaaaactgaacattccattttagctgtgttgcttggtcagggaacagctccagcttcataatgtgcacacaatccctgaggatgtgtgtaggagctcctaatagcttggtgaaggctattaacgtattagctttaaatggtggtcctgcaactcttgtttcaaagaatttctccaaaacttgaagttcatcaggtttccactgtcctgcattttcaggtgtcacttttagctgaagcgtttggttggttttgggactaagagctactctgcatttcagtgcatcagtcttaaacatgatcactccgggttcattagaatttatcagctgcagcgtttcttgttgaataattctttgaagatgtcgtctcatgatgactgatccaaggaatctctcaagtggagaacaaaggtaactacctgccaggccgggcacaaggcctggagttggagagggcagcagtaaaatgttcaaggcactgtgagtgaggatggtaggtatggatgccgcccaagagcgctgaggtagtttacgaggtggaggcatgtttgttggcattgtttgagaacttgttccagctcgaggggaatgagaagcatctggaaccggagaatgtagtgaggggttggctggtgacattccaggcatgcgtgctgctggtgaggggccagacacttgaggagatcctggccagttccctgctcgtccacttggtgacaccatagtgtatggggaactagggtcaagagttccatgtggactagcaaaactggcccctggtcctattgagattccatgcgaggatgggggaggagttggaacaaatgacgctggtgatggggctctcaaagccccactgggggagctggcagcatgcagatttcctggagactgtgtgtgcatcattgagggagactgattgactgtgctatgataagatgtagggggtgaagtaagaggataagcacctgatgttcctggctgctttggaaatggctgttgctggggtggtggctggagctgcgatattaaagaatccatcatatctcctcctataggagaagggggattatcgtcctcatttacagaccttcttcgagcatcctgattgctgtcaacaaacatattcaggaacgtctttagtcctggtgcaggatagaaaccttcaactagtttgctgttatcaaaaagactataggcaccatcccgtattgccacaacacctcgactccggcagtatatatcaatgcaatacatgttcctgaaggccagtctgatgtgggtggacgactgtggcagaatggagaagcactggtaggcagtattggttctctgggtcaagcccaacatcggcacagtggggagtttgttgatggcatttaatggagcctgagtatcaaacagtacctgtaataactgaaccacatttggtgttttgttgaacatttcttgaagctgatggagaatggtattgtgacagttactgcaacctgagtttgggccaacagttcccaaagaaatgtggaatttttgatggatcgaattccattggatactaattgagcttcccttggtggttccataacacaagataagttttcggtaattataaacacgaacttctgagaaaatatttagatgagcaggtatgtctggtagagaacgtgcaaattccaacacacactcatataatcgtgcaatgctattccagtcattaagaaacatttcaaccacctttctaccaccaacaggctcagacaacagattttcatatgtcaggtaaacgtgccgggatggtccttgctccctagtagaagtgccattaagtggacaatttgcaaacactaactctgctacccaagtgcggttatttctaccttgtaatcggaaagtgcaatcaagaagagagcggtccagagccttttgggtttcctcagttatacccttacagggaggaatttttaataagcgaattgcatggctgaagccatcaccttccacttgcactccttgatgtggaatctccagattggacaactccaaccgaagtcctacaaatggcatatttgtatcacacatagcgacgaagtgggctaaaactttattgaaggcacacatttctcctgctcgttttgttttcttggattctactggacatggatcatcagacaacttgcgcttggcattggttctggtctgtttcccggtttttgtacgaaaaaccaagtcctgaatgttttccttgaactgctgcagcagcaatgccattgcagggctgtcttcacgatctgcagcattcacagacataaagtagtacttgtacgacagttgtgtgggtttattgggaacctccaacatctccacaacaatgtagtattgtggaaggcgggtaagtttaatgaacagtttattcttagaaaggtttccaataggatgagttgagtaattggaaagctgcaatgtttcactgcttatcgtaggcagatgttttatagactgcttgcaacgctgttgtccaagccaaaacttaagttgctgaatccagggtatgattcgtttcatatcatcattcacagacttctccatgtcatccagagtggcctggtcaagtccataaagcatcaattgaaacattccagaatgtaaatctacaaaaatgtgcagacactctgaattaccacagggctccaagatgggaacaacaagagctgggagtgcagtctctatggaagagttttcattggcattgaagcctctaagaatggccttcagttcttggagcttctgatgagctcttgcatggacactgtcaatcaggagtttttctattgataagtggtcgatcttcatggctctttctactaatttggaatcagaagctggcaaaggaggatcgtgaaaaatctgtaaaggcttggagacatcattctcatcaattttaattgtaactttgtgaacagatgctgttccagtttttctcccaagaacctgttgattccaaactgaaagggagaggcactttccagcatgatacctttccacctgcacaaggtctccccaccgttctcggattaacattagagtttgggaatgtaacacttctaactgaagtgataaacagaaagaatgtaggcagttgtacatatcctgaagaggtttctcatcagcaaagagcctagactgcaccagttgatggatgaagctgatttgcatgctatgaaccaaagctcgcccatctcctgtttccttatcctcaactagaatttctagcttgagaagacgccatggaacatcagggtcatctcccatcacagtcaaggtggcttcaaattctccttcaacacgaaacttcacccggccatttgcaactgtaagatttgctaactgaggaggaagatctgtggttacaagccgatgtctaagaatctgattcagctgatggagtgtggcttgtttttcaattttggtaattgggtctggaggaataattttatccctaatgcaggttggcagccgtgggtaagatccagtagttagtacatcaatggcatatgggatggcaaaactaggcaggcgtgcatggaccagagcatctctagctaacgaggccaggcgatcagcagtgtccacaaacaggatggcttgctgatctaaaaagcttgaaatcatcgcacatttttccactttgccagcattattagcccatttcactaaagctaataatcgaacgaagagttggcgtgtccggctagcaaactgcactatttctattttcctttccacatcagatttccttggcagtaggtccgtcaacaccataagctccgagtaggcccggtgcagcagaaattcaatgagggtgctcagccggtagcccgggctagccgcagctgcagcggccgccgccacggcggctcccgggggaggaggggctggggctgacgggggtccgccgctgcccccgccgccgcctccgggcgggaccagctggtggttctccagctgcactggggccatggcggcgcaggaccgggcttggcgcaacggcacacgatgcggtcctcgagcctcccgggcgctcggtcaccgcgccgaaacgggagcgggcagagtcgccaccgcctaccgccggcaaccctcggccgattaaaccagcctcgtactagcta

SEQ ID NO: 548072 - DNA, 7156 bp, Homo sapiens
ttggctactagtctacgctggaatacgattgctccacggttggctactagtccacaggttggctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataaggaaaggttaaaaaaagtaaaaggaactcggcaaatcttaccccgcctgtttaccaaaaacatcacctctagcatcaccagtattagaggcaccgcctgcccagtgacacatgtttaacggccgcggtaccctaaccgtgcaaaggtagcataatcacttgttccttaattagggacctgtatgaatggctccacgagggttcagctgtctcttacttttaaccagtgaaattgacctgcccgtgaagaggcgggcatgacacagcaagacgagaagaaaggcaaagaaggcttcaactctgattgaaaatgagtggagaatcaaacaaagttgagaacagatatgatataggtacagtgagatacttgaaactagaatttgatagttgatagttatagaagctcaattaaatcatcttgaagtggaattagacaaagcatctacattttaatggagaaccagtattacagtgaccaggtaactcggcatggtattatcacttaaaaatttttcctaaataccatgaagtcggtagaagacctttgcatcagaccatgttctttgaagcttaaaaaagtccctgactgactaggaaagacagcacagtgctccaaaaagaaaccctgcagagatgtattaataccaaaaactccatttgaccctggacaggcccaggattcgggattcttcacaatgaggggaatggaccaggtttcttccaagcaaaacattctatcgttttgttgacaatgaattaaattgaaattgtttagaacaatcccaattttggtggggaaggaaaggaggataagttaagcaagataaagaaagctcacagaaacttcatgcagaggtacagcattaaagttctttgtttcctaattaatgttgtatgcagaagtattctgtaaactaaattttcctgacagaaaagttcccacatcctcaacagatgagaatgattgcattatttgggatccttgatcaatacgaaccacatactgtcccttctcaaagactaagttccttatttttcacccaaatcctatatattgaaagacaaccaaggtgctaaatgttaaccactagtcaagttaggaatgtctgaagaaaatatattaaccttgacataaagaagatgtttttggtcaaatttcagacatgtattattataaattaataactggctccatccaccaggttaaagatgaagggagggcctaagatgtctctagagtttatatacacacaagtgagtgtcactgttttgttttgtttttgacctagttttattaaatattgcttccttggggtgtgtttataacaactcccagaacatttcatgtaaggattcaaagcggtcatattaaaatacagcttcaatataaagtttatcacagttttacagtattcaaaaatgacagacctgccttaaaaaacaaaacaaaaaccaaaaaaggactattacacccaaaacataagaaaacaattaaataaacaagtttggcattttcataactttatagtataaaacagaatattaaatttattactggcaaacggacactgatttatttcctttgaaatgtgtcccatttaaacacactatacaagttcattatacaaaagatggatgatcattttgatgaaagaagtgcaccctgaaaatttttgccagtttagaatatttagctcttaaagtttaaaaaaaaagtccttttccttttttaaactgaaggctgaattcagattttttttgttgtctcatctgtcagccttcctggtttaaaaacaatagtgtctatggacgcccaccagggggcagtgtaagattagccattaaatcacgaacagctgcaaatattgtgcattcaccttgtcgtggtggattcatctctgcaaacctcttcagaatgttgctgaccatcatgggagcagcaacagaagagttctgctgtctgggaatgtctgcctgctgggttgtacctgaagccatgtcataaatgattggaactataatactaacaggttcttggggagggaccgatgttttctgagttagttgaagaaaaaatagcattttggatttcagcaccacagcaggcgtcccaggaggtgcaatcggcggcgcgctgggagggatcgtcaggcaaaactgaacattccattttagctgtgttgcttggtcagggaacagctccagcttcataatgtgcacacaatccctgaggatgtgtgtaggagctcctaatagcttggtgaaggctattaacgtattagctttaaatggtggtcctgcaactcttgtttcaaagaatttctccaaaacttgaagttcatcaggtttccactgtcctgcattttcaggtgtcacttttagctgaagcgtttggttggttttgggactaagagctactctgcatttcagtgcatcagtcttaaacatgatcactccgggttcattagaatttatcagctgcagcgtttcttgttgaataattctttgaagatgtcgtctcatgatgactgatccaaggaatctctcaagtggagaacaaaggtaactacctgccaggccgggcacaaggcctggagttggagagggcagcagtaaaatgttcaaggcactgtgagtgaggatggtaggtatggatgccgcccaagagcgctgaggtagtttacgaggtggaggcatgtttgttggcattgtttgagaacttgttccagctcgaggggaatgagaagcatctggaaccggagaatgtagtgaggggttggctggtgacattccaggcatgcgtgctgctggtgaggggccagacacttgaggagatcctggccagttccctgctcgtccacttggtgacaccatagtgtatggggaactagggtcaagagttccatgtggactagcaaaactggcccctggtcctattgagattccatgcgaggatgggggaggagttggaacaaatgacgctggtgatggggctctcaaagccccactgggggagctggcagcatgcagatttcctggagactgtgtgtgcatcattgagggagactgattgactgtgctatgataagatgtagggggtgaagtaagaggataagcacctgatgttcctggctgctttggaaatggctgttgctggggtggtggctggagctgcgatattaaagaatccatcatatctcctcctataggagaagggggattatcgtcctcatttacagaccttcttcgagcatcctgattgctgtcaacaaacatattcaggaacgtctttagtcctggtgcaggatagaaaccttcaactagtttgctgttatcaaaaagactataggcaccatcccgtattgccacaacacctcgactccggcagtatatatcaatgcaatacatgttcctgaaggccagtctgatgtgggtggacgactgtggcagaatggagaagcactggtaggcagtattggttctctgggtcaagcccaacatcggcacagtggggagtttgttgatggcatttaatggagcctgagtatcaaacagtacctgtaataactgaaccacatttggtgttttgttgaacatttcttgaagctgatggagaatggtattgtgacagttactgcaacctgagtttgggccaacagttcccaaagaaatgtggaatttttgatggatcgaattccattggatactaattgagcttcccttggtggttccataacacaagataagttttcggtaattataaacacgaacttctgagaaaatatttagatgagcaggtatgtctggtagagaacgtgcaaattccaacacacactcatataatcgtgcaatgctattccagtcattaagaaacatttcaaccacctttctaccaccaacaggctcagacaacagattttcatatgtcaggtaaacgtgccgggatggtccttgctccctagtagaagtgccattaagtggacaatttgcaaacactaactctgctacccaagtgcggttatttctaccttgtaatcggaaagtgcaatcaagaagagagcggtccagagccttttgggtttcctcagttatacccttacagggaggaatttttaataagcgaattgcatggctgaagccatcaccttccacttgcactccttgatgtggaatctccagattggacaactccaaccgaagtcctacaaatggcatatttgtatcacacatagcgacgaagtgggctaaaactttattgaaggcacacatttctcctgctcgttttgttttcttggattctactggacatggatcatcagacaacttgcgcttggcattggttctggtctgtttcccggtttttgtacgaaaaaccaagtcctgaatgttttccttgaactgctgcagcagcaatgccattgcagggctgtcttcacgatctgcagcattcacagacataaagtagtacttgtacgacagttgtgtgggtttattgggaacctccaacatctccacaacaatgtagtattgtggaaggcgggtaagtttaatgaacagtttattcttagaaaggtttccaataggatgagttgagtaattggaaagctgcaatgtttcactgcttatcgtaggcagatgttttatagactgcttgcaacgctgttgtccaagccaaaacttaagttgctgaatccagggtatgattcgtttcatatcatcattcacagacttctccatgtcatccagagtggcctggtcaagtccataaagcatcaattgaaacattccagaatgtaaatctacaaaaatgtgcagacactctgaattaccacagggctccaagatgggaacaacaagagctgggagtgcagtctctatggaagagttttcattggcattgaagcctctaagaatggccttcagttcttggagcttctgatgagctcttgcatggacactgtcaatcaggagtttttctattgataagtggtcgatcttcatggctctttctactaatttggaatcagaagctggcaaaggaggatcgtgaaaaatctgtaaaggcttggagacatcattctcatcaattttaattgtaactttgtgaacagatgctgttccagtttttctcccaagaacctgttgattccaaactgaaagggagaggcactttccagcatgatacctttccacctgcacaaggtctccccaccgttctcggattaacattagagtttgggaatgtaacacttctaactgaagtgataaacagaaagaatgtaggcagttgtacatatcctgaagaggtttctcatcagcaaagagcctagactgcaccagttgatggatgaagctgatttgcatgctatgaaccaaagctcgcccatctcctgtttccttatcctcaactagaatttctagcttgagaagacgccatggaacatcagggtcatctcccatcacagtcaaggtggcttcaaattctccttcaacacgaaacttcacccggccatttgcaactgtaagatttgctaactgaggaggaagatctgtggttacaagccgatgtctaagaatctgattcagctgatggagtgtggcttgtttttcaattttggtaattgggtctggaggaataattttatccctaatgcaggttggcagccgtgggtaagatccagtagttagtacatcaatggcatatgggatggcaaaactaggcaggcgtgcatggaccagagcatctctagctaacgaggccaggcgatcagcagtgtccacaaacaggatggcttgctgatctaaaaagcttgaaatcatcgcacatttttccactttgccagcattattagcccatttcactaaagctaataatcgaacgaagagttggcgtgtccggctagcaaactgcactatttctattttcctttccacatcagatttccttggcagtaggtccgtcaacaccataagctccgagtaggcccggtgcagcagaaattcaatgagggtgctcagccggtagcccgggctagccgcagctgcagcggccgccgccacggcggctcccgggggaggaggggctggggctgacgggggtccgccgctgcccccgccgccgcctccgggcgggaccagctggtggttctccagctgcactggggccatggcggcgcaggaccgggcttggcgcaacggcacacgatgcggtcctcgagcctcccgggcgctcggtcaccgcgccgaaacgggagcgggcagagtcgccaccgcctaccgccggcaaccctcggccgattaaaccagcctcgtactagcta

SEQ ID NO: 548073 - DNA, 119 bp, Homo sapiens
tctagaggactgtatacactacacactgcaaatctgtctggattagctcttcttccttagcattcggtctttcttcatggtcccatgaatgctttcttctcctccatggtctggaagcg

SEQ ID NO: 548074 - DNA, 1761 bp, Homo sapiens
  misc_feature (841)..(841): n is a, c, g, or t
ttggctactagtctacgctggaatacgattgctccacggttggctactagtccacaggttggctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacctttccttatgagcatgcctgtgntgggttgacagtgagggtacaacacaggcatgctcataaggaaaggttaaaaaaagtaaaaggaactcggcaaatcttaccccgcctgtttaccaaaaacatcacctctagcatcaccagtattagaggcaccgcctgcccagtgacacatgtttaacggccgcggtaccctaaccgtgcaaaggtagcataatcacttgttccttaattagggacctgtatgaatggctccacgagggttcagctgtctcttacttttaaccagtgaaattgacctgcccgtgaagaggcgggcatgacacagcaagacgagaagaccctatggagctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccgatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttagtattatacccacacccaccccaagaacagggtttgtttaaaaaaaaaaaaaaaaaaaaaagtgcgagagcatcataagacgaggggagagaaaaggtacgaaagaggcacaggccacacggggtcactgccga

SEQ ID NO: 548075 - DNA, 7106 bp, Homo sapiens
ttggctactagtctacgctggaatacgattgctccacggttggctactagtccacaggttggctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacaggttaaagagcacacccgtctatgtagcagctgttgtgtgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataaggaaaggttaaaaaaagtaaaaggaactcggcaaatcttaccccgcctgtttaccaaaaacatcacctctagcatcaccagtattagaggcaccgcctgcccagtgacacatgtttaacggccgcggtaccctaaccgtgcaaaggtagcataatcacttgttccttaattagggacctgtatgaatggctccacgagggttcagctgtctcttacttttaaccagtgaaattgacctgcccgtgaagaggcgggcatgacacagcaagacgagaagaaaggcaaagaaggcttcaactctgattgaaaatgagtggagaatcaaacaaagttgagaacagatatgatataggtacagtgagatacttgaaactagaatttgatagttgatagttatagaagctcaattaaatcatcttgaagtggaattagacaaagcatctacattttaatggagaaccagtattacagtgaccaggtaactcggcatggtattatcacttaaaaatttttcctaaataccatgaagtcggtagaagacctttgcatcagaccatgttctttgaagcttaaaaaagtccctgactgactaggaaagacagcacagtgctccaaaaagaaaccctgcagagatgtattaataccaaaaactccatttgaccctggacaggcccaggattcgggattcttcacaatgaggggaatggaccaggtttcttccaagcaaaacattctatcgttttgttgacaatgaattaaattgaaattgtttagaacaatcccaattttggtggggaaggaaaggaggataagttaagcaagataaagaaagctcacagaaacttcatgcagaggtacagcattaaagttctttgtttcctaattaatgttgtatgcagaagtattctgtaaactaaattttcctgacagaaaagttcccacatcctcaacagatgagaatgattgcattatttgggatccttgatcaatacgaaccacatactgtcccttctcaaagactaagttccttatttttcacccaaatcctatatattgaaagacaaccaaggtgctaaatgttaaccactagtcaagttaggaatgtctgaagaaaatatattaaccttgacataaagaagatgtttttggtcaaatttcagacatgtattattataaattaataactggctccatccaccaggttaaagatgaagggagggcctaagatgtctctagagtttatatacacacaagtgagtgtcactgttttgttttgtttttgacctagttttattaaatattgcttccttggggtgtgtttataacaactcccagaacatttcatgtaaggattcaaagcggtcatattaaaatacagcttcaatataaagtttatcacagttttacagtattcaaaaatgacagacctgccttaaaaaacaaaacaaaaaccaaaaaaggactattacacccaaaacataagaaaacaattaaataaacaagtttggcattttcataactttatagtataaaacagaatattaaatttattactggcaaacggacactgatttatttcctttgaaatgtgtcccatttaaacacactatacaagttcattatacaaaagatggatgatcattttgatgaaagaagtgcaccctgaaaatttttgccagtttagaatatttagctcttaaagtttaaaaaaaaagtccttttccttttttaaactgaaggctgaattcagattttttttgttgtctcatctgtcagccttcctggtttaaaaacaatagtgtctatggacgcccaccagggggcagtgtaagattagccattaaatcacgaacagctgcaaatattgtgcattcaccttgtcgtggtggattcatctctgcaaacctcttcagaatgttgctgaccatcatgggagcagcaacagaagagttctgctgtctgggaatgtctgcctgctgggttgtacctgaagccatgtcataaatgattggaactataatactaacaggttcttggggagggaccgatgttttctgagttagttgaagaaaaaatagcattttggatttcagcaccacagcaggcgtcccaggaggtgcaatcggcggcgcgctgggagggatcgtcaggcaaaactgaacattccattttagctgtgttgcttggtcagggaacagctccagcttcataatgtgcacacaatccctgaggatgtgtgtaggagctcctaatagcttggtgaaggctattaacgtattagctttaaatggtggtcctgcaactcttgtttcaaagaatttctccaaaacttgaagttcatcaggtttccactgtcctgcattttcaggtgtcacttttagctgaagcgtttggttggttttgggactaagagctactctgcatttcagtgcatcagtcttaaacatgatcactccgggttcattagaatttatcagctgcagcgtttcttgttgaataattctttgaagatgtcgtctcatgatgactgatccaaggaatctctcaagtggagaacaaaggtaactacctgccaggccgggcacaaggcctggagttggagagggcagcagtaaaatgttcaaggcactgtgagtgaggatggtaggtatggatgccgcccaagagcgctgaggtagtttacgaggtggaggcatgtttgttggcattgtttgagaacttgttccagctcgaggggaatgagaagcatctggaaccggagaatgtagtgaggggttggctggtgacattccaggcatgcgtgctgctggtgaggggccagacacttgaggagatcctggccagttccctgctcgtccacttggtgacaccatagtgtatggggaactagggtcaagagttccatgtggactagcaaaactggcccctggtcctattgagattccatgcgaggatgggggaggagttggaacaaatgacgctggtgatggggctctcaaagccccactgggggagctggcagcatgcagatttcctggagactgtgtgtgcatcattgagggagactgattgactgtgctatgataagatgtagggggtgaagtaagaggataagcacctgatgttcctggctgctttggaaatggctgttgctggggtggtggctggagctgcgatattaaagaatccatcatatctcctcctataggagaagggggattatcgtcctcatttacagaccttcttcgagcatcctgattgctgtcaacaaacatattcaggaacgtctttagtcctggtgcaggatagaaaccttcaactagtttgctgttatcaaaaagactataggcaccatcccgtattgccacaacacctcgactccggcagtatatatcaatgcaatacatgttcctgaaggccagtctgatgtgggtggacgactgtggcagaatggagaagcactggtaggcagtattggttctctgggtcaagcccaacatcggcacagtggggagtttgttgatggcatttaatggagcctgagtatcaaacagtacctgtaataactgaaccacatttggtgttttgttgaacatttcttgaagctgatggagaatggtattgtgacagttactgcaacctgagtttgggccaacagttcccaaagaaatgtggaatttttgatggatcgaattccattggatactaattgagcttcccttggtggttccataacacaagataagttttcggtaattataaacacgaacttctgagaaaatatttagatgagcaggtatgtctggtagagaacgtgcaaattccaacacacactcatataatcgtgcaatgctattccagtcattaagaaacatttcaaccacctttctaccaccaacaggctcagacaacagattttcatatgtcaggtaaacgtgccgggatggtccttgctccctagtagaagtgccattaagtggacaatttgcaaacactaactctgctacccaagtgcggttatttctaccttgtaatcggaaagtgcaatcaagaagagagcggtccagagccttttgggtttcctcagttatacccttacagggaggaatttttaataagcgaattgcatggctgaagccatcaccttccacttgcactccttgatgtggaatctccagattggacaactccaaccgaagtcctacaaatggcatatttgtatcacacatagcgacgaagtgggctaaaactttattgaaggcacacatttctcctgctcgttttgttttcttggattctactggacatggatcatcagacaacttgcgcttggcattggttctggtctgtttcccggtttttgtacgaaaaaccaagtcctgaatgttttccttgaactgctgcagcagcaatgccattgcagggctgtcttcacgatctgcagcattcacagacataaagtagtacttgtacgacagttgtgtgggtttattgggaacctccaacatctccacaacaatgtagtattgtggaaggcgggtaagtttaatgaacagtttattcttagaaaggtttccaataggatgagttgagtaattggaaagctgcaatgtttcactgcttatcgtaggcagatgttttatagactgcttgcaacgctgttgtccaagccaaaacttaagttgctgaatccagggtatgattcgtttcatatcatcattcacagacttctccatgtcatccagagtggcctggtcaagtccataaagcatcaattgaaacattccagaatgtaaatctacaaaaatgtgcagacactctgaattaccacagggctccaagatgggaacaacaagagctgggagtgcagtctctatggaagagttttcattggcattgaagcctctaagaatggccttcagttcttggagcttctgatgagctcttgcatggacactgtcaatcaggagtttttctattgataagtggtcgatcttcatggctctttctactaatttggaatcagaagctggcaaaggaggatcgtgaaaaatctgtaaaggcttggagacatcattctcatcaattttaattgtaactttgtgaacagatgctgttccagtttttctcccaagaacctgttgattccaaactgaaagggagaggcactttccagcatgatacctttccacctgcacaaggtctccccaccgttctcggattaacattagagtttgggaatgtaacacttctaactgaagtgataaacagaaagaatgtaggcagttgtacatatcctgaagaggtttctcatcagcaaagagcctagactgcaccagttgatggatgaagctgatttgcatgctatgaaccaaagctcgcccatctcctgtttccttatcctcaactagaatttctagcttgagaagacgccatggaacatcagggtcatctcccatcacagtcaaggtggcttcaaattctccttcaacacgaaacttcacccggccatttgcaactgtaagatttgctaactgaggaggaagatctgtggttacaagccgatgtctaagaatctgattcagctgatggagtgtggcttgtttttcaattttggtaattgggtctggaggaataattttatccctaatgcaggttggcagccgtgggtaagatccagtagttagtacatcaatggcatatgggatggcaaaactaggcaggcgtgcatggaccagagcatctctagctaacgaggccaggcgatcagcagtgtccacaaacaggatggcttgctgatctaaaaagcttgaaatcatcgcacatttttccactttgccagcattattagcccatttcactaaagctaataatcgaacgaagagttggcgtgtccggctagcaaactgcactatttctattttcctttccacatcagatttccttggcagtaggtccgtcaacaccataagctccgagtaggcccggtgcagcagaaattcaatgagggtgctcagccggtagcccgggctagccgcagctgcagcggccgccgccacggcggctcccgggggaggaggggctggggctgacgggggtccgccgctgcccccgccgccgcctccgggcgggaccagctggtggttctccagctgcactggggccatggcggcgcaggaccgggcttggcgcaacggcacacgatgcggtcctcgagcctcccgggcgctcggtcaccgcgccgaaacgggagcgggcagagtcgccaccgcctaccgccggcaaccctcggccgattaaaccagcctcgtactagcta

SEQ ID NO: 548076 - DNA, 141 bp, Homo sapiens
agatcggattcatatcaaaaatgcgtgtaatcagctgtcaaagtaacaagaaaaaagaaaagaaaaaagccaaagactgtggaagttgaactgcaacaacacacaaatcaaaacagcctggccagggatactccagaattc

SEQ ID NO: 548077 - DNA, 7140 bp, Homo sapiens
  misc_feature (552)..(554): n is a, c, g, or t
  misc_feature (570)..(570): n is a, c, g, or t
ttggctactagtctacgctggaatacgattgctccacggttggctactagtccacaggttggctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctnnnagcagccaccaattangaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataaggaaaggttaaaaaaagtaaaaggaactcggcaaatcttaccccgcctgtttaccaaaaacatcacctctagcatcaccagtattagaggcaccgcctgcccagtgacacatgtttaacggccgcggtaccctaaccgtgcaaaggtagcataatcacttgttccttaattagggacctgtatgaatggctccacgagggttcagctgtctcttacttttaaccagtgaaattgacctgcccgtgaagaggcgggcatgacacagcaagacgagaagaaaggcaaagaaggcttcaactctgattgaaaatgagtggagaatcaaacaaagttgagaacagatatgatataggtacagtgagatacttgaaactagaatttgatagttgatagttatagaagctcaattaaatcatcttgaagtggaattagacaaagcatctacattttaatggagaaccagtattacagtgaccaggtaactcggcatggtattatcacttaaaaatttttcctaaataccatgaagtcggtagaagacctttgcatcagaccatgttctttgaagcttaaaaaagtccctgactgactaggaaagacagcacagtgctccaaaaagaaaccctgcagagatgtattaataccaaaaactccatttgaccctggacaggcccaggattcgggattcttcacaatgaggggaatggaccaggtttcttccaagcaaaacattctatcgttttgttgacaatgaattaaattgaaattgtttagaacaatcccaattttggtggggaaggaaaggaggataagttaagcaagataaagaaagctcacagaaacttcatgcagaggtacagcattaaagttctttgtttcctaattaatgttgtatgcagaagtattctgtaaactaaattttcctgacagaaaagttcccacatcctcaacagatgagaatgattgcattatttgggatccttgatcaatacgaaccacatactgtcccttctcaaagactaagttccttatttttcacccaaatcctatatattgaaagacaaccaaggtgctaaatgttaaccactagtcaagttaggaatgtctgaagaaaatatattaaccttgacataaagaagatgtttttggtcaaatttcagacatgtattattataaattaataactggctccatccaccaggttaaagatgaagggagggcctaagatgtctctagagtttatatacacacaagtgagtgtcactgttttgttttgtttttgacctagttttattaaatattgcttccttggggtgtgtttataacaactcccagaacatttcatgtaaggattcaaagcggtcatattaaaatacagcttcaatataaagtttatcacagttttacagtattcaaaaatgacagacctgccttaaaaaacaaaacaaaaaccaaaaaaggactattacacccaaaacataagaaaacaattaaataaacaagtttggcattttcataactttatagtataaaacagaatattaaatttattactggcaaacggacactgatttatttcctttgaaatgtgtcccatttaaacacactatacaagttcattatacaaaagatggatgatcattttgatgaaagaagtgcaccctgaaaatttttgccagtttagaatatttagctcttaaagtttaaaaaaaaagtccttttccttttttaaactgaaggctgaattcagattttttttgttgtctcatctgtcagccttcctggtttaaaaacaatagtgtctatggacgcccaccagggggcagtgtaagattagccattaaatcacgaacagctgcaaatattgtgcattcaccttgtcgtggtggattcatctctgcaaacctcttcagaatgttgctgaccatcatgggagcagcaacagaagagttctgctgtctgggaatgtctgcctgctgggttgtacctgaagccatgtcataaatgattggaactataatactaacaggttcttggggagggaccgatgttttctgagttagttgaagaaaaaatagcattttggatttcagcaccacagcaggcgtcccaggaggtgcaatcggcggcgcgctgggagggatcgtcaggcaaaactgaacattccattttagctgtgttgcttggtcagggaacagctccagcttcataatgtgcacacaatccctgaggatgtgtgtaggagctcctaatagcttggtgaaggctattaacgtattagctttaaatggtggtcctgcaactcttgtttcaaagaatttctccaaaacttgaagttcatcaggtttccactgtcctgcattttcaggtgtcacttttagctgaagcgtttggttggttttgggactaagagctactctgcatttcagtgcatcagtcttaaacatgatcactccgggttcattagaatttatcagctgcagcgtttcttgttgaataattctttgaagatgtcgtctcatgatgactgatccaaggaatctctcaagtggagaacaaaggtaactacctgccaggccgggcacaaggcctggagttggagagggcagcagtaaaatgttcaaggcactgtgagtgaggatggtaggtatggatgccgcccaagagcgctgaggtagtttacgaggtggaggcatgtttgttggcattgtttgagaacttgttccagctcgaggggaatgagaagcatctggaaccggagaatgtagtgaggggttggctggtgacattccaggcatgcgtgctgctggtgaggggccagacacttgaggagatcctggccagttccctgctcgtccacttggtgacaccatagtgtatggggaactagggtcaagagttccatgtggactagcaaaactggcccctggtcctattgagattccatgcgaggatgggggaggagttggaacaaatgacgctggtgatggggctctcaaagccccactgggggagctggcagcatgcagatttcctggagactgtgtgtgcatcattgagggagactgattgactgtgctatgataagatgtagggggtgaagtaagaggataagcacctgatgttcctggctgctttggaaatggctgttgctggggtggtggctggagctgcgatattaaagaatccatcatatctcctcctataggagaagggggattatcgtcctcatttacagaccttcttcgagcatcctgattgctgtcaacaaacatattcaggaacgtctttagtcctggtgcaggatagaaaccttcaactagtttgctgttatcaaaaagactataggcaccatcccgtattgccacaacacctcgactccggcagtatatatcaatgcaatacatgttcctgaaggccagtctgatgtgggtggacgactgtggcagaatggagaagcactggtaggcagtattggttctctgggtcaagcccaacatcggcacagtggggagtttgttgatggcatttaatggagcctgagtatcaaacagtacctgtaataactgaaccacatttggtgttttgttgaacatttcttgaagctgatggagaatggtattgtgacagttactgcaacctgagtttgggccaacagttcccaaagaaatgtggaatttttgatggatcgaattccattggatactaattgagcttcccttggtggttccataacacaagataagttttcggtaattataaacacgaacttctgagaaaatatttagatgagcaggtatgtctggtagagaacgtgcaaattccaacacacactcatataatcgtgcaatgctattccagtcattaagaaacatttcaaccacctttctaccaccaacaggctcagacaacagattttcatatgtcaggtaaacgtgccgggatggtccttgctccctagtagaagtgccattaagtggacaatttgcaaacactaactctgctacccaagtgcggttatttctaccttgtaatcggaaagtgcaatcaagaagagagcggtccagagccttttgggtttcctcagttatacccttacagggaggaatttttaataagcgaattgcatggctgaagccatcaccttccacttgcactccttgatgtggaatctccagattggacaactccaaccgaagtcctacaaatggcatatttgtatcacacatagcgacgaagtgggctaaaactttattgaaggcacacatttctcctgctcgttttgttttcttggattctactggacatggatcatcagacaacttgcgcttggcattggttctggtctgtttcccggtttttgtacgaaaaaccaagtcctgaatgttttccttgaactgctgcagcagcaatgccattgcagggctgtcttcacgatctgcagcattcacagacataaagtagtacttgtacgacagttgtgtgggtttattgggaacctccaacatctccacaacaatgtagtattgtggaaggcgggtaagtttaatgaacagtttattcttagaaaggtttccaataggatgagttgagtaattggaaagctgcaatgtttcactgcttatcgtaggcagatgttttatagactgcttgcaacgctgttgtccaagccaaaacttaagttgctgaatccagggtatgattcgtttcatatcatcattcacagacttctccatgtcatccagagtggcctggtcaagtccataaagcatcaattgaaacattccagaatgtaaatctacaaaaatgtgcagacactctgaattaccacagggctccaagatgggaacaacaagagctgggagtgcagtctctatggaagagttttcattggcattgaagcctctaagaatggccttcagttcttggagcttctgatgagctcttgcatggacactgtcaatcaggagtttttctattgataagtggtcgatcttcatggctctttctactaatttggaatcagaagctggcaaaggaggatcgtgaaaaatctgtaaaggcttggagacatcattctcatcaattttaattgtaactttgtgaacagatgctgttccagtttttctcccaagaacctgttgattccaaactgaaagggagaggcactttccagcatgatacctttccacctgcacaaggtctccccaccgttctcggattaacattagagtttgggaatgtaacacttctaactgaagtgataaacagaaagaatgtaggcagttgtacatatcctgaagaggtttctcatcagcaaagagcctagactgcaccagttgatggatgaagctgatttgcatgctatgaaccaaagctcgcccatctcctgtttccttatcctcaactagaatttctagcttgagaagacgccatggaacatcagggtcatctcccatcacagtcaaggtggcttcaaattctccttcaacacgaaacttcacccggccatttgcaactgtaagatttgctaactgaggaggaagatctgtggttacaagccgatgtctaagaatctgattcagctgatggagtgtggcttgtttttcaattttggtaattgggtctggaggaataattttatccctaatgcaggttggcagccgtgggtaagatccagtagttagtacatcaatggcatatgggatggcaaaactaggcaggcgtgcatggaccagagcatctctagctaacgaggccaggcgatcagcagtgtccacaaacaggatggcttgctgatctaaaaagcttgaaatcatcgcacatttttccactttgccagcattattagcccatttcactaaagctaataatcgaacgaagagttggcgtgtccggctagcaaactgcactatttctattttcctttccacatcagatttccttggcagtaggtccgtcaacaccataagctccgagtaggcccggtgcagcagaaattcaatgagggtgctcagccggtagcccgggctagccgcagctgcagcggccgccgccacggcggctcccgggggaggaggggctggggctgacgggggtccgccgctgcccccgccgccgcctccgggcgggaccagctggtggttctccagctgcactggggccatggcggcgcaggaccgggcttggcgcaacggcacacgatgcggtcctcgagcctcccgggcgctcggtcaccgcgccgaaacgggagcgggcagagtcgccaccgcctaccgccggcaaccctcggccgattaaaccagcctcgtactagcta

SEQ ID NO: 548078 - DNA, 142 bp, Homo sapiens
aagaccagaaaaaagtgatccagataataaagagacagatgagtatcttacgatgtatatctttaataacaaagttaaaaggtcagagtaaagactaccaaatattcgtttagttcactcagcgaaagcatgtatttatctt

SEQ ID NO: 548079 - DNA, 341 bp, Homo sapiens
gactgggaaacagagtgagactccatctcccacgctggagtacagtggggcacgatctcagctcactgcaacctccatctcccaggcccaagtgattctcctgccccagcctcccaagtagctgggactacaggcgcccaccaccaccatacccagcaaatttttgtattttagtagagacagcgtttcatcatgttggtcaggctggtctcgaactcctaacctcaggtagtcgacccacctcggcctcccacagtgctgagattacaggcatgagccaccacgccctgctaggagttcacgctttagttggggaaaatatacaataagcaaggtcgacg

SEQ ID NO: 548080 - DNA, 749 bp, Homo sapiens
ctattctccaaccagtcccgactatagtcgcacatgacccgagctattcgccaacgtcacccagctactcaccgagctctcccagctactcacccacctctcccagctactcgcccggctctctgccgagctactcgtcccacgctcgtcccgtgctactcgaccgcacttccccgtaggatatctcgccgaattgccctctagtctgactacggcttactggtctcctcaagctgctcggccgaccatctcctcagttctactacgcgaaaatcagccgagctaattcgtccgcagttgtctcccaagtgtactcaacgctaacactctcaaaagttgattcacctcgacacgtacccgcccagctgtctcaacagcactttgccccgagaggttactcgatcctcgccgagcctctgatacaattctcgaagcagtcccagtgatgcccacagcatcacgcagtctccagcccgaggtccggcacagctatctacaaacatatctagtcaccaaaatacagcaaccttacgcagacggctggattcacagccctcaaagctcgtaccataggcttagtactcccaatgattcgaggcgcagtctaatgtccccgaggtccaccgaagttaactaacctgtaggaagcaccaaagataccatcaccccgaggtctctcgaaaacttgtatgcccaccgtgtgccccgatcgttcagggcgagtatgccaccgtgtaggtgcctgacct

SEQ ID NO: 548081 - DNA, 256 bp, Homo sapiens
gacgcgcagcgaaaaagggttctcttttcaagtcattttcttcagatggcatttaaatcctttagaaacacgcaatttatacggagattcatggtgtcccttaatatgccacattccgtgaagtcagatgtgcgccgtccttcatggtggctggagttgtcattcatgatctacctcaggtctccagtaaaagacactttctccgtctaccttcctattatgatcctgtattgctatagaaacttctaaaactagg

SEQ ID NO: 548082 - DNA, 246 bp, Homo sapiens
ggatgatggctgccatggccgaaaatgggctgtcgagtgcaatatattagagactggagacttttgcgcgatctgcaatgagatgatggtctgatgattcgcttatttcaggcttgctgtcattctccgtgtccacccttctctctggcactcctgctctagtttgcaaatcctactcatgagttcagaacctgactcatctgccatcagcccacccacagacccatgcgcgttgtccgatcgtgt

SEQ ID NO: 548083 - DNA, 498 bp, Homo sapiens
  misc_feature (400)..(400): n is a, c, g, or t
  misc_feature (486)..(486): n is a, c, g, or t
aaattatcttccctacccagaaggcgtcctttgaccatttcccatgaataatcagtctcattataggaataggggatgatacagaaatccaaagtattccagttgcactgcatttgcatgcgatgttcgagactcaccacccaatctccaagccaaataacagactgtcttaaatcattaatttgattagcttgtgtccatcccttaagggcactgagtttccctgggctgtgggtaggtccagagattctgtccagggagccagggcctgggagttggaaaccttaggaataatcctgggtgctctgttttactgtggctgagctgggcacccagggttacaagacagcattcctttcccatttctttccctccccttttttccagggcagatggattnttttccccgtgttccaccattaccacaggcccacaaggagtttttttcagggtaccacaaatgtttactttaaggcccaagggttntttcattcagtt

SEQ ID NO: 548084 - DNA, 1099 bp, Homo sapiens
gggcgaggtctgagatgtcactggagctaccaggaagcatcatgggtgccctgtgggagatgccagagctcctggtgtggctgccccgaggcggtagcttcagagcctccagtgcctgtgggtgctggaggtgaagttgggggccctgtgtgctgctgctggtgctcaccctcctctgcagcctggtgcccatctgtgtgctgctgcctggaacaggagctaaccatgaaggctcagcttcccgccagaaagccctgagcctagtaagctgtttcgctggtggatggcgtcttttatggccactatgtctcctggacctgctgcctgactacctggactgcgcatagatgaggcccctggcgcagcttgccacgtgacgcatccaggttcccagctgccaaggaggtacatccttggcaccattgggagcattcgttccctgcgctcctgggctgatcggcacgcaggactcacacctgggacttagcaaagggaggccatggtcaaggggcacggtacaacccttcttgggacgtgaacacaaagtgagccttcttgtactgtcgaaaccatcggtggaaaattgggtgggtgcccagcatacaccaattaggggcacgtgcaattggagatgcacaatgagggtagatcgcctaacaagggtgacgcacgctgggcaagtggcccacaaggcaaagactccccaccttcaaagtggcaccttattggcagagtatggaccccgttgcgatttgcttaacccattggggagctatagggttagcctatagccccaaggttggcgacacaccgcatcaccgaaagttttcggccggtatgcggatttaccagtgcaacgtaggaggtgaccattagcgtaccggtggtgaactatgtggccgacctttgggcgcaacgtgccggaaaaggaaaaccaatgggtagcggccgagttcacgaggagggcgcaccgaaaatgtagagggacagcgcccattggtattctgccacccttgtgctggccacatttcaatacgcgacattgggaaagcatccgccaaacacgaagcatggggggtgcacaaatatccccaacttg

SEQ ID NO: 548085 - DNA, 1416 bp, Homo sapiens
ggcaacagatctaacttggtacgcgaagatcaccaatgacttgcttggagccgagagcgaccaagatggtgaagatgatagccacgcgcatgttaaatacgtggatggtctgggctagttgtacctgctggtgacgtggttcccagacgatcgacaatggctgcgcatctgacagccagtcaagatcaaagcagtagccatcgcacgttgagtaggatatgtggagctcgcactgggactctcaatgtgttggcgtcagggtacacagaccattcacagattgtaggtgccctggagggaggaccctgagtcctcattgttcaccagtgaccagcatgtagagtgcaatgccgtgaagactcaatagcaactagctctcactatgcggtgaagcgctcatggtcgcatcggcacttgagggatctactgaagatatggatcgtgcagtgtgtcatggccagacaagggattgccttgtggtgtccacatgcgctacccgttttgatggcgaagggggcgatttccgtgtggacattagttcgagggtggaaacctaacaaagttgggggccgaatgagttacaggggactatgaggatgtgggatcacaacgaatagctaccggaatatgagacgggattgagccagtaccggtccgattgccctgtagtagggaccagaaacagtacgcaatatgggggctcgaaaaggcaatcgatcacaagattgaatcggccccatactttacacgtgccaggtaagaaggcacatacgattgagggcggaggcaacgcgataagaaattccgtgggcacaaagggccgcggctacaaaaaagacgatggattctccctggggtcctaacggggtatggtcaactaatggggaccaagggaatgtgatatggagcttcaattgacttgtcgcgttgggtataacagggcgcgttctaagtagcctctgtggaaagaatcgctcagatgggggtccacctaggagatgaaatacaggataatatcgcggaaacaccccatggcgtgcacccattaaaggcaaacagcctgtggccagttccgactggcacgttgggacctgtggggcatacatccgacgttgaaacgatgggcataaatcaccccgtacaaagatcgcccgggaggaagtggggatacatgacgcaatcacctttgtggtcaaatcataaagtggcaaaatggcacccacaccctattataacttgccccaattatactaaacagaaacctaaataagcttaacccctatgaaaccaccacgaaaccacttcattgaaacacgacgaatcacattgaacattaccacaccaaagattttatccgcataattcaagagaagtatcacttatcaaccacaccatcagtatcaaaagaatcccaag

SEQ ID NO: 548086 - DNA, 927 bp, Homo sapiens
gtgtgagaaagtgtccttgggccccctgaataattgagtggacggcgagtagaaacttcttggggggatatcctatcttctcaggagggagggtagcccccggaagacgaacttgtttggcgttccggccaggaattaactgtgcgggagcccgcctttgccgtgagcggggttgtgagacgcacccccgggagcatctggagacctaccacgcggtgaagatattaagaacgcgcgttcggcctagacagtaaataacagtttgaccctcggagaaagtggtagccccgcccccgcttacatgactcaagacgtcgtctccagggcaagggggatgtagggcgaggcatgacacccacgccgctggagaggttagctggtggtggacagaaaagacgatgttagattctatttgtgtgtggagaactaattcatggagataactgcgattgatcggtggtacagttggggtgacagatgtttttacgtcacatcggctagattggtaacattggtgtagccgttcctatatacagaggtgtttcgccccgcacccccagacatattgattgacagccacacacacagacagttccggtacgcgctacgcgccaatggtatgtatcgacatagttctctttccgcgaccgatgtgttataataggtgtcgctcgcgccgctacctctacgcgctcttttttgacgagggaccgcttggttggcaccacaaaaggtgttctatagataggatagacgtggggcgtgcatatacaaaaatcgtggcgaataatataatgagagaacaatgcgagctgctggtttcaccaattccctcactgagatgctgtgccccaaatctgaaatgccgcaaaaaactggggaaaaatgggccataaaagaaaaaaatcaataaccccgacaaaaaca

SEQ ID NO: 548087 - DNA, 246 bp, Homo sapiens
ctttcgcgcctcagcgtcagtgttggtccagttggccgccttcgccactggtgttcttgcgaatatctacgaatttcacctctacactcgcagttccaccaacctctaccaaactcaagccaaacagtatcgaaggcaattctgtggttgagccacaggctttcacccccgacttgaatggccgcctacgcgccctttacgcccagtgattccgagcaacgctagccccttcgtattaccagggag

SEQ ID NO: 548088 - DNA, 1438 bp, Homo sapiens
  misc_feature (139)..(139): n is a, c, g, or t
  misc_feature (146)..(146): n is a, c, g, or t
  misc_feature (153)..(154): n is a, c, g, or t
  misc_feature (895)..(895): n is a, c, g, or t
  misc_feature (1013)..(1014): n is a, c, g, or t
  misc_feature (1017)..(1017): n is a, c, g, or t
  misc_feature (1098)..(1098): n is a, c, g, or t
  misc_feature (1117)..(1117): n is a, c, g, or t
  misc_feature (1341)..(1341): n is a, c, g, or t
  misc_feature (1379)..(1379): n is a, c, g, or t
  misc_feature (1395)..(1395): n is a, c, g, or t
  misc_feature (1423)..(1423): n is a, c, g, or t
ctgcggtcagagtcggattgtgggggaggttcactggcagagaaggttaagagagaggattatctccgtgtgggccggtggccatatttggcgtctccaggaatgaatctgtgcgatattgagagtccagtgactcggnggagaanatgcganngggtgggatgaggccgagcaagatggaattggggaggaggtgctcaacgatgtccacgcgaggagatcatccagcgcacacggctgctggacagtgagatcaagatcatgaagagtgaagtgttgagagtcacccatgagctccaagccatgaaggacaagataaaagagaacagtgagaaaatcaaagtgaacaagaccctgccgtaccttgtctgccaagcgtcatcgagctcctggatgttgatcctaatgaccaatgaggaggatggtgccaatattgacctggactcccagaggcaaggggcaaggtgtgctgtgatcaaaacctctacacgacagacgtacttccttcctgtgattgggttggtggatgctgaaaagctaaagccaggagacctggtgggtgtgaacaagagactcctatctgatcctggagacgctgcccacagagtatgactcgcgggtgaaggccatggaggtagacgagaggcccacggagcaatacagtgacattgggggtttggacaagcagatccaggagctggtggaggccattgtcttgccaatgaaccacaaggagaagtttgagaacttggggatccaactccaaaaggggtgctgatgtatgggcccccagggcacggggaagaccctcctggcccgggcctgtgccgcacagactaaggccaccttcctaaagctggctggccccccagctggtgcagatgttcattggagnatggtgccaagctagtccgggatgcctttgccctggccaatggagaaagcgccctctatcatcttcacttgatgagttggatgccatcggcaccaagcgctttgacagtgagaaggcnnggngaccgggaggtgcagaggacaatgctggagcttctgaaccagctggatggcttccagcccaacacccaagttaaggtaatngcagccacaaacagggtgnacatcctggaccccgccctcctccgctcgggccgccttgaccgcaagatagagttcccgatgcccaatgaggaggcccgggccagaatcatgcagatccactcccgaaagatgaatgtcagtcctgacgtgaactacgaggagctggcccgctgcacagatgacttcaatggggcccagtgcaaggctgtgtgtgtggaggcgggcatgatcgcactgcgcagnggtgtccacggagctcacccacgaggactacatggaangcatcctggaggtgcnggccagaagaaagccaacctacaatacnacgctgggcacacag

SEQ ID NO: 548089 - DNA, 554 bp, Homo sapiens
  misc_feature (277)..(277): n is a, c, g, or t
  misc_feature (286)..(286): n is a, c, g, or t
agaaacgatcggtactggtggcagacgctcctgatggaactctccgcagaggggtggctatggatgcatgttgatttccagtcctcactcaccccctggggaaaatcggtgttacggtttgtcctcacacaatgccccacgagacccagccttgtccccttggatgcttgaaggggatgattctggagacccccaagaggcctcctgagcggagctggtgggttccttttccttctccggcaggacgttagagccgcattgatccacgtttcaaaanccaggctcncttttgatacacgtagaacccttccacaccctttttttcatatgtgacttgaagtttcaaaacaatattgtgtgtttgaaaaaagcgggcgtgacgttgaacagcccgtctttgggccctgggggttctgactgcccccacagcccctcagaggtgacggtgcaaccggtggtggccatggcgagccattggcggaaaagagctcgtgagggactcgcctggcctcttgtggttgacattctgaattcataaccaggtgggctggtcc

SEQ ID NO: 548090 - DNA, 179 bp, Homo sapiens
gagctgcttctggagcgtttgcaggaggtgggggagggcgaagcgcagggccctggcaggtttctcagcagcctgtgggagcgcgttccccagaacaacttcctgaaggtgatagcggccgcgctcttgcttcccccgtcgtctccctggctccaaggagaggaattggaaccgggcag

SEQ ID NO: 548091 - DNA, 1382 bp, Homo sapiens
  misc_feature (139)..(139): n is a, c, g, or t
  misc_feature (146)..(146): n is a, c, g, or t
  misc_feature (153)..(154): n is a, c, g, or t
  misc_feature (957)..(958): n is a, c, g, or t
  misc_feature (961)..(961): n is a, c, g, or t
  misc_feature (1042)..(1042): n is a, c, g, or t
  misc_feature (1061)..(1061): n is a, c, g, or t
  misc_feature (1285)..(1285): n is a, c, g, or t
  misc_feature (1323)..(1323): n is a, c, g, or t
  misc_feature (1339)..(1339): n is a, c, g, or t
  misc_feature (1367)..(1367): n is a, c, g, or t
ctgcggtcagagtcggattgtgggggaggttcactggcagagaaggttaagagagaggattatctccgtgtgggccggtggccatatttggcgtctccaggaatgaatctgtgcgatattgagagtccagtgactcggnggagaanatgcganngggtgggatgaggccgagcaagatggaattggggaggaggtgctcaacgatgtccacgcgaggagatcatccagcgcacacggctgctggacagtgagatcaagatcatgaagagtgaagtgttgagagtcacccatgagctccaagccatgaaggacaagataaaagagaacagtgagaaaatcaaagtgaacaagaccctgccgtaccttgtctgccaagcgtcatcgagctcctggatgttgatcctaatgaccaatgaggaggatggtgccaatattgacctggactcccagaggcaaggggcaaggtgtgctgtgatcaaaacctctacacgacagacgtacttccttcctgtgattgggttggtggatgctgaaaagctaaagccaggagacctggtgggtgtgaacaagagactcctatctgatcctggagacgctgcccacagagtatgactcgcgggtgaaggccatggaggtagacgagaggcccacggagcaatacagtgacattgggggtttggacaagcagatccaggagctggtggaggccattgtcttgccaatgaaccacaaggagaagtttgagaacttggggatccaactccaaaaggggtgctgatgtatgggcccccagggcacggggaagaccctcctggcccgggcctgtgccgcacagactaaggccaccttcctagtccgggatgcctttgccctggccaatggagaaagcgccctctatcatcttcacttgatgagttggatgccatcggcaccaagcgctttgacagtgagaaggcnnggngaccgggaggtgcagaggacaatgctggagcttctgaaccagctggatggcttccagcccaacacccaagttaaggtaatngcagccacaaacagggtgnacatcctggaccccgccctcctccgctcgggccgccttgaccgcaagatagagttcccgatgcccaatgaggaggcccgggccagaatcatgcagatccactcccgaaagatgaatgtcagtcctgacgtgaactacgaggagctggcccgctgcacagatgacttcaatggggcccagtgcaaggctgtgtgtgtggaggcgggcatgatcgcactgcgcagnggtgtccacggagctcacccacgaggactacatggaangcatcctggaggtgcnggccagaagaaagccaacctacaatacnacgctgggcacacag

SEQ ID NO: 548092 - DNA, 400 bp, Homo sapiens
acgagcccggcgatcatgagggcggggtgttcccgggctacctcggcgctcacctggccggtgtcgacgagttcagcgaccaggtctgtccactcggtgcgcagcacgtccaggccggtgatctgtccgtcaccgccgatgacgacgagacgatcgatcccgtgttcgaggagatttctgacagctttcaggcgccccggacgttcgcgcatccccttgcaacggaaggttccgatcacggtgccgccacggttgaggatcgagccgacgtcgtcccacccgaacctacggatgccatcgccaccatcgatcattccctggtagccctcgtatatcgcatagacctcggctcccacacttagtgcagagcgcaccacagcccgcacagcggcgttcatgc

SEQ ID NO: 548093 - DNA, 302 bp, Homo sapiens
taggccggaccctcctcagctcccaaagtgctgggatagagacatgagccactatgcctggctgtagttattattttgatgggtttgtcttttaggtctttctactcaagatattagtagtttaaacatcgcaattataatgttatactatcctgcgtttctctgcatatttactatcatcagtgagtttggtatttttaattgattcttattgctcattaatgtccttttcttaagaaatccctttagcatttcttataggacaggtctgttgttgatgacatatcaacttttgcttgtct

SEQ ID NO: 548094 - DNA, 144 bp, Homo sapiens
tgctgctaaaggggtagagagagaacgagatctcgtaggccccatctccctgcctgaatgcctacttcacaatgctccttcccggggtgccccagactctcccttgcgcctcaccctgtgtctggtgatgagtgagaggaagca

SEQ ID NO: 548095 - DNA, 486 bp, Homo sapiens
tgcaggcctgtttcgaagggcagctcttcctgcgaccagccgcgttctcgcccggtaacggatgagattggttgccaagatggaccgtgcgcttcgctcgcccgacgctggtttatgggcgacggaagacatgcgaaaagtcttccgccatgctgcttttacgtcagccgcctttaagtcacaatttttcaggttggcacaggtaagacgagggatggcatgacgcaaaaactccggtccagactcgcatcgacgttggtggcaacgagcgcgttgctcgcgacgaatggatcttgggcggccaccctgtttgggtggggtgacggacgattccgtgtgcgatgtgggcagcacggagcagcgcaagggagggggctttggccccccagggagttcatcgagcgccagtgcaggaacgggcagctgctggtcggcgtgggcgtgtttgccgccgggggaatgtcggagcctctcatcacggcgctg

SEQ ID NO: 548096 - DNA, 191 bp, Homo sapiens
  misc_feature (95)..(95): n is a, c, g, or t
gtacaggccgagagtacatctccaactgaccctgatcaacgaagagggattcatgtgtctgtctcacgttggttccaaatgaaaccagggagcanggggagttagtgaatcgtaacacctagtcatgccttactggttcttctgctacgagaggccaatacgcctgtgccgctccacgtcatctgtgattt

SEQ ID NO: 548097 - DNA, 141 bp, Homo sapiens
ggtgcgactgagaaaagattgatttttcttgtttgtttcgtgtcgcagattccaaccccaaaaatattccaggacaagatagggggtcaggactgggctggattcttgctgtcaatgtggcttgttgccgccagagggagg

SEQ ID NO: 548098 - DNA, 494 bp, Homo sapiens
  misc_feature (494)..(494): n is a, c, g, or t
gaggctgaggcatgaggcaggagaatcgctcaaacccagaaggcagaggtttcagtgagccgagatcacgccatgcactccagcctggtgacacagtggggactcccatctcaaaaaaaaaaaacaaaaaaaaaaaaacatttttgggccgccttgggcccttagaaaaagtttttgacgaaccaatttgtgttgtgtgggcggggccccggatataggttaaggggaacagtgggccaaaggggggtacccaaagggagaaccggggggcaaaggaaccaagtggtagtgggaatatcatcacaccaagaaaaaaaaggcgcccgggggaacaacgcaggagtcgttttgtgaaaacacaatctcccagaagaggagagatccgagggaggacacaacacggggggactcactacacaccaagggggacgcaccacaaggaggaagcacgggagataacacaagataacggcccccctgaccggggggatgtn

SEQ ID NO: 548099 - DNA, 116 bp, Homo sapiens
gccttggcggatgatctggttggtgagcttcggctcacgctccttgtgtggcagaacaatcgagttcatggctgagcacctcgtgcagggatcctggactcgtgcagcccagtgat

SEQ ID NO: 548100 - DNA, 409 bp, Homo sapiens
  misc_feature (77)..(77): n is a, c, g, or t
cggcccatgcgggagcggactgctgtccagggccagtacctgacagtggagcagctcacactagacttcaatatgtnaaccctaccctcatccagaccccctcccctctgtgtgtaccatgtaagtatattcagcgcagtatgtcatcgtcattcctggaggtgggcccagggtgcaatcagagtcctatcaatcatttgctaaatgctacgggcattcgcgtcgtccaatcaggaggggcacctcctaccacagacactatcactccagtcctcaaggtggccatggtccactccctccatggatccaccatgcaggtcagtgtagagtggatagagttaggtcatatgtcagttcacccacagagtatggagctcgtacagccatacgtgcgagaacatggtcacat

SEQ ID NO: 548101 - DNA, 161 bp, Homo sapiens
  misc_feature (112)..(112): n is a, c, g, or t
gtctcactggccaagaaaattgcctttaaaactcgaaaataaggccaggtgtggtgactcacacttgtagtcccagcaatttgggaggctgagacaggaggattgcctgagncaggagtttgacaccagcctgggcaacatagtgagaccttgtctctaca

SEQ ID NO: 548102 - DNA, 1376 bp, Homo sapiens
tctgcgggacggggggctccgggtgggagcgtcactgtactccgtgaggcggcggctcctccgtgcggtggtgctctggctgtttctccacgcggtggtgggctggctccgtgctgcttctcctccgtgtggcggctggctcctccgagggtgcggctccgtgctgcttctccatgctggtgggtgggctggctcctccaggtgggctggctcctgtgcttgcttcatcctcctgagcgagcaggctgtgctttctctgtggccatgtgctgtgtccaatggttgccaggacgcatactggagtgctgtctcatacgcgtgcgggatcctcctggtggggtgtgctcccgagtttgcttcatccaatgacagtgacggaggggccaggcatggcattcattgatcatgcacgaggcataacatctagtgcaggctggcatcatgggcgagaagtgaaatcttgggattgacagtgaagtcacgtgcataccattaaagagactgagaaagccggacatcccaggtgcataccaatctcaatacgccacaacacagatacaacatccagaaacactcagtataccgacagcccaccaagaaacggaggattaacgagcaaggaggagggatacgaaccagaacagagacagagagggacaaggcgagagagacaaaacgagaccatgacataacttccaaatcgaggcagagaggaggccaagacggagaagcaatcccggacatagcaggaaggagcgagactacccaatccgaggaaataagagcaaaggcgagacagggaatcaaatcaaatgatgagccacgaagaagagcaacgcagaaaataggccgggacagagtagggaaacccaacaatagaaaaaggcacagagcaggagcaggagaagagcaaccacaatcaccagagagaggatgagaaacccaggagaaagctaggacaaacgaggaggtacccaagacaacctagcacacacaaaaaaaaacaccaagacaagaaaaagacaaaggcagccacaaaaaacctaggacaccagaccacaacatataaggaatacagcacataggagggttaaaccacagaaaaggagcaaagggaagatatgagagcggataggattaatacacaagttagataaactgaaatgagtgaattagaataaagccatcattcagatgagttgataagcaccggaaaggtattatgagaaagtcaagttgaagatgatttatatagagcatacagcattggaaaagagaataagcgaatttgaatggtaatccagtgagatggaatataaatgatcctataggatgagtttaaatacacgagtcaataggtggattacgtgcatgaa

SEQ ID NO: 548103 - DNA, 874 bp, Homo sapiens
ttggctactagtctacgctggaatacgattgctccacggttggctactagtccacaggttggctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaaccgcctatagccggcatgctcctaaggcgagcgggacctgagtcgggagggactcggc

SEQ ID NO: 548104 - DNA, 1058 bp, Homo sapiens
  misc_feature (820)..(820): n is a, c, g, or t
  misc_feature (860)..(860): n is a, c, g, or t
  misc_feature (885)..(885): n is a, c, g, or t
  misc_feature (894)..(894): n is a, c, g, or t
  misc_feature (1006)..(1006): n is a, c, g, or t
  misc_feature (1018)..(1018): n is a, c, g, or t
  misc_feature (1024)..(1024): n is a, c, g, or t
  misc_feature (1027)..(1027): n is a, c, g, or t
  misc_feature (1029)..(1030): n is a, c, g, or t
ttggctactagtctacgctggaatacgattgctccacggttggctactagtccacaggttggctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtacatgaaacatctctctcgcataagcctgcgtagattaaaacactgactgacaattacagcccatattacatcaaccacaggcattataccctactgcaaccacacagcatgctatanggaaggtaaaaaaaaaaaaactgagggggcccgaccaatnggctatatgagcgatacaatactgncgcgtttanacgtctgactggaaacctgcgtaccaactaatgctgagaaatcccctttgcagtgcgaataaaaaagccgaccatgcttcaacattgcaactatggaaggaattagcgtaanttgtaaatccgnaatttnaanannctttaacaagcaatggaaacttaattaa

SEQ ID NO: 548105 - DNA, 171 bp, Homo sapiens
tcatcgagctcggcccgaattaagagaagaaggaaggaaggaaagacggatgaaggaaggaaggaaggaagggagggagaaatacagacagtgagcttatatttctcatttccttttcactatccagcttaattggtcttccttttatcccactttattgaaaactttttg

SEQ ID NO: 548106 - DNA, 502 bp, Homo sapiens
  misc_feature (502)..(502): n is a, c, g, or t
tggcgtgctgtgctcttctagggagaggcttgaaggctagcagcaggcaagcaccagtttccaggcaagcagcagcttcaggtggcaggcacttgaaggctgggtaacagcaaataataatcatgtaatcaacataatgcatgcatatactttttaaaaatcccaggagcactaacaggcttataatgtatcacagtaacactttacttagtcttattataaccccaatctcactgatactcctttttaaagcaggattcttttggtattcatattgatgactctaaacatgcttatttagctctcttgtgattcatcggttttaggcattcatttaatgaattacgctatctgttggtacaccagtatctgctcttctcactggctactatccctcccctcctgagtccccattttttcgttaaatttacattccccgtttatgatattatgaacatgcacatattctcggctgaataaaatatgtattatgaccctcagn

SEQ ID NO: 548107 - DNA, 1055 bp, Homo sapiens
  misc_feature (817)..(817): n is a, c, g, or t
  misc_feature (857)..(857): n is a, c, g, or t
  misc_feature (882)..(882): n is a, c, g, or t
  misc_feature (891)..(891): n is a, c, g, or t
  misc_feature (1003)..(1003): n is a, c, g, or t
  misc_feature (1015)..(1015): n is a, c, g, or t
  misc_feature (1021)..(1021): n is a, c, g, or t
  misc_feature (1024)..(1024): n is a, c, g, or t
  misc_feature (1026)..(1027): n is a, c, g, or t
ttggctactagtctacgctggaatacgattgctccacggttggctactagtccacaggttggctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgctaaaacactgactgacaattacagcccatattacatcaaccacaggcattataccctactgcaaccacacagcatgctatanggaaggtaaaaaaaaaaaaactgagggggcccgaccaatnggctatatgagcgatacaatactgncgcgtttanacgtctgactggaaacctgcgtaccaactaatgctgagaaatcccctttgcagtgcgaataaaaaagccgaccatgcttcaacattgcaactatggaaggaattagcgtaanttgtaaatccgnaatttnaanannctttaacaagcaatggaaacttaattaa

SEQ ID NO: 548108 - DNA, 787 bp, Homo sapiens
ttggctactagtctacgctggaatacgattgctccacggttggctactagtccacaggttggctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcaaacaaaaaacacaaacaaaacaaataaacaaaaaaaacaaaacaaacatga

SEQ ID NO: 548109 - DNA, 775 bp, Homo sapiens
  misc_feature (1)..(1): n is a, c, g, or t
ncccccccggggggggggtatattttggtattgttgtgggccgtcttgctctgtgtgatgcccctctcgtggtgatgtagtgaggcccccttcgtgatgttttctcctcctccgatgtttccctctcgtcgtgggggttgtttttctgccagacaagtccgtttgcgttgttcctccctccggcgcggtgtttttttttttactgtgggtgggtggtgcttctctcaccgcgccttgttctcttgtgccccgggtgtcgttctcgtggggagcccttgcacagaggtgcagcaacatgtggggccccgcgccgcccacaccaacggtgtgtttttaaaaaatttctttcggggggcggacggggcgccgcgcgcacaaagttgttgtttttttgtttgtttttttttttgttgttgtgcgccgctttttattttttttttttttgttttttttttttaattgttttctttttttaatgaaactagatcactgcttacaaaaccctgcacaagccctcctgcccatccccctcacagtttccttgggtcgagctctcctgtctcacaggaagtgcaacaaaatgggtgtgggacaggcaccaccacgtccattgtatgataggaagggggaggggctgggctccgaccccgggccttaagagggtgaaagttcttccttccacaaccgtttcccatggggcctggagttgcatggatgagggtggtccatgccaccatgattctcaggccaccactcagaccagagtgaaacctcc

SEQ ID NO: 548110 - DNA, 872 bp, Homo sapiens
ttggctactagtctacgctggaatacgattgctccacggttggctactagtccacaggttggctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacaaccaggtatgccagaaggtccaggtattccagaaggtccaggtatgccagaaggtccaggtatgccagaagtccaggtatgccagaagtccagtatgccgggtcc

SEQ ID NO: 548111 - DNA, 788 bp, Homo sapiens
ttggctactagtctacgctggaatacgattgctccacggttggctactagtccacaggttggctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaccagaaaccactttctccggccggggagagtccttgaccgcaattaaccggccattttaccattccacaggcattttccctccgg

SEQ ID NO: 548112 - DNA, 800 bp, Homo sapiens
  misc_feature (17)..(17): n is a, c, g, or t
  misc_feature (58)..(58): n is a, c, g, or t
  misc_feature (103)..(103): n is a, c, g, or t
  misc_feature (124)..(125): n is a, c, g, or t
  misc_feature (139)..(139): n is a, c, g, or t
  misc_feature (176)..(176): n is a, c, g, or t
  misc_feature (474)..(474): n is a, c, g, or t
  misc_feature (476)..(476): n is a, c, g, or t
  misc_feature (616)..(616): n is a, c, g, or t
  misc_feature (635)..(635): n is a, c, g, or t
  misc_feature (642)..(642): n is a, c, g, or t
  misc_feature (662)..(662): n is a, c, g, or t
  misc_feature (681)..(681): n is a, c, g, or t
  misc_feature (734)..(734): n is a, c, g, or t
agcgggctcctcctgcncacctccctcgctctcccacaccactggcaccaggccccgnacacccgctctgctgcaggagaatggctactcatcacacgctgtngatgggactggccctgctggnngtgtgctgggcganctgcaggcagcaccggatggcccaggtctccgtgcancccaacttccatcaggacaagttcctggggcgctggttcagcgcgggcctcgcctccaactcgaagctggctcacggagaagaaggcggcgttgtccatgtgcaagtctgtggtggcccctgccacggcatggtggcctcaacctgacctccgaccttcctctaggaaaagaccatgtgtgagacccgaaccatgctgctgcagcccgcggggtccctcggctcctacagctaaccggagtccccactggcggcagcacctactaccgtagtcagtggtggagaccgactacgaccangnacgcgctgctgtacgagccagggcagcaagggccctggacgaggacttccgcatggccaccctctacagccgaacccagacccccagggctgagttggtcggaggaaagttcaccgccttctgcaagggcccagggactngcacagagcgataccaatngtcgttncctgccccagaaccgatganagtgcatgaccggaacaantaggactccccaggggctgaagctgggatcccggccagccaggtgacccccangctctggatgtctctgctctgttccttccccgagcacctgcccggctcccaaccgcatcacccgtt

SEQ ID NO: 548113 - DNA, 616 bp, Homo sapiens
  misc_feature (520)..(520): n is a, c, g, or t
tactactactaaattcgcggccgcgtcgactttttttttgtatttttagtagagacagggtttcaccatgttggtcaggctggtcttgaactcctgacctcattatccgcctgactcggccttcaaagtgctgggattacaggcgtgagccaccgcgcctggccatcaaaagtcttttttattgctctgtaatagttatacatatttatgggctacatgtgacatttgatatattgtataatgtgtaatgatcaaatcagggtaattagaatatccatcacctcaaacatttatcatgtctttgttttgggaactttccggttcttctcttctagctattttgaaatatacaatgaattattgttaacagtagtcactctactgtgctatcaaacactagcacttattccatctgtaactgtatttttgtacctattaaccaacctctcatccctgtccttccacccttctcagcctctgggaatcatcactctactttcttcctccatgagattgactntttaaacatatgaatgaaaaacctgctattatttgaaatctttgacagcacaaagtaattgctgggagacccaaaatatttattacacacaatgta

SEQ ID NO: 548114 - DNA, 795 bp, Homo sapiens
  misc_feature (635)..(635): n is a, c, g, or t
ttggctactagtctacgctggaatacgattgctccacggttggctactagtccacaggttggctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaaaaaaaaaaatanaaaaaaacggccttccacccccgtcgcctccgccaagcacactataatctaaacaaagaatatccttccaatactaaatatggagttaatattaccaattttccccatattatacctcaacaaacaaccgagtcctattactaaacatatcaaacactca

SEQ ID NO: 548115 - DNA, 824 bp, Homo sapiens
  misc_feature (255)..(255): n is a, c, g, or t
tgcgctggcgaacgtcatcattatgctgtgcatgaccgtctgggcgttgtacctgatctttcgtaataaaaaagagattacccagcatttgctcaacttcgcggagcattcgctggcctttttcagcctgtttaatgcggcctttgcgctggtgtggcactggctggcaagcgcctattttatcgtgctgtttttcttttcgttgttcgatccgggcaacagcctgaaatttatgatgggtgcacggtgcgcacntggcgattattggtatcgcagcgtttgtttccggtatgttttcccgctggctggcgaaaaccatcactctctcgccacatactcagcgtaactatccggagctgcaaaaacggttgaatggctggctgtcggcggcgctgaaaacggcgcgtattctgacagtctgcgtggcggtaatgttgctgttgagcgcatggggattgttcgatttctggaactggctgcaaaacggcgcggggcagaaaaccgtagatatcctgatccgtatcgcactcattcttttcttctcggcggttggctggacggtgctcgccagtttgatcgaaaaccggctggcttcggatattcatggccgcccgctacccagcgcccgcacgcgtaccctgcttacgctgtttcgtaacgcgctggcggtgattatcagtaccatcaccatcatgattgtgttgtcggaaatcggcgtcaatatcgcgccattgctggcaggtgccggggcattaggtctggctatctcgtttggttcgcaaacgctggtgaaagatattatcaccggggtatttattcagttt

SEQ ID NO: 548116 - DNA, 695 bp, Homo sapiens
gcaaaagctggagctacctctgagggggaaatcggttccaggcctgcgtgatcttacgggcttcagaattccgctgaacacagtttaaaatagtcttagatatcgaccagctttcccgaacgttggtctcccatttcctcaggggcacaaagccgtttttggaagcttggtttatttatcaagcccactgtttaaggggacgagctgctcctcatcaagattgccaaagctctgtttgtgtggcatgagcagcacctgttcaattgcaagaaggtttacaaggtggttgagaatgccaacgacaccaggtatggactggctccgtatgtgttcgcctaggatatagtcaaggccatgtaattcgtggaggcactccagttcgggtgcgtgggagtagacagttcctatattgtcacctaccattcaccatttgaatggtttaagccatttgtagtcggcagggggttggttagaatggagttggggccaacacataggtagaggcggtcgtcatcaaggttcatcagcagcacatcgtaggaacatgtgtcagggaggcctatgtcacagtcccgtctatcccactgccgcccttggctcaaggcgtgcctacatgttttgaagccaagaactccatttgtgtgttcccactcgactggtacaaaaaactccactaatacagcagttccatcaaa

SEQ ID NO: 548117 - DNA, 827 bp, Homo sapiens
  misc_feature (716)..(716): n is a, c, g, or t
  misc_feature (718)..(718): n is a, c, g, or t
  misc_feature (734)..(734): n is a, c, g, or t
  misc_feature (748)..(748): n is a, c, g, or t
  misc_feature (791)..(791): n is a, c, g, or t
ttggctactagtctacgctggaatacgattgctccacggttggctactagtccacaggttggctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcagctcaacaccactacctaaaaatccaacatatactgactctacaccaattggccatctatcacctatagagactatgtagttagtacatgaaacatctctcgatagctgcgtcagtancntgctgcatacgccatnttcatcaccacagnattttcctaattttaccacaaggctgtctaggaggtaaaaaanaaaatgggggggcccgtccattgccttggggggttt

SEQ ID NO: 548118 - DNA, 264 bp, Homo sapiens
  misc_feature (255)..(255): n is a, c, g, or t
acggcttgaaagggggtacaaggaaggcataagacaggaagggaatctagagtttaacctcctaacccttctgctagccctcaaggcttcacaatggtgactggggagctagaaaccttctatgactcaggctgaaggcttggggaaagccaagtttagatggttccttcttcctccaccccgatagtaccagttatccatggtctctcagagggtattcctatgctacccctagccctcaaagcataccatgtngctcaggag

SEQ ID NO: 548119 - DNA, 1004 bp, Homo sapiens
  misc_feature (766)..(766): n is a, c, g, or t
  misc_feature (806)..(806): n is a, c, g, or t
  misc_feature (831)..(831): n is a, c, g, or t
  misc_feature (840)..(840): n is a, c, g, or t
  misc_feature (952)..(952): n is a, c, g, or t
  misc_feature (964)..(964): n is a, c, g, or t
  misc_feature (970)..(970): n is a, c, g, or t
  misc_feature (973)..(973): n is a, c, g, or t
  misc_feature (975)..(976): n is a, c, g, or t
ttggctactagtctacgctggaatacgattgctccacggttggctactagtccacaggttggctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaggaaaatccacacatagtactgtataagtaacatgaaacatctctctcgcataagcctgcgtagattaaaacactgactgacaattacagcccatattacatcaaccacaggcattataccctactgcaaccacacagcatgctatanggaaggtaaaaaaaaaaaaactgagggggcccgaccaatnggctatatgagcgatacaatactgncgcgtttanacgtctgactggaaacctgcgtaccaactaatgctgagaaatcccctttgcagtgcgaataaaaaagccgaccatgcttcaacattgcaactatggaaggaattagcgtaanttgtaaatccgnaatttnaanannctttaacaagcaatggaaacttaattaa

SEQ ID NO: 548120 - DNA, 942 bp, Homo sapiens
  misc_feature (821)..(821): n is a, c, g, or t
  misc_feature (829)..(829): n is a, c, g, or t
  misc_feature (860)..(860): n is a, c, g, or t
  misc_feature (867)..(868): n is a, c, g, or t
  misc_feature (889)..(889): n is a, c, g, or t
  misc_feature (914)..(914): n is a, c, g, or t
ttggctactagtctacgctggaatacgattgctccacggttggctactagtccacaggttggctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaaccccanccacaggnatgcttctttagggaagggttagaaaaagangaaaaannacctcgggggggggggcccgnttcccatttggccctttggtggggnggttttccatttccttggcgggggtttt

SEQ ID NO: 548121 - DNA, 215 bp, Homo sapiens
tgcgaaaatgttaaaatttcgggcattgccgatcccggagggccagcccccttcctgatcggccccgggaatgggaaagcgggttcaggcagggcccgcaagcggatcacccgattcccgggcaccgctttttttaaacgactccggattcccgtccccgaaaagccatgaataccgcacaccgcaagaagctccccggcacctcattcgattat

SEQ ID NO: 548122 - DNA, 359 bp, Homo sapiens
  misc_feature (104)..(104): n is a, c, g, or t
ccggaaaatataaaggggcccccccccccccccgttttttttttttctcccgggcgaaaaattttatagggatgtgttgggggccgggggaaggaaatatcttngaaaatgggtggggaaaaaaaaaaattcccccccccccctgcccccccaagggggggtcccccccgggggtttttttgggaaaccccccccccaggtttttttttttggggttgggaaagggcccaacccccccccccccctttgggggcccccccccccttttttaaggggggggggccccccggatttttgtttttaccctttttttgccccccccccgggggtttttaaagcccgaaacccggggcccctta

SEQ ID NO: 548123 - DNA, 165 bp, Homo sapiens
acagcagagggtggtttcacggaaatagtgctacttctagatactttaagtagatatttcaacgctgtaataatattttataacataaactggaaagttaaagaataagcttttacaatagtcctcatacgtcaaggtcacagttccgaaagttacctgattcca

SEQ ID NO: 548124 - DNA, 421 bp, Homo sapiens
  misc_feature (221)..(221): n is a, c, g, or t
  misc_feature (375)..(375): n is a, c, g, or t
tctcttgaaacctatttcatctgatataagtatagctactcctgctctttttttgttttcattggcatgaaatatctttttccattcatttattttcagtctatttgtatctttataaatgaagtgtgtttcttttaggcaacagctcattgggccttgcatttttatccattcagcctctccatgtctttgtgttgtgtgtcacccaggccgaagtgcangtggttcaatctcagctcactgcaacttctgcctcctgggcttaagtgatccttttcttcagccttccaagtaaagtagctgggactacaggtgtatgccaccatgcccagctaatttttgtattttttgtaaagacaggggtttccctgttgnttgcccaggggtgggtcttgaactcccgtgctcaagcaatctgctt

SEQ ID NO: 548125 - DNA, 321 bp, Homo sapiens
gcgctctgaatcccaccctgtattgcttcacgaattcaaaacctttacctggttcttgcggttcgatcttcagaacaacgtgaccgtactgaccgcgaccacccgactgcttaacgaatttaccttcgatttcttcgcatgttttgcggattgtttcgcggtacgcaacctgtggcttaccaacagttgcttccacgttgaattcgcgcttcatacggtcaacaataatttccaggtgcagctcacccataccgccgatgatcgtctgaccggattcttcgtcagtttttacgcggaaagaaggatcttcctgcgccagac

SEQ ID NO: 548126 - DNA, 510 bp, Homo sapiens
  misc_feature (153)..(153): n is a, c, g, or t
catacaggtcccctggccatggcctcggtccagggatcccctttagggggttagggtccagttctcagtggaaaaacaggcccgaaaaagtgcgtgcccaacttaggcagatgtttccccagtggccccaaagccctggggtatagttttttncccccccaaagaaaaaccccctttttgggacatgggttggagggcaggacctaaaggccccaaaggaaggccccctttcgggggtgtttccccaggaggaaaggaaagggctttttgttcccccccgaaggaaaggggccttagttttggggttaaaccccccttttcgtgttttcccccccaaatggaaggtccccaaggttccctttcagttccctttccttaaccctgggggggcctttccgcccacccccccaaaggaccccccccccccttggagtgtgttcaggagttccgggcagggtgggcattttttcccaaggggggaaaattttccataaagggtttggcccttta

SEQ ID NO: 548127 - DNA, 207 bp, Homo sapiens
  misc_feature (26)..(26): n is a, c, g, or t
cctgcacagtccactctataggatancccaaatgtttagtgtgtggtgaaattcttgagagtaagtatcagcataactttgtgagttgtaattgcaagaaccagacgtttactgatggtggattggtatacaatcgtgtgggagcagttgatttagacttagttgagaatctatgcgaatatgctgaaatgactcgtggtgagcatt

SEQ ID NO: 548128 - DNA, 359 bp, Homo sapiens
ctctggaagtaagttgccctgaggagtgtgatccaacacagactgagtaccaaggaatgatgagatgtggaggagggcggtatgaaaggtgaggtctatccattggcatcgttgggatggccaacaaaggggatagcctgcagaaaaggggagagcgtcaagttccaattgtgtgtcctgggccaaacatgcacaacactactggcttacaaacatcacaccccctgcgcacgggccaccagtggacactgtgctgacacgatcagctttgcgcttcacttaacctatgaacgtaggcagactagcacagaagctctcttttccactgctgaacaccgcacgcctccagcgatggcact

SEQ ID NO: 548129 - DNA, 410 bp, Homo sapiens
  misc_feature (121)..(121): n is a, c, g, or t
aaactgcaggcatcagtacgtggtcccctcaagtccaagaaggaggagtaaaggcttggtgtttccctgccctccgctggcttctaacctgacccaatgcttactgcttccttggagcccnagactatccctctggtacttgggtttattccctacttccccaattttcttccatggcttatagatcattattttggcaccattacacatactgctcttataccaaaagggacctgattgttgtttattcagagtacttttgccactgttctgcctggctagggcactttccactcctggaagtgtagaaaagcactggtgacctggcctgcagtttgaacccctttttattttgcaatgtaccctaaaggaggctgctgtgaagcaggtcaactgttttatcctgaggg

SEQ ID NO: 548130 - DNA, 670 bp, Homo sapiens
ttgtccaacaataaacaggaattttattttgctgagttgttctaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacccaaaaaaaaaaaaaaaaaaaaaaaaaaaaagagaaaaaaaaaaaaaaaaaaaaaaaaaaaaaaaatttggggcctatttgccccgacgacctttaattttcgaaatgttttccactgccgccgaatttagggctcttttggcaaaatccccctatggggggggtctttaaaatgaatgggccggcttttaaaaacttagggttgggaaaaacctggggtggcccaaataaaatcgcttttagaaaatatccctttttgcaaagtgggttaaagccaaaagggcccccacgcggtggcttttcaaaaaattggccaaccctgaaggggaaaggaaaatttgccgggttaaattttgggaaaaatccgggtaaaatttttgtaaaaacccttatttttttaacaaatgggccaaaaggggaaaacccccttatagaataaaagatttaccccaaaaggggtttgtgtttatcccttttggaatggcccctttatgacggtggttctcaacatcgcgctttggg

SEQ ID NO: 548131 - DNA, 334 bp, Homo sapiens
agcaaccgtgcaatcactgaactcccaacaacaccaacaaacctcagggagtcactcgctacgaaatggaaaaaataagctcaatatcacaaccgaaaagtgacacaagatccataaaaaaaaaaccacatagaagaaatgcttgcattcttacagattcaagaggatcgtggggaaaaatccaaatcattttataagcatcataaacgtcacataaaaacaacctcatcatccaaaacaacccgggaaaacagagccgaatgaagtggtatatctgaaatgatgggcacacgtagcacagcatgccatatcaccatcccatatataatgtcac

SEQ ID NO: 548132 - DNA, 381 bp, Homo sapiens
tcaccagcatctctgctgttgactatggctctctggccaacagcgcttcatctagaggacagcttcacttggtacaacaacaagcttaccagagtacctggtgggctggcagagcataagtacatccaggtagtctaccttcataacaacgatatctctgtagttggatcaagtgacttctgcccacctggacacaacaccaaaaaggcttcttattcggttatgattcttttcatcaaccctgtccagtactgagagatacagccatccacctttagatttgtctacctgcgctctgccattcaactcgtaaactattagtaattctccagaaagccctcatttttataaactggcaaaatcttgttcattttctttgct

SEQ ID NO: 548133 - DNA, 221 bp, Homo sapiens
  misc_feature (22)..(22): n is a, c, g, or t
  misc_feature (54)..(54): n is a, c, g, or t
  misc_feature (64)..(65): n is a, c, g, or t
atgttatagaatagaatagatngaatagaacagaatagaatagatcagaacagnagagaacagnntagaatagaatagaatagaaacgaacagagtagaatagattagaaaagaatagaatagaacagaatagaatagaataggacagaaaagaatacaatagaataggatagaacacaaaagaacataatagaatagtatagaatagaatagacctcgtt

SEQ ID NO: 548134 - DNA, 270 bp, Homo sapiens
ctcgggagttcctaatgcttaaatacattttagttgctgccctcgcctgcaccgcctctttgctcgccgctagggacaccgcccaagcctcttggcattaccaaccccaaggcaaacgcatcaccatccagcaagccgccgccaacatcgctgccggcacgcagccgagcgaaatcactttcgccgagaaccagatgtttgtggagttcaccgattataaaactcccgccaactccacctacgggctgaccaccaccgtggccgccttcg

SEQ ID NO: 548135 - DNA, 309 bp, Homo sapiens
ggcacgagcacagtggaagaagacagcactgatgaccaaagagaagacactcatatttaagcctatttataatgcaaatttccatgccattcagggatttctgagtgtgggggccattaacgtcacttatgcccaaaaacccaaactgtcaagtggtactgctacaatggcagcatctgtgaggacgtcaccctcatgaaattgacaccactctgcctacattcttttctattagcagcagaggatagactacgaacaatttctgccaaagattagtggcaaaagatggcagacacaagcagtatggat

SEQ ID NO: 548136 - DNA, 408 bp, Homo sapiens
aggcgccgcgacctaccccatctccctccacgcttgtgggggagtgagtggggaaggggctttgggaaaggcggcgcgcgggcacttaggtgcattgtgagctttccggacttgacagcatcaaaggaaaattctggcgagcagccagggccagcgagcgaccccaacaacaaggaagcggccgttcgaaagcttccggacaagccaaggggattccaagggaacaagctctggcccacgggccacgggcgatgcacggagtggaaaagtgaacgtggtctacaggatttctgtccggaaggtggagagcgctacaggggaatctcctcgattcctgtccgtctcgtaacttggcaaaagctcgcgccactgccctccggcctgggcgacagagcaagactccgtctc

SEQ ID NO: 548137 - DNA, 684 bp, Homo sapiens
agggccttcaaggctctcatcgctgctcagtacagcggggctcagtgtcctgcgtgctctccgcaccaccccacttccatttttgtgccaaaccaacctgcacccctgaatttctccgcaaatttcctgcctggcaatggtcccatgcatttgatgtgtgtgatgattgtgattcttgtagtgttttgatgatgccaactgcctatttgccctaacatattgttgatgcaattgatgtgatgcttgctgtgtggaatgtacatccatgatgtgcatgcatgcccatgtgttggttgcatgttggtgtgatgcttttgcttgattcctgatatatgtgcccccagccatgtacctggtgtgttccccaccttgggcatcatgcaccacaacaaacagtgccactgatgaatgcaaatgtgaggaagttgaggcgaattcttgggtgctgcttggatgcttacttgaagacgatggactatttctggttggtgctgaactgagtgacattggcttgacatcacagttgtcttgcaccctgttgtgtgctctataagcagtgttctagatgccttctttcctgccagggcctttcccaataccaacctgctggttcctcacctgcattaaccagccccagttctgggcttgtcttgggcgaaggtgaactgtgtgagaagatggcca

SEQ ID NO: 548138 - DNA, 168 bp, Homo sapiens
  misc_feature (24)..(24): n is a, c, g, or t
gctgccatggggttgtagccccangatcttgccagtctgtatgcttccctagaggtttgagcagcggagtactaaagaagcaagccacacccccactccacctcctgtgagggggacaaggaaacttttcccatttcaactggtggctcgtctgggatctcggaagat

SEQ ID NO: 548139 - DNA, 207 bp, Homo sapiens
ctggaacacacgaacagtgaaggacagaaccttggaccacaggccattcctcaggatggcagtataacacatcagatttctagtgccgtaatcctccaaatttctggtccaggctttgtcaatagattcacagcgataaagcagtatgacagagtggctccagcgagacccaacatgctgcttcaacatgcacgcatgaagctatct

SEQ ID NO: 548140 - DNA, 2220 bp, Homo sapiens
cagttttagttgtttttaatgagctttctgagcttggaaaacatgtcaaaattgtgtgtagttaaaagcctctgaggaaagagtctaaacattaaaccttcccgactgtggttcacagcaaaaatgtccagtgtttaggagcactagctcagactcaaactgccccttcttagcagtttgatcttaagcaaccttaatttgatctcaggcaaattacatttctctgggcctccatttactcatttttaagaagaggatatcaataacctaccacattgggttgttgtgaggattaaatacacattgaaatattaagaaaatgcctagcacacagtaagctctcagtaaatacttgctattattttatattgacctaaatatgccctttcatcaatcagttatattcttgggcaaggtattttaacaaatcactggccacttggaagtggaggcaacttgcagaaaattgtgagcataccatggagttcctggagttgtgcagcacagtgctggctggcctctgctaactttgtcttaataacctcaatgctaaatccatcctaagtaaatttaaatcacatccttagacacactgtccattctcaaaccgaatgaaaaaaaaattccacaagaaacaatgaaatacacattaacattttccctctatgtcccttgaatgtaagttctcttaaaattttctgtatactgattttatatcaagaacacttggatgataaataaacattaaggtaaaatgtaataggcacttcttttggggggaaaaactatgaaaggaacaactttttatattgaaattgcatcagaatccagggtagcaaagttataacttcttgaagttatcaaattaaccacagtccaaagaatggctgttagtatcctttggctgaacagattactgtgttaattagaacacagttattagtggttcttaaattcaaagtcatataaattttagtttatgcttgcacttaactcactcagttaattttcaaacataaggttcgactcctgttattagcgacttgacacgttctgctgaagctctcacttttcttctaattctgaaagtacttttatacattctgaaatggcatttcagcagatggaaaaatgaaggtggcaaatcaggaccaatttcttatttcaaggttaaattaatactaaaccagactattaatgaaaacatcttcatcaaaattaactagagagttggtagttctctgaaactttgtataaattttatttattactgtaaatactaaaatcacattgaaaacaccttaaagttaagtcccaacccgattattagagaaaatcacttgggcatccagtccccttgatcgaacctgggtaacaaaagaggcaaaagacatgatttgtgatgaaacttactattcaaatgctaaatgttttcaagctttaataaggtatatatcaattccaagtaccaagcataatataaaaattcaaattcatgggtttactcttaataagcatcaaaagcaaattttgcgcactgaatcctatcttactcttgattggcacaatgcattcagagatgagttataattaggaaaaaagagtgtccactgaatgcatcatgtgtaaaaatgcaattaacatttcaaaaccacattaaaagggaaaatacctaaaaagttaactcttaataaaattatttgaaacaatattatcctgcagataaaaatacatttcttgtatatacatgtagatttctacatgaaagaaaagattcagctccaaatagaaaagggctgacccttgataaagacatcttagattgccaaactgatgtgattaccactgtaagaactaaaaacagaaggataaaaagattaagttaaaggaaggataaaagtttagtcaactgctcctgaacagtggcagagttgggtgagaagtgggagatgaaggcagaaataagacaaagaagaaaggcaaagaaggcttcaactctgattgaaaatgagtggagaatcaaacaaagttgagaacagatatgatataggtacagtgagatacttgaaactagaatttgatagttgatagttatagaagctcaattaaatcatcttgaagtggaattagacaaagcatctacattttaatggagaaccagtattacagtgaccaggtaactcggacaactcgtcggggatcctctaggtcacccagcac

SEQ ID NO: 548141 - DNA, 755 bp, Homo sapiens
ttggctactagtctacgctggaatacgattgctccacggttggctactagtccacaggttggctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaagccgccccaagttagaaagcggtcaaggtcataacctcttactaatccaacacatgactggacatctacaacccattgtaccaagtttacacttatagaaacataggtggttaaagacatggaacactcttctcccgttaggcccggtcgaatcacatgaacgggggttccctgccctttcctt

SEQ ID NO: 548142 - DNA, 94 bp, Homo sapiens
ggacttccggcgagcgggcaagcgggaaccaggtggccacccggtgtcggtttcattttcctttggaatttctgcttttcttttctaacaaggg

SEQ ID NO: 548143 - DNA, 775 bp, Homo sapiens
ttggctactagtctacgctggaatacgattgctccacggttggctactagtccacaggttggctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaggagggtacagccaacgacgacgaagatcccagacagacaacgtgaacgcctgaaagccaactggacgcaatctagtcagacctactagaagaacaaaatgtctagaagaaggaaagcatgtgaacagttttgactcgtgaagagatgattgcgatcatgattggtagattgtagat

SEQ ID NO: 548144 - DNA, 473 bp, Homo sapiens
tataaccctaatcgcgggcgatccctgtgattcctggtacgctgctgttgttccagctgtaccgcgtacagaccagcagcagggtggtgatgaaggcgaccgcattgacggcccagaatttgtatttgagcgagatattgctaagccaggcacccatggaaggttttctctgatagcggaaacggtattggcaaggtgccattattgtgccgctattcagaacagcgcttttgatatgggtcaatgcgccgcatcaatcgatggcaggcaagccgaaaaagcgccgggcgcacgcggtgttgtgcagcgcctggtcttccattgtttcgttaccggtgcaaggccacttccgcgcagtacttcgggcaggtaagcgggttcattgcgaccattcttcgggcttggggcgcagggtgcgtggaagcaggattagggcgcatcgtttcccagcattcaaagggcctcggggaata

SEQ ID NO: 548145 - DNA, 504 bp, Homo sapiens
ccagtgatgggtgcaaaaaggtaggaaaccgctgttattgtgtctattgctcaggctgctattaagatatttcccattagactgggtgtggaggttcatgaagcctgtagtctcagactactatgggaggcctgaggtaggaggatcacattgagcgtaggagtagcacgatctcggctcactggaacctccagctcccaggttgaagtgattctcctgccttggcctcccaaattgctgggattacaggtgcccaccaccacacctggctaattttttgtatttttagtagagacaggattttgccatgtaggccaggctggtctcaaactcctgacctcaggtaatccacccgcctcagcctcccacagtgctgggattacaggcttgagccactgggcccagccgctcactttatactatagctcttagcacatgtggaatatagtggtaataacttctcaagtgtctttacagattctataattcgtatcatttatcagt

SEQ ID NO: 548146 - DNA, 660 bp, Homo sapiens
ttggctactagtctacgctggaatacgattgctccacggttggctactagtccacaggttggctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaatgcaaaagtgcactcttctatatctacctttgctcagtgaagatgataataacctatggtatgttcattcctgttgtagaataaaagtttcaatctttccaagaatttttggtg

SEQ ID NO: 548147 - DNA, 729 bp, Homo sapiens
  misc_feature (68)..(68): n is a, c, g, or t
  misc_feature (140)..(141): n is a, c, g, or t
  misc_feature (191)..(191): n is a, c, g, or t
  misc_feature (206)..(207): n is a, c, g, or t
  misc_feature (271)..(271): n is a, c, g, or t
  misc_feature (283)..(283): n is a, c, g, or t
  misc_feature (309)..(309): n is a, c, g, or t
  misc_feature (313)..(313): n is a, c, g, or t
  misc_feature (341)..(342): n is a, c, g, or t
  misc_feature (367)..(367): n is a, c, g, or t
  misc_feature (382)..(383): n is a, c, g, or t
  misc_feature (416)..(416): n is a, c, g, or t
  misc_feature (441)..(441): n is a, c, g, or t
  misc_feature (462)..(462): n is a, c, g, or t
  misc_feature (620)..(621): n is a, c, g, or t
ggacgttccgggagcgcggtgttagcgtcggcggtttgggcatggcgactttttctggcccggtggcnaatcctgtcgcttaatccgagaaagatgtcgagttcaaaaggaggtggcgcaggttcgcaagcgcataaccnnagcgaaaaaaacaagaacaatttactcctggagtagtctatgtgcgccanctacctaacctattnngaggaaaccagatctttcatatttctcccagtgtgcactgtgacacggttcaggctgtccagangtaaaaggatgnaaatagcaaaggctatgcatttgtgnagtngagtctgaggatgtggccaaaataggtnntgaaacaatgaacaactacctgttnggtgaaagactctgnngagtgtcattttatgccactgaaaaagtacatnaaagaatctttaaagactgaatatnccatttaagcagcatcatatncatcagtgaaacggtataatccggaatcggacactaacacaaaagctaggatggaggagcgatttacaagaaagaaagattactcagggaagaagtagttaaaaaggaatggactatgattttccttcttggattaacgaaaggaagtatttaaaaanntaatcgtcagacgtctacaaaggccgtttcgtagaggaggaaaaggtttcggatctcttggatctgtgaaatgtggtggcagggcccacacgtgggtccccatttttg

SEQ ID NO: 548148 - DNA, 673 bp, Homo sapiens
gggagcttgtacgtgatgagagcagcttcgccaacccctgcaaagtgactctgaagaagacgacaagccctgctccagtcacacccagaagctgactggtccacgcatggccgaagcatgaggaaactcatcgcagaactcattttccttaaaatttggacttgtatagtaaggacttcaactgaccttcctcagaccgaaggctgttcccagtgtatacatcaagtcactgaggtaggatgaaaggttgctacggtcctattattttacggttattataagtgtacgagaactctaaaaaaacttatttgtataatgttattctatacaaggtatgtagcccaggaaatgaccaacctgatgtgttttatgactcatctgagcctcccatgaccacagtttttaaaataagattaaagatctcataagtgggatctaattaaactaaagagcttctgcacaggaaaagaaactatcatcagagtgaacaggcaacctacagaatgggagaaattttttgcaatctgcctgtctgacaaaggtttaatatccagaatttacaaggaacttaaacaaatttacaagaggaaaacaaacactccatcgagaagtgggcaaggatatgaacagaacttccccaagaagactttgctgacaaaaacatgaaaagtca

SEQ ID NO: 548149 - DNA, 700 bp, Homo sapiens
  misc_feature (525)..(525): n is a, c, g, or t
  misc_feature (533)..(533): n is a, c, g, or t
ttggctactagtctacgctggaatacgattgctccacggttggctactagtccacaggttggctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggtgtccagatagatctagttcactttaattgccacagacctctaatccctgtaattactgtagtcaagggacagcttttgacactagaaaacctgttaggagtaaaatttacaccntgtggctnaagcgccccattaaaaggtttagttaaaccccttctaaaaattccacatatattgattctaaccccttgggccaattaacctatataaacctagttggtaaggactgtaaacactttttccataaactttgtagataaaacacttaatggcatacaacccaaatttc

SEQ ID NO: 548150 - DNA, 163 bp, Homo sapiens
ctgcactctatcttcatgtatttaggcatctagtgatcccatatctattgtgaacagtgctgcagtaaacatgggtgtgtaatgtttcttcaatactgacttcctttccttttgataaagtacccagtaaggagacagctggctcatacagtagttctatttg

SEQ ID NO: 548151 - DNA, 697 bp, Homo sapiens
  misc_feature (378)..(380): n is a, c, g, or t
  misc_feature (382)..(384): n is a, c, g, or t
  misc_feature (389)..(389): n is a, c, g, or t
  misc_feature (407)..(407): n is a, c, g, or t
  misc_feature (410)..(411): n is a, c, g, or t
  misc_feature (427)..(428): n is a, c, g, or t
  misc_feature (435)..(435): n is a, c, g, or t
  misc_feature (438)..(438): n is a, c, g, or t
  misc_feature (441)..(441): n is a, c, g, or t
  misc_feature (538)..(539): n is a, c, g, or t
  misc_feature (546)..(547): n is a, c, g, or t
ttggctactagtctacgctggaatacgattgctccacggttggctactagtccacaggttggctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggctagnnngnnnacaanaccctcccgaggcctggntgnntagctgggttggtccnncgaatanaantcnttagcttcaagcttttagaatgttgccctagcagaacccgtcttagaatcgcccattgttaacatttatactggttagctcccaaacgaggcaacanngctcttnntggacacgtaggaaaagaacccttgctagcagcagagtaaaacaatttaacaacccattagtaggcgctgcagccaccaaattacagaaagcgttcaaggctcaactaaccgactaccttcttatcagcccttatacgaagctttggttg

SEQ ID NO: 548152 - DNA, 557 bp, Homo sapiens
tgacgccgttgtggctccgtgacacggatacttcctctccatggagacgatgacaaggggcgcctcatcggctggacgcgggctcccataagaccgtgcgcagtgccgtctggacctgactggcagtggcgggcacaggttccaagcccagcgccgagatgagctctaggtccaggtgatcgactgcgaaggaggtccatggacaggacagtacttgcccagagagcagagcgaggagcgttgtgggcagggactgcgagatccgtgtcgagacttggctagcaatcttggtgatggcctgtctgctctctggagctgtctgtcatcgggagaaacacgtcgggagatggatcccattccctaaaggtctcacagcaaaggagcaggactcccaggcccctgtaccctgcctggcctgattcagggccttgtggcccccagcttctgttttaagctgggcagaccccaggatcccttccctccctaaggactcagctgaggggcccctctgcccccttctaactccacctcagaacccccccccggcataaggtggg

SEQ ID NO: 548153 - DNA, 778 bp, Homo sapiens
  misc_feature (618)..(618): n is a, c, g, or t
ttggctactagtctacgctggaatacgattgctccacggttggctactagtccacaggttggctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaaaaaaaaaaatanaaaaaaacggccttccacccccgtcgcctccgccaagcacactataatctaaacaaagaatatccttccaatactaaatatggagttaatattaccaattttccccatattatacctcaacaaacaaccgagtcctattactaaacatatcaaacactca

SEQ ID NO: 548154 - DNA, 693 bp, Homo sapiens
  misc_feature (552)..(552): n is a, c, g, or t
  misc_feature (584)..(584): n is a, c, g, or t
  misc_feature (606)..(606): n is a, c, g, or t
  misc_feature (629)..(629): n is a, c, g, or t
  misc_feature (638)..(638): n is a, c, g, or t
  misc_feature (648)..(648): n is a, c, g, or t
  misc_feature (679)..(679): n is a, c, g, or t
  misc_feature (682)..(682): n is a, c, g, or t
ttggctactagtctacgctggaatacgattgctccacggttggctactagtccacaggttggctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctnaaaagcagcaccaataaggaaaggcgtcaagntcaacacccactacctaaaaanttcccaaaccattttaccttggncttccttanacccaatttnggcccatttttttaccctttttgggggcctnatnttaggttaggt

SEQ ID NO: 548155 - DNA, 415 bp, Homo sapiens
taccgtttatttgtgttggtacaggaagaaatgagcttcaataatcattagagtgacgagcagtgattactttaaaatctgagttctggccaggactcacgcctgtaatccccgcactttgggaggctgaaacgggcagatcatttgaggtcaggagttcgacgaccagcctggcctacattgtgaaatcctgtctctactacatacaaaaatcacgctcctgtaattccagcactttgggatgccaaggtgaatggatcacttcaggtcaagagttcatgaccagcctggccaacgtggtgaaaccccgtttctgggaggtggaggctgtagtgaactcagactgcgccactgtactccagcctgggccacacagtgagactgcaggccactgcgtgctgactctctcaccatg

SEQ ID NO: 548156 - DNA, 484 bp, Homo sapiens
gcccgttccgggtgctgaagggcgagctggagctggcccgcaatgacatgatctcgtcagtcggacctgcattatgaatcggcagggtgaggatctcgagtacggtccaagacggaggacgggctggcaggacgggacgcacgacgcaaaggtatgtatacggacccagcgcagaggatgaaaggtgcgcgcaagagagcgactcacgacagatggcggtatggactgatgcagcggaaggaaactccggggcatgggatgcgcctggttacgcctgcagagtccgaagccatgctaagtgcatacctggatagcatgaacggcatcgacgacgctgggtgacccgcagaggtaacacgaggtagccctctaggactacgtcacgcgcaccacacgcagcaaaggccagcgcttagtcccgagtatacaggctgtgacacaaatctcactggacggcacgcggccacagcgaggatcgcagaac

SEQ ID NO: 548157 - DNA, 373 bp, Homo sapiens
tttcacggaaaacatttaaacatcataaaagatgtttgagccgacataaaaatagacagaagtatcttattaggcaaattcaaatttataaccagaaaataattgtggagacttatttttggactctgtagttattggtgtatcatacacaagccaacatttctgaccactagtttctttatctgtgagcagaaatgcctccataagatacaaagaggactcctttgaaagactgacagcttgttatttgatgggtggttggaccttacacagtaatttactgggctttggacattgttcgagggacaaaactcttggggcttatgatccacacctccccacatttttggaattcttttttaaaaacggaaat

SEQ ID NO: 548158 - DNA, 316 bp, Homo sapiens
gctcgacgctggagtcagttacaatcaaggaaaactcagttttttggcctgagaactggaaggatggagttaccataaacgaataactgcaatgaggaaggccaaagtggattaaattgtcctggccaacatagtgaaaccccatctctactaaaaatacaaaaaattagctgggcgtggtggcgggcacctgtaattccagctgctcaggaggctgaggcaggagaatcgcttgaacccgggaggcagagattgcaatgagccaagattgcaccattgcactacaacctgagcgacaagagtgaaactccatctc

SEQ ID NO: 548159 - DNA, 492 bp, Homo sapiens
  misc_feature (16)..(16): n is a, c, g, or t
  misc_feature (28)..(28): n is a, c, g, or t
  misc_feature (123)..(123): n is a, c, g, or t
  misc_feature (264)..(264): n is a, c, g, or t
  misc_feature (283)..(283): n is a, c, g, or t
  misc_feature (327)..(327): n is a, c, g, or t
  misc_feature (346)..(346): n is a, c, g, or t
  misc_feature (355)..(355): n is a, c, g, or t
  misc_feature (374)..(374): n is a, c, g, or t
  misc_feature (396)..(396): n is a, c, g, or t
  misc_feature (406)..(406): n is a, c, g, or t
  misc_feature (464)..(464): n is a, c, g, or t
atctgagcaacagcanttaaccctagancttctgtctgacagagcctacccaaatgagaagaaaccagaaaatcaactctggtaatatgacaaaacaaggttctttaacacccccaaaaaatnacactagctcatgagcaatggatccaaaccaagaagaaatctctgatttacctgaaaaagaatacaggaggttagttattaagctaatcagggagtcaccagagaaaggtaaagctcaatgtaaggaaataaaaaaaacantcaaaacttcaggaaacantggacacacttatagaaatgcaaaatgctctggaaagtctcagnaatagaatggaacaagtanaagaaaganattcaaagcttgaagacanggtctttggattaaaccaatcnaacaaagacnaaaaacaacaacaacaaaaaagtatgaacaaagtccaaagaagtctgggattatgttnaatgacccctaagaatattggtggttct

SEQ ID NO: 548160 - DNA, 116 bp, Homo sapiens
atgtatcatcgcgttagaagtatatactttggaagtctcaatgaagagcaaatttaaatattatgtgcattgtaaatacagtagctataaaattttccatacttctaacgcgatga

SEQ ID NO: 548161 - DNA, 276 bp, Homo sapiens
ggtaccacagcctgcttgctcagtgtcttgcttttgacaaacgagggaggacaaaggcgaaagtgtctttgtgctcctgtcctcctggagaactgtccttgtctttctgggggacctgtccttgtcctacctgctgggccaggtgagctgcccattgcgacgttgaggctgggcccccaacactggcacaggtggcattggcttgggtcctgagggctgtggtgtttatctcggccgctcctccggaatcccttctccaagggtacccacagcctg

SEQ ID NO: 548162 - DNA, 163 bp, Homo sapiens
gcttactgcttgctctttcaaccggctcttcttcacagccatgttgttcctctctcggcgttgcccatactcgtcaatatatcgatccatgggcgaactctttaagctctgcttgctgggagccacagctttgcctcctcccccagaggccagcatggcacca

SEQ ID NO: 548163 - DNA, 151 bp, Homo sapiens
ttttctatagtgtcttctaacaagattaattccacaaagtgatttgaagttaaaagatacgtgatatcttctgtggctctcatcatactaagtacatagattaattacttgttgactgctttgagactatcagtattatgggggtatagaa

SEQ ID NO: 548164 - DNA, 345 bp, Homo sapiens
aagaggcatttatttataaatacccttgccccccattactatcttaagaaaagcagttctaggccaggcaccaggtgctcatgcctataatcccagcactttgggagtctaaggtgggaggatcgacttgagcccaagaggtcgagatccagcctgggcaacatagttagacccattgcagcaaaaaatatatatattagctgggtgtggtcgatacgcctatggtaccagctacttgggaggctgaggtgggaggatctcttgagcctagaggttgaagagccatgattgctgtgatcgcaccactgcactccagcccagacgacagagcaagaccctttctca

SEQ ID NO: 548165 - DNA, 1079 bp, Homo sapiens
  misc_feature (772)..(772): n is a, c, g, or t
cgtgttggctgccagctcgccgcctgcagggcctgccacctgccgcgctgctgcctggccctcgtggtggcttgcctgccacctcctgaccctcgcctgcctgtgtgcttcactgcttgcctgcctgcctgtgtgatgtgcatgcctgtgtgctgcctgtgcaccgatgtactgagtcagaacgttctggaactgtgaccccctgtgtggctagcaagcctgccatgctgccatcatgtggtgcctgcctgatgtgagttgtgtgtgctcttgcatgatgcattgccttgcccgaacacctgtgtgcagcattcagacagtgacgatgcacacctgtgaccagtgcaatgtgatgcttgttatcacccatttcacgactggatgtggttgtccaagagctcacatggtcaaacaaacgtggtcatgatgtaaacacaagatatattacatgggttcaagccaacgaacacagttatggcccatacaagacaacaaagtctgaggggatgtcccaaacaataacacaagcttcagtgggagtcagccattaattggttgtgcgggaccaaaatggcatggcttggaagggttccccaagccaagaatggtgccgttttcccccccttagctaacagtttgagtgtcgcgtagttcgaaccaattggagaagcaaagaactgtcgtggcagggtccttcagagctgcatacaaagatgttcaagttccaaaccccatgccctcggtgcccccccggtggttctccaacgctggnccccagagacacattggggcacagtaccccgaaggagacacccaaagaccaaagattctcaacaacgttacattgtttgaccaacctcggggctcagtcagttgggcgagccagagcgcaggacgggatcagtacccgaggggggcctccttggacacttatcccaacacatgactacaggacgcggtgcacaaccccccatgtgtgtgaggaaagaccccccacagccaaccagtttcccctcagagttgggcagtctacacagaggcaagtcccctaccgagtaaggactcccaattaatcatcc

SEQ ID NO: 548166 - DNA, 354 bp, Homo sapiens
caaactcctctcttaccacccgcagctgaactcctctcagcgttcaggtgttcctcatcttctcactttctctgccatgccgttctgctgtttgactgcttttctcttcatctcttcatctgctcctggagcctggggtttggggtttatatgggtacaggatacgggggtgtggtgggccaaagggcaactttttgggtacgaaaacagaaatgcctgttcccagttagggccatgggtctccaggcttgagggtggggcctttgctggggagccgccctcttctatgcagtatttccctgtctcttttctatatcaatacctcaataaaatttagttttaaaaaataaaaaa

SEQ ID NO: 548167 - DNA, 161 bp, Homo sapiens
  misc_feature (21)..(21): n is a, c, g, or t
  misc_feature (94)..(94): n is a, c, g, or t
  misc_feature (111)..(111): n is a, c, g, or t
  misc_feature (132)..(132): n is a, c, g, or t
  misc_feature (136)..(136): n is a, c, g, or t
gaggcaggagaatcgcttgancccaggaggcggaggttgcagtgagctgagatcatgccattgcactccagcctgggtgacaagagcgaaactntgcctcaaaaaaagggngggggggcaatgggaaaccantgantcgtttttagcaggtggtctgattt

SEQ ID NO: 548168 - DNA, 396 bp, Homo sapiens
atggcagacagcggtatgcgagctacgccaatggatccgccgcttcgctccaaagatgcgataatagctggtacgatcgcactcgtcgcaggagtgacagcgggcggcacagggctcgtcggtgaaggagtcggagtaggagagggcgcaggtgtcggcgtgggcgttggagtgccgccaccaatcccgccgcctacgccgccgtcatcatctcgtgctgcggttaggctcattggatgtcacctactgggtcactagaagtctgcgtttgcactgaacctgtattagcggtgtcagagccagcggctgtctgactgctagtgtaagctacttttgcggtctggcgtacttccctcaagccaatttcaacagtcaacatgcttgcgccttttgacg

SEQ ID NO: 548169 - DNA, 318 bp, Homo sapiens
gaggtcccctcacgcttcagcttaagaacacctctttccaggtgggcgtggggactcaggcctgtaatccaagcactttgggaggccacggcaggcagatcatgaggtcaagagatcgagaccatcctggccaatatggtgaaaccccgtctctactaagaatataaaaattagctgggcacggtggcacgtgcctgtggtcccagccattcaggtggctgaggtgggagaatcccttgaacctgggaggtggaggttgcagtgagccgagatcacgccactgccctccagcctggcgacggagcaagactccgtctc

SEQ ID NO: 548170 - DNA, 199 bp, Homo sapiens
tagaggatccccccgcgtgatgcagcgtgcgcggtcttttctttcaattggcggagggagaaatgatcgaggtgagcataggtgtggataatgctcaccaacttcagtcccagctgcatcaaaggcgcgcaaggatcaactcgtgattgcaccggggtcgaccacgatggctatattaagtgatcgggtcgccaaatga

SEQ ID NO: 548171 - DNA, 713 bp, Homo sapiens
ggggacagctgcggcagccggcggggggcgtcctgagttggcggtcgagggcgctgccagctcccgaggggccgctcgggccccttccggcccgggtctggttgggccgcaggagcagggcgggctgcggcgcccgggtctggccctggcctacgggctaagcgcccggccccggggccgcggatccggcagccatgtgtggattcttgaagcgccatgtggtcttctgaacgcgcatttgaacagattcgtacaagcggccttcagtattgcaagactgatcaaagctgcttcgtagccccggaagcgcttaggcatctccgaagtagcgctgggcaaagtgaaggcttcctgatctcagaagcacgttgtgggcttggcaaacccgacgcgcagcccatattcaggtttcaaaaattaacacatgggcattccgcttttggactttctccaacacggttaggcatctctgaaaccttgagaactgtgcatgggcagtggaacgaagagggaaaggtgcccatggcgtccgagcaagagcaggtcaagcacaacaggaagcaagaacagacagagaaacgaggatggtaccccacacgaacaatacagtcctgacccacaaaggcgcaaatatgaggcaccacccctatatacccaccgacagacgaacaggcacccctatgatggaaccagatagggaccccacccagacc

SEQ ID NO: 548172 - DNA, 473 bp, Homo sapiens
  misc_feature (439)..(439): n is a, c, g, or t
  misc_feature (467)..(467): n is a, c, g, or t
gtcgacgggaagatggagcctccgttttgaacatacctggctcccaggtagcccttttctgttggcacagctgctggcattcacccgtgcaagcttccagcttgcttgtctatgtttgcagctcgatttttcaggctgctctttgttagaaaagaataacttcttgggctactttttgttagaaaggaagccttgccaaggactcttctaccctcactatctgcctaatttctttctatctcctgtatcaaaaaggtgaaagttcttgatttgataaggaaagaaaaaaaatccatatgctgaggttgctatgttctctggtaaggacgaatctgctgggtgtgatggtgctcgcctgcagtcccagacactcaggaggctgaggcgggaggatcccttctgcccaggagttcaggtccaacagacaacattgagaccncatgtctggaaagaagtaaataaatganataaca

SEQ ID NO: 548173 - DNA, 243 bp, Homo sapiens
atgcagaaaaccaagatattaatagacagcatgaaggtgctgcacaaagaatatcatctgtgtaatgaataacataacattggggaaattaatctcttactggctttaatatgcatcccacataatattgacaaatgtagggctattaagcatacttgaggtaggactttcaatggtaagcgtcgtcaggagtgatgttgttagggctgacagcagcaaattttcaagtctgagggcacgatg

SEQ ID NO: 548174 - DNA, 245 bp, Homo sapiens
  misc_feature (41)..(41): n is a, c, g, or t
  misc_feature (160)..(160): n is a, c, g, or t
  misc_feature (197)..(197): n is a, c, g, or t
caacctccaatattaccccactacagcaaaggggaagacanaccccgcctatggtacactgtctatgtaagcacaacttagaaacaacttaactgcctgcagcatcagaccaagttcctggatcataagttggaaaggggcttccaaataacacttctanatatttccaataatatctactaatttctgttaaccanctatgtttcaactccacttcaataaaaacagccaaatttctctcctgg

SEQ ID NO: 548175 - DNA, 277 bp, Homo sapiens
tgatatttttttcgtatcaggtcatctcgttcgttgctgtgatcttatttagtcacgtagtgtgtggggcgacattgtgcataagcttggggatactgagctcgaatttttggtcattgtctttgacttgtttcctgtgttgaacattgtcatcctgcaagtgtagtgttgagcagtgatggtaataatgacttgttggctgagtgtagatcttgggctgtcaattgtcagttcagtgtaataatctgacgcaggcttatgcggacacgaatgttca

SEQ ID NO: 548176 - DNA, 197 bp, Homo sapiens
tctcccctgcgctgcgaccctccggaaccgctgtttggctcctctctttcggctcagctctcggtcggagtttccttatcagtatgacttttctcgcaactctaggataggctgtgggagttcagggacatgtccatagctacttattgttaatgcctttaacgagaagttaactcttaggttgagcacggaccgga

SEQ ID NO: 548177 - DNA, 565 bp, Homo sapiens
cgtcatctgggtgacgacaaaagggtgtcgtccggcacgcgccatccgggtagatgcgcaccactttaccttgcagcttgtcaggtcctgggccgtggggcggtcgttgttctccccgagagtcacgaacaggtagccatcacggtcgaaggccaggcgcgagccgaagtggttgccagtagacagcttgggctcctggcgcagtatcaccttgaagtcttccaagccgctcaagtcggccgccaaacgcccgcgccctacggctgtaccggccttgcggccctcgccagcgccttcggcgtacgacaggtaaaccaggcggtcttgcttgaagtctggcgacagcaccacatccagcaacccaccctgcccttgggcccatacctgcggcacgcccttcaggggcgcagacagcttgccgtccggggcacacaaaacgcaggttcccaggcagtgcggtcaccaggaaaccttgcgggtccggcaaaaacgccagtgcccacggatggtcaaggccctgggcaaccggcgtggcggagatgctgccttgcccgctggggaactg

SEQ ID NO: 548178 - DNA, 90 bp, Homo sapiens
caaagggagcaaaggcacctgcctttattgggggccatgggctgcctgatttcattcaaaggccacacatctgatcacgacctgccagtc

SEQ ID NO: 548179 - DNA, 163 bp, Homo sapiens
catcacaatatattacatcaatcatgtgtcatgtcatgtatatattatcttttatatagtaacataagaatttacatacacaacatttattaaaatataaatatatatggaaaatagctattagttctttttctaatctgggtagtcacagactgggtagtca

SEQ ID NO: 548180 - DNA, 613 bp, Homo sapiens
  misc_feature (47)..(47): n is a, c, g, or t
  misc_feature (150)..(150): n is a, c, g, or t
atcccatgcccaaaacgttgtaaccaaattttgccccaaaaagattntcccaggcttagccaccgccatacgccggagaaccgtgcttaagaggcccactatggggggaaaccatttcattctcaaaaaaaatttttttttcctcttctncctgtttatcagtagttctgaatgttagatattttttccatggggtcaaaggtacctaagtatatgattgcgagtggaaacataggggacagaatcaggtattggcgtttctccacgttcatttgtgtgtgaatttttaatataaatgcaagatggaaagcattaatgcaagcaaaatgtttcagtgaacacatttcaacagttcaactttataacaattataaataaacctgttaaaattttctggacaatgccagcatttggatttttttaaaataagtaaatttcttattgacggcaactaaatggtgtttgtagcatttttatcacacagtagattccatccattcactatacttttctaactgagttgtcctacatacaagtacatgtttttaatgttgtcagtcttctgtgctgttcctgtaagtttgctattaaaatacattaaactataaaaaaa

SEQ ID NO: 548181 - DNA, 196 bp, Homo sapiens
cgacactgccgatgggtggggttcggtccagtccttcagagacgtcttttgtttgttgggttccatggaattgaactgctcacagaggtctccatcaagtcacacttcttcacagggtaagtagtacggagcgaaagtctgagagtggtccctgcccacagtagagggggactgttcagaaccgcagggtagcatt

SEQ ID NO: 548182 - DNA, 154 bp, Homo sapiens
gtctagagatcccccttctctgcccggccgcacagcttctcctaaagtggtttcagacttataagaaagttgcaatggcaccgactacagacatttctagtgtggctttatttacatcacagctaccctgtatccgaaccaggacggtggacag

SEQ ID NO: 548183 - DNA, 276 bp, Homo sapiens
atccccctctctccacacttctcttcacactggcacattctctctcggtgcttccctcaagcctctctattgtcttatctggaaataggagcatgttcattctcatccccaggtgtatcgagatacttgtcatcggcatcaggcgtactgcctgctgttagacaaatggcgctgccacacacggccatgcagtactcttctgtgtcaaagttgttccggttgccgccacatccgccgtaaaagaatggggcacacttcccttcagtcacatcaaag

SEQ ID NO: 548184 - DNA, 1021 bp, Homo sapiens
  misc_feature (37)..(37): n is a, c, g, or t
gaacggctaggtacgaggctgggtgtgtaatcggccngatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcgaaaaaaaaaaaaaaaaaaaaaaaaaaaaaaaaaaaaaaaaaaaaaaaaaaaaaaaaaaaaaaaaaaaaaaaaaaaaaaggggggagagcgaataaaagacaaccccaggaggaggacacgaacacatgacggccgacccaacgacagttgtcgtgttaagcaaaaagaaggagtcagcgccacagaagagagataggaccgactgaatcaaataggaggaaggagggagagccaaagtaaaaacacaggagcaggggagagagaaacaaagaggcatcgagcggagccatctgtgggccgaagaagacaaacactcacattgcgaaggtagcacaaaacatgggcgaaacaacacaccgaagggaaaagtaccgagcacgcagggacgacaaataaaccaaacggcgcgagataagagggaaacaccaacgcgaacaagagcgaccagcaagacgactgcgatgaagagacat

SEQ ID NO: 548185 - DNA, 952 bp, Homo sapiens
  misc_feature (844)..(844): n is a, c, g, or t
  misc_feature (848)..(848): n is a, c, g, or t
  misc_feature (851)..(851): n is a, c, g, or t
aacacgcaaggtaaatgaagctgaggtcgcggtcgtgcttatttcaggggtgtcttattgcgccctcgaccgctgaggccgtgtctcgtcaggcgtgatgaggtgctccccggggggtccgccctgtgggtttttccgaggtgtcagaattcatgggttaacaatccgccgggggcgtcccggtttgggggagtttacagcttatatgcccggcccttcccgccaacgccttcccaccaagagggccaggagctcgtccgaattcggccacgagctaggtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcgaaaaaanaaanaanaaacccaaaaaaactttttggggcccgctggggcccccggaagaaggtttttagaaaccttgggttgggcgccggggccccagtggtatacgggcccctgg

SEQ ID NO: 548186 - DNA, 362 bp, Homo sapiens
  misc_feature (106)..(106): n is a, c, g, or t
aagtagagagacatgatctgacctacattttcaaaagcttactctggctattgtgtggaagtagaagcaaaaagaaattcagtcttcccttatgatatttgcactntaaatagaaaaaaaaaaaaaaaaaaagccccaaaggggcggattggcccagggccttgcgggtaaaaatcctgggggcgggaacatactctccattgtcagtctgacaataagttcggcacggtctatatttcacccccatttgcctagaggtgctggatggcccattattagattcccatgggacacagtcagctctttcggagaaagggcagcccagcatttcccattgagacccgcgcttcttttggcaaaaa

SEQ ID NO: 548187 - DNA, 553 bp, Homo sapiens
cgacccacgcgtccgcggacgcgtgggtcgacccacgcgtccgaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctc

SEQ ID NO: 548188 - DNA, 756 bp, Homo sapiens
gcggccgcctactactactaaattcgcggccgcgtcgacggttatcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaatagaccaacaaccaacaccagaccaagcgcccagccacacccgccccacaccaccgaccgccacccaccacacctcacaccgccaaacacaccaccgctcgcggcgccaccccggcaccccgcacgacgactcacacacacacccgaggggcggcgcgccgaccaagtgtacacaagaccgcgcgcacgacgcgggcccaagcacaccccgcgccaacaccgcgggggccctcccgaaacagcgccggg

SEQ ID NO: 548189 - DNA, 869 bp, Homo sapiens
gcggccgcctactactactaaattcgcggccgcgtcgacggttagaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcgaaaaaaaaaaaaaaaaaaaaaaaaaaaaaaaaaaaaaaaaaaaaaaaaaaaaaaaaaaaaaaaaaaaaaaaaaaaaaaggggggagagcgaataaaagacaaccccaggaggaggacacgaacacatgacggccgacccaacgacagttgtcgtgttaagcaaaaagaaggagtcagcgccacagaagagagataggaccgactgaatcaaataggaggaaggagggagagccaaagtaaaaacacaggagcaggggagagagaaacaaagaggcatcgagcggagccatctgtgggccgaagaagacaaacactcacattgcgaaggtagcacaaaacatgggcgaaacaacacaccgaagggaaaagtaccgagcacgcagggacgacaaataaaccaaacggcgcgagataagagggaaacaccaacgcgaacaagagcgaccagcaagacgactgcgatgaagagacat

SEQ ID NO: 548190 - DNA, 395 bp, Homo sapiens
gcggccgcctactactactaaattcgcggccgcgtcgacggttagaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctc

SEQ ID NO: 548191 - DNA, 170 bp, Homo sapiens
ggatttttttcccctaaagcaattttttttttttggattaaaagaggaatggcaaggggaacccggtttgccaaaaaagagggtcgagttgatttgaagggggggcggccggatttaaacccaacccctgaccccttttaaagaccaataaaacattttttcccggccca

SEQ ID NO: 548192 - DNA, 420 bp, Homo sapiens
gcagccacctggcactcccacttctaagcttacgcccctgatcggcgcactgcgatgcgctagcccaaagcatctcttatgacgtcaccctagccatcattctactatcgtcattactaataagtggctccttttccctctccacccttgtcacgacacaatgaacacctctgattgactcctgccatcatgacccttggccattcagtatgattcatctccacactcacgcagagcaccatccgaacccccttcgaccttgccgaaggggagtcggaacgactctcaggcttctacatctaatacgccgcatgccccttcgccctattcttcatagcctactacactatccttattctcaccagacctcctaggcgacccagacgcttataccctagcctaccccttgtacacccctcc

SEQ ID NO: 548193 - DNA, 365 bp, Homo sapiens
gcggccgcctactactactaaattcgcggccgcgtcgacggttaaatcaaagcgttatctgtcaaagcaattataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctc

SEQ ID NO: 548194 - DNA, 1146 bp, Homo sapiens
agcccggggcggcgttcccccggcggtttgagtaggcggccgggggggatacccgtttttctcccgggtgcgcgtgttggcaccccctggcccttgtttggggggcgccttatgtgaccccgtgggtgccccccgcacaaccgggcgtgtgtcgcctcctccggcgttttccccgcggggtattttggggaggcccagcgggcgtgtgcgagcgctcttgcgggtgtgtgcccccctcctctagagggcgctttttgccctcttgggggggtgtgtaggtgtcctcggtggaccgccgctgtttgcggaacaccctcgcgccccccgcctcgattgtttgtgttttgtgcaccctttttttggccgccctctcggggagtaatttgaccccctgtgtgtgaggtgtttcttgttgtccccgccgcacctctgtctctctgttggctcttcttttttgccccccctcacccctctctctctcttggcgcgctccttttgtcacatgtactacacaccgcgaggtgtgtgcaccgtgattcctctcctcctctttccgcctcccactctcccttgtggcgcccccccgcggtgttgttgagcctctctcgggggtgaccccgcgcttcgcgcggcggggtgatatttttttcaccctcctcccacaaatttcccccctctttttttttctgtgagccccgcgcggcgacgccgcggagactccctctctgtgcctgtgtcccacctcgcggtgggtgagttctcccgcgctttgtagaccccccctctcttcgtatataaataataacctcctcccacaaatactttttgcacctctctcatgtgggggtggtccccccacactgtgagggtgttataaaacacacaagagccactttctcccgcggcgtctttataacaccacacaccacctcttttcccgctcacacaccgccccgcggggggaataatgcgcgtgtccaatagttttgtgataatattgtgggggcgcacacaccacccgtttttatagagcccctctgtgtctcctgagagaggagaatattcccctctcaaatatattttgtaaatagagggcccgctttttttccctcatgtggccccccctttcccccttttggggccaca

SEQ ID NO: 548195 - DNA, 301 bp, Homo sapiens
  misc_feature (299)..(299): n is a, c, g, or t
gcggccgcctactactactaaattcgcggccgcgtcgacggttaaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaaaaaggaaaaaaagtcgacgcggccgcgaatttagtagtagtagtnga

SEQ ID NO: 548196 - DNA, 864 bp, Homo sapiens
ggctcgggccccccccgatgccggtggccctctttccacctggccccgtcaatgaactcgcccatggcaacgccatggggacggccctgggtttccacagacttcccgaatctaaccgtagggcagacccggtgtggcagccctgggccgcgccatgctcttcagcaatccatagtactaggacggaatggctcgcatggatgagccatggatgtgtacagagctgttcctcacacttctccagtcctgcatcgtgcatgcgcgcacggtggatgccggactgctgctgcatgcgctacccgggtcccatgacgtgcagcgcgagggctcaagtgaggaccatggtaccacacgctgcgctctcagagacgtgtttgagggcctctggctccctgaactccacgctgtgcgcagtgtctagctctttgaatcaggacgcagggcaacagcaccttgaccccacccgtgtcccgcgtgggccgtggctatggcctacaccccaccccacttctcccccaaaaccagagccacctgccagcctcagctgggacagggctggccgtagccgagaccccaagcctggcccattggtccgcctctctggcatctgtgggtccctgggctctggacaagcacatgggggacgtagccgctccagtagccacccacattctcgagtcaccataacggctagtttccctgccccctgacgtctgatgattcgggctgtggccatccacgtatttatgcagtacagtctgccgtgacgaccagcccgtgcactctgggacctggggggtgggctgtagaagagttgttggggaaggagggagctgaggataagcattctgcgcacttctccct

SEQ ID NO: 548197 - DNA, 701 bp, Homo sapiens
ggcacatgaatgccttccactgaaccgaggcactgttatagaaagaatggaacgaattgatacagattatacgaatcaggttgacgtgtctgtgtgtgtgtctttaactgatcacgttggagttgcatggcgctataatagagctcagccaagtgacttgtatttgttaattgatgattgatgaacagggacagttagttaataagaccatcgatgagcctattttcaagattagtgaagatacaacttgagccaacataagttttcccaagaaaccagaactagatcttcaagatctgtccttagaagatggaagaaaccaagaagttcatactttgacttgaacgtacactgatggtgaccaataactcatcagtctggtccagaaagaggaggatactagtcgttgatggaacttccaaatgtgagcgaaaaagctgatgttttaagctccttttgggatgagaaaagactcatgcagtcactggaatcaatttttggccttgtgaatggtaacgagagcaacgtggccttgctaaacacgagagctaaattgggactacccttcctgaattctcaatagggcaagaatcctttgaacaaaaaccagaagggctaagtttaccaccagtgcccattaaggcagaaaattttcccattttttaggtaacctggtaggacacaaccgtggacattggtgt

SEQ ID NO: 548198 - DNA, 984 bp, Homo sapiens
  misc_feature (392)..(392): n is a, c, g, or t
tcccctcgggtttgtttccaatcgagccccgagttttctcccagaggggtggtttcgtggtgttcaaaaacatcttcccagtgtggcaaataacggtttctgtcgtatgacttcagactttccggcctgctatctttctgctgcgcccgcccatattgccgcggtgtccagttggtccccgaccccttattgcgttgtctggcgtgacccgaccaggcgctgttctaccaccagtgcttcgacggcgaaaaacacagagcttcgcccgtgggcccacatgcggctgccccccacagagagggctccccaacgtcgataggaaacactccgggggtaaaccaccaaatagatggggccacccacaaatgtcttttgctgagagaccccccggntaacgcccaccccaacttcccaccttcggcggcgatgataacaaggttcacggccacccccacgtttgggagacaagaattggttgcagcagacaaacagaacaatagcttgttctctgttccgcgcaattatactgagggaactccctcatcgcactctcatgaaaaactgtttcacacagggcgcacctctctcctcttaccccacactggatgtcgccacttttccccctggaatgttatagcttcccgggataatttggatatttgaggggtacatttcacagattgggttagaagtacaatatgggaagtaaaacccagggtgagtcaccaccccacctgtatcactacagaggtcggaggagcaactccacacgacttcttatctggtgaagtccacaatgtgttcggtggaaggcacgtctgcacactgttggcatggtccggacgtaccccctacgcgagaggagaagttttggtcacccctggaccccccgcatgacatgaggagacacgacgtgcaatagttggcccgccatgaattgagcattttaaaacaaaatttcgtcggggaagccacaacaaaaca

SEQ ID NO: 548199 - DNA, 176 bp, Homo sapiens
ccgatcctgcgcgaggacgtatttgcgtgaccgcctcatcgtaccgcatcggccgctgggtgagcgcggtctggacatctactgcgccggtggtctggttgacgcgaataacataggggacgacagtcttgagaggcgttagagcctttccctgtgtgagatcgatgctgcggcca

SEQ ID NO: 548200 - DNA, 399 bp, Homo sapiens
tatattccttgtgatagtgctttgctttttcatagataagcttcctccttgcctttcgaagcatcttttgggcaaacttctttctcaggcgcttgatcttcagctctgcgagattccttcgctttttcttaagggtttctggcacagcaggaacctccttcttcttctcttctacaccctccatggttccagccggaaaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctc

SEQ ID NO: 548201 - DNA, 905 bp, Homo sapiens
  misc_feature (37)..(37): n is a, c, g, or t
gaaacataggaacatatgtaggtgaaacatgggggcnctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgagaaagaccaccatttgtagaagtggagatgctggcacagggagagacagatcacaggttattagaagatgactagtgtgtaccggatattttctagcggtgggtataaaagtctgtctcatgaaaaaaaaaaaaggggttttgggggaaaggtaaagggggtgttgcctttgtgaagggatcggccaagggtatgaaga

SEQ ID NO: 548202 - DNA, 766 bp, Homo sapiens
aacatggtagaccttccgactgacgcgttcgctaccagatagcgtaaggtgacattggtcataactgtaatcatagtgcagtatctcgtggatcatagatgtacgtggttgagaattctcagcgaattatacaaagacccatggggtctggcgcgttcgatgtatgcacacaagagtacacagtatgtgaaggtgcctgcacgtgaatcattgacactgaggaatcattagttccaccctatgcgagttgcctaaagtcgtaggtctcagtatcatacgagaaacttgactgccctcctgctgcgtgatgggtagaccaaagatgaaagattggcagagggacccatttgttcatcccgccgaggacctattctgccactaacatcccgcaaagttacaaaccgctttcggagaaagcagccacgaagaagcatgtcgtgtacacactgtcccccatgcttcacgggacgtccacgatcgagtgacaatcgtcaacagttgggcagagtgccggcactcttgagcacagacagttgctgcttcaaacggttgcttcaagtgtcacccaagggctgccgagcaccaatgaagcaggttccacgaagtttctgaaggctggaacatcgagccgaatccaccacaaatgaacactaaagttattttctcagttccccaaaaaaaattagaaaacatataagaacaaaaaaaacacatttttaagtgggcagaactataggaagcacacttcaaaaaagagtttaaaaaa

SEQ ID NO: 548203 - DNA, 1165 bp, Homo sapiens
  misc_feature (15)..(15): n is a, c, g, or t
  misc_feature (36)..(36): n is a, c, g, or t
  misc_feature (454)..(454): n is a, c, g, or t
  misc_feature (616)..(616): n is a, c, g, or t
cagtacctccttcanctcaacaacctggccgaccgnagctgcaacgacctctcccagtaccctgtgtttccatggataatacatgattattccagctcagaactagatttgtcaaatccaggaaccttccgggatctcagtaagccagtaggggccctaaataaggaacggctggagagactactgacacgctaccaggaaatgcctgaaccaaagttcatgtatgggagtcactactcttccccgggttatgtacttttttatcttgttaggattgcaccagagtatatgctgtgcctgcagaatggaagatttgataatgcagatagaatgttcaacagtattgcagaaacttggaaaaactgtctggatggtgcaacggattttaaagagttaattccagaattctatggtgatgatgtgagctttctagtcaatagcctgaagttggatntgggaaagagacaaggaggacagatggttgacgatgtggagcttcccccttgggcttccagtcccgaggactttctccagaagagcaaagatgcattggaaagcaattatgtgtctgaacaccttcacgagtggattgatctaatatttggctacaaacaanaaagggagtgatgcagttggggcccataatgtatttcatcccctgacctatgaaggaggtgtagacttgaacagcatccaggatcctgatgagaaggtagccaatgcttacgcaacatcttggaatttgggcagacaccaaaacaactatttgtgacaccacatcctcggaaggatcaccccaaagtttaacaagtagtccaagagctccagttataatgcttctatggcagatccccaggtgaagagtcttctagaagaacctgagcggaggaagagcaacaacactgacctggacataatatcaccaaaagcttgcaggtacaacgagcacgtacttcaaatccactacagaagcaagtacatggtatcacgggtctctcgcaaggatcttcaagtattcagaaattccaaggattcacttgaaaatgtttctaaagaatcgaatgatacaccgagttattcatctcaacgatgtgtactgcttgtaactttacacggaatcgcctgaataaattcagggaacaggacatttatgcaagctggagaa

SEQ ID NO: 548204 - DNA, 120 bp, Homo sapiens
cacagcggtccatcagcacaccagtagcttgagcaggcacggctcatgaagtaaatggtgcccaagcgcttaaagggcagcacgcaggtgttgcgatcgaaacgaatctggcgaagcaca

SEQ ID NO: 548205 - DNA, 177 bp, Homo sapiens
gaacgagtttataatgggggagtggggtctcactagtggcgcccaggtatgctcggcgaaactcgcaggtctacaagtggatcctcctgacctcaggctcccaaagtgctggtgattacaggcatcgagccagcagcatctgtgccgtcttttacgtatgtttcaaacaacacttat

SEQ ID NO: 548206 - DNA, 403 bp, Homo sapiens
  misc_feature (27)..(27): n is a, c, g, or t
  misc_feature (32)..(32): n is a, c, g, or t
  misc_feature (45)..(45): n is a, c, g, or t
  misc_feature (344)..(344): n is a, c, g, or t
  misc_feature (352)..(352): n is a, c, g, or t
  misc_feature (364)..(364): n is a, c, g, or t
  misc_feature (379)..(379): n is a, c, g, or t
  misc_feature (382)..(382): n is a, c, g, or t
actcttaagtgtaatttgccctcctgntctangtgaccttgaganaatcacttgatttcccggggctcaatgtgtattccctctaaacgtggaggagttctacataaatctgtggaaatcccatttaattctatgatttcaacatattaataaagaaatacttctcaatgggacagttttgccaggctaaactgtagtaagtatgtagtaagtaaatcacagtatgtagtaagtaaatcacagttcaagactccaatcaggacttttacacacaatttgattccaggtttacttatttacccttttaactttttttttttttttttgggaaagggagtcggctnttaacccngggcggaagggngggggggcaatcaangcncagggcaggccccacccccaa

SEQ ID NO: 548207 - DNA, 332 bp, Homo sapiens
ctgagattggtgtgcaatggtgtgatcatagctcactgtatcctcaaactccctggctcaagggatccgcccacccagcctcccgagtagctaggactgcagatgcatgccaccgtgcttggctggttttttcatctttttgtagagatggggtctcactatgtttcccagggtggtctcgaactcttgggttcaagtgatccttctatcttgggtgtcccaaagtgtaggggattactgtgagggactagtaatttttttttttttttgagataagtctcactctgtcgcccagtctgggagtgcagtgagctgagatcgcgccactgcac

SEQ ID NO: 548208 - DNA, 415 bp, Homo sapiens
gaggtaaggaccaggacaagaacaggcattaaaggcaagaaaaggcaaggcaaggttatagggaacagaaaatactcatgagggctctaacaaagggctggtagggtggggattcagggggggccttccaggctacactaaataaccagcacggtcaggggaagtcacggatagtttttaaaggcaccatcagttctggtgtttaatttccccctgggcataaaatttgcctggaggctggtctggtggctcccaccttctctccctggctttggcctggctctggttcctgcttgggtcccaaagagcagcagccggagcctcctcggggatcctccctaagcataaatttcccaaacagtccacaggtcccatggcccacttggcgtctggcacggtgatcgtgacaaatctt

SEQ ID NO: 548209 - DNA, 629 bp, Homo sapiens
tcgccctctaaatgttcaaaggccacgtgaataatccaattaaaggggtgaccccactaggcggaaatgggactggtcgccccttttaaatttttaaaacctgaaaaagaaatccttggtttcttttttaagcgaaagatcgcttttaatgtttgccctgatttagttgcatgattagtcagaaaccgccatttgaaaaagttatttttataccggccaaaaaaaaaaaaaaaagaatccggttaaatgttttatacataattttggacccaaagaggccaccagatcagttttaattttattagccggtgaggccatttgaaatgaggtggacgttttgagcagtcccttgagtggcctgccaacgtttcagggtatgaatggattttgtttattcggtttgaggggttttttccacccttacccccccaaaaggtagagtaaaaatgactatgatagaatgcgggggggtacccttaaatcctcatttttatgtttatttaataaagctccccttagattttgtttcataataatttaaacccaaccaattttcccatagacttgctgttaaagtattgtacgtttgggtccagtttaaaaaaataaaagattgagggccccgggca

SEQ ID NO: 548210 - DNA, 301 bp, Homo sapiens
ggagtaagtcggcagctgtgcaattatgagggcggtttctcagagtttcatagccggtattggctgaactggaatctggtaatttttggactcggtcctggtcaactctaaaatttctctcatggtctcatccttttctcttctggctggtggtaaattagcagtgagcggggtaataatgccatctcttggtttaagggcagcttcaaatcctggtaactggctggcagtccttcagtcccataggtaaccctcatttcttccagctctcggtttagctctccaaggggtcacgagctcg

SEQ ID NO: 548211 - DNA, 162 bp, Homo sapiens
gggggggccccccccccaaaattttttttgggggggccccccaagggggccaaaaagggttccttttttttttccccccccccccccttggggggttttttttcccccgggggccccttttcccccccccccccaaaaaggggggggggggggtttttttta

SEQ ID NO: 548212 - DNA, 127 bp, Homo sapiens
  misc_feature (7)..(7): n is a, c, g, or t
  misc_feature (42)..(42): n is a, c, g, or t
  misc_feature (45)..(45): n is a, c, g, or t
  misc_feature (87)..(87): n is a, c, g, or t
  misc_feature (102)..(102): n is a, c, g, or t
agcccgntcccccccgcggacccagcatccccgcagcaccangcngccggcctgcccccttgctgagcacccctgctcccgaggccncggccgtgatcgggncctggggctgtgagaccccgaccct

SEQ ID NO: 548213 - DNA, 419 bp, Homo sapiens
aatattaatgtcatagatgacattccactgaaggcacagggatagatgaacacgctgagagcactggacaagcctttgtgcttgacgtggcgcagagccaccatcaagtctcaaaccacaaaagcctgacgtacaaagacacctgggcattctggtgacccagggctccctgccacaagaagtgctgttggatctcttagaatcaataattggcactgagaaaattggcattgcatctcctgcagtttcagtctgttcttggagcatattatgatgagtagagctcacgtggatgaatctgttagaagaaaatgaagtgtttaaccatctttttttttcaaaaaatgaaagccttcccaatgctgatggagttggttcgttgcctatcagagcataaactgtaaataaatattgctaaa

SEQ ID NO: 548214 - DNA, 850 bp, Homo sapiens
cggcagtgcaggttcgggggtggattccttgggccgtctgggcaatggcggctgagacctggcccgggccagcgagccgaggacagcatgggcgtcgcggtacgggtccgggtccgcagccccggccgcttgtctgactcccgccatggacccgttcctggctgctgctgcactcgcgttgtctgtccagctctgtcgagcagcgagctgacctgagctccagttccgtatgcctcgggctgcgtggtgccagctgcaagctggagcgcgtgcacgagcggcctagacctcttctccatgctgctggagcagaacgacctggagcccgggcacaccgagctccatgcgcgtagctgcttcgtcctccctgctggtcgccacgactcgtgctgcggcgcgtcgtacgacttcgaggacgggggtcgtgcggccgtgggtccgtcgcctggggaagacgtacctgtgtgcagcatttaacgtcatatgtgataagtgtggggaaagattggagaaggctggctcgtcagctcaacagtctcagacgaccaacgtatcgagcagcatcgacggacacgatatcccccgctaacctgacagagctgtgtgcgggatgtcactgagaatctggaagaacacagatgaaggagaacgcaacagtggtcccacctgtgttgggggctctcagtgtcctgtccagatgacacctggtggctgacctggtacaagaggttcagcaggcccgtgacctccagaacaggagtggggccattgtccccgactgtcatggatactcagacgcgtctacctccgaaggcgtcctgatgggccgtgctttgcgcttggtggacca

SEQ ID NO: 548215 - DNA, 107 bp, Homo sapiens
  misc_feature (89)..(89): n is a, c, g, or t
ttttttcccttttttttttttgtcctttttcccccataaaacatggagccaaaaaaaaccataatgggtctaataaaaactccctaggngtttcctgtccgatttta

SEQ ID NO: 548216 - DNA, 170 bp, Homo sapiens
tacgtgcgcaccgtcgtgtctgtgctatctcgttccgaggtgttctactccaaacgttcctcagcttcctcttgctccattttcactggccacgtgttcaaatgttcttgaggttggagttccatcatcatggacttcttccactgaaatgtacgcttctgtaggcagcc

SEQ ID NO: 548217 - DNA, 601 bp, Homo sapiens
ttccagctactcgggaggctaagggaggagaatcgcttgaacccaagaggcggaggttgcggtgagccgagatctcactattgcactccagcctgggcaacaagaaaaaaaaaaaagtttatcccaagttgagaaggcaaggttagtaacctaggtaacctatgttcttggctggagaatcaaagaatgtcgagttagggcactcggatacaacccaattttattcctaaactaccgtgggctaattataccctacgggtatgattgtatacagctctctgtatcttccaatcttacatgtcacaatttatgatagaaactgggccaggtgcggtggcccacacctgtaatcccagcactttgggaggccaaggcagggggaccacttgaggtcagacagttcgagactagcctgccaacatggcaaaaccccatctccatgaaagatacaaacattagctgggcgtggtggtgggccctgtatctggcctcttgggaggctgaaacagaagaatcactcgaacccaggaggcagaggttgcagctgaactgagatgtgccatggcctccaacctgggtgacaagagggagaatccatgtc

SEQ ID NO: 548218 - DNA, 156 bp, Homo sapiens
  misc_feature (107)..(107): n is a, c, g, or t
  misc_feature (136)..(136): n is a, c, g, or t
attccccctctgtgagaaacacccaagaatgatcaataaaaataaaataaaataaaataaaataaagactagtgtgaacatgcaatgttttaatgtggcctcctggnctatttatgattacctaacaatgggcccnctaaatgaatatcgtttctt

SEQ ID NO: 548219 - DNA, 465 bp, Homo sapiens
ggaccagattacgctctagacggagtcttgctttgtcacccagtggagtgctgtagcactatctcggctcactgcaacctccgcctcccaggttcaaacaattcttccgcctcagactccagagtagcaggtataacaggcacctgccaccacacccagctaatttttacacttttagtagaggaggtttcaccactgttggccaggctagtctcaaactcccgacctcatgatctgctacctccatctcccaaagtgctgggattacaggcgtgaggcaccatgctggcctctattgggttttttttaaaaaaagtttttgatccttagttggttgaatccatagatatggaacccacggatacgaatggctgactgtatttttccacgtgactcatgtatcacctggaatacaccagcaacacatctcagaaatgtccaccttttgccgtctaggagcgtaat

SEQ ID NO: 548220 - DNA, 290 bp, Homo sapiens
  misc_feature (224)..(224): n is a, c, g, or t
gaaagacccgcataacaggcagagacgggcacaggctgaagcagccaaggatgttacccccacgggcaaagctggagactcaggaacaggaaacagttttttctctttctctttttctttttctttctggagacagagctctcgctctgttgcccaggctggagtgcagtggcagcccatcaacggctcactgcccctgacccttccaagactcaggtgatccnccacctcagcctcctgggtagcagggactgcaggtgccgcaccaccacattgcaactaattttttt

SEQ ID NO: 548221 - DNA, 1161 bp, Homo sapiens
  misc_feature (844)..(845): n is a, c, g, or t
  misc_feature (1161)..(1161): n is a, c, g, or t
cgacccacgcgtccgcggacgcgtgggtcgacccacgcgtccgaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaatgcacacaaaaanncacaacacagggggacagataaaaatccccgagggccccagataagcgaacccacatcgggccaaggggccccaagggaacacgatatacgcaggccggcagacccccacaccgcgtgcaggaaaagcgcaggagaaccgacagaccacaccagggggacacacgaaaagcccggaacggacggcagcaaacaaagtacggagaccacataccggagaggaacgtgatatcgtcaacgaccgacgacaccagccaacgaaccacacagcaagcagaccagcagcacgataccgacgccacacaacgacgaaagcan

SEQ ID NO: 548222 - DNA, 643 bp, Homo sapiens
  misc_feature (588)..(588): n is a, c, g, or t
  misc_feature (593)..(594): n is a, c, g, or t
  misc_feature (608)..(608): n is a, c, g, or t
  misc_feature (619)..(619): n is a, c, g, or t
tgtggaggctcgtctgggaacactatggggatggaacggagctaatcctgtcagcgcagctggggattaggacccggagttgccaagagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatatgcatgggggtaccccaatctgaagtcagtaaatgaactaatctacaagcgtggttatggcaaaatcaataagaagcgaattgctttgacagataangcttnnatgggtcgatctcntggtaaatacngcatgcttcttgagtaaagcgcag

SEQ ID NO: 548223 - DNA, 244 bp, Homo sapiens
ccacatggctgggtatgatggcacatgcctctaatcccagctactgggaggctgaggcatgagaatcgcttaaacctgggaggcgggtttgcagtgagccaagatagcaccactgcactccagcctgggtaacagattgagactctgtcaaaaaaaaaaagatgttaaaggaaaaatctgaggcgccattcatgaagttaagtgtcccagtggcaaaatgtcacaggcaagtatttatggggaa

SEQ ID NO: 548224 - DNA, 843 bp, Homo sapiens
actgatccgaggatccctcctacgagcgaattccgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgagaaagaccaccatttgtagaagtggagatgctggcacagggagagacagatcacaggttattagaagatgactagtgtgtaccggatattttctagcggtgggtataaaagtctgtctcatgaaaaaaaaaaaaggggttttgggggaaaggtaaagggggtgttgcctttgtgaagggatcggccaagggtatgaaga

SEQ ID NO: 548225 - DNA, 1084 bp, Homo sapiens
aagtctttaagtggacagtacgcatgcgccaacttcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaaaaaaaaaagaaaacacaacagagcaaaaaaaaaaaaaaccccgggggccttcttttggcggggggggcggcacaaaggcggggtcagagacaggggccccaggggccaaaggggtgttccgggcccccatttctttggtccacaagggggaaaatcgcggcgggccccccaaaagaggaggggaaaaaaatggaaaagaccgggtaaccgttaag

SEQ ID NO: 548226 - DNA, 1466 bp, Homo sapiens
aagtctttaagtggacagtacgcatgcgccaacttcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaaaaaaaaaagaaaaaaaaaaaactctccgagagggcattcttatattgccgggtgtgcgcgggaaaaagagggtgtcatagaaaatatggcgcaattatgggccataaaagagctgtgtacccatggaccccaggtattttttttgtgtcaccacagggggtgacaaatattgacgcaaggagttccccccatatatagggaggaggccgcgataattataaatcttcgcgagatattagagccccccaggtgtttatacccccggtcgcgtctttataaataggactcctctcgcgcgcgaaagaaaaatgaccacccaggcgagaaagatgtgataatatacgaacgcccccggcggaccggactctatcagatcagaagagcgcacgggggagagcgagtttcatacagttatagaggagatgtacagcacgaacgagaggagtagatactctctcagagcgcggagaacatacctacgccaatgatcgagatggctagtcgagggacgagacgatataacactcggtgggagagtgttgatatcgcacacaccaacaagcagaaaaaacaacacccacgcggcgatatacaccg

SEQ ID NO: 548227 - DNA, 754 bp, Homo sapiens
agtggtggttcgtgcctataaacccagcacttgggcaggccgaagcaggaggatggcctgagctcaggagttgagaccaccctgggcaacagagtgagaacctgtctacaaaaaatacaaaaattagctgggtgtggctgagtgcgcctgtagtcctagctactggggaggctgaggtggaaggatcacttgagcccaggaggcggaggtgtgcagtgagccaagatgacaccatgtgcactccaccctgtggcaaatgaacgataccctgtctcaaaaaaaaaaaaaagggtggaaggtaaagggcttttttcttcctcttgagagaaacattagtatagtcctgtggcaataatacttcgcgggtccgtggtaaagaggccataagtggggaagcttggctattaaaccatttcaccaaaaaaaaccttcccaggaaaggaaaaaaaagggtgattggagaccttgtggagatatgattggccacacctgtgtggttatccagatgtgggactataagattagtgccacatctaaaaaaaaaaaaaaaaaaaaacattgtgggggcgcggctgggcacgagaaaaagttttctcaacccctctgtgggcgccgggccccatagtgttatcaacctgggcacactcgccaagagaccctgggcagatagggtggtccccacaataaaacgcgggaccgggtgctgcaaccaagggtcaggctcggctaccaggcaggacgacccccggggggg

SEQ ID NO: 548228 - DNA, 322 bp, Homo sapiens
  misc_feature (322)..(322): n is a, c, g, or t
tcgagctcggcccgcttatccgcttaagcaagggacttgacgctttgtgcaagcttggagaagtgtactggactcataggaagcttataacaagaatggaagattcttaaactaactcacgtcttcttgggtatccagtaacagtagatgttcaacaatatgtagcatgattaataccagccattgtgaacgctgtacaaccttgggggttattactaagcaaggttactacgtagcttctgaaaagtaggcttcatagattaactgttatgtatacaactgcggttccatgactttgacttgagccttagaggggatcagn

SEQ ID NO: 548229 - DNA, 1112 bp, Homo sapiens
tttccaacatatacgaagtatcagtcgcggtaccgacatatgccggaatcggccatacgccgggctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaaaaaaaaaagaaaacacaacagagcaaaaaaaaaaaaaaccccgggggccttcttttggcggggggggcggcacaaaggcggggtcagagacaggggccccaggggccaaaggggtgttccgggcccccatttctttggtccacaagggggaaaatcgcggcgggccccccaaaagaggaggggaaaaaaatggaaaagaccgggtaaccgttaag

SEQ ID NO: 548230 - DNA, 310 bp, Homo sapiens
gacccccacctgattgctgcatatcctagagggatatttgatcaggataacgtggttactaacacagagagttctcccagtaggttaatagtggggggtaaggggaggttaccgaggcttgctagatgtcttcaaaaagctattagtgggattagagtttgaagtccttgaaagaggattatgatgcgactgtgagtgcttccgtagtttgagtttgctaggcagaatactaatgaggatgtaagtccttgggcgattatgaaaatgactgccccggtgaacactcacttggtgtgactcaggtgatgtg

SEQ ID NO: 548231 - DNA, 112 bp, Homo sapiens
aattgtctcagtattagtattatcaaactccttttcttcctgtctgtagtagcttgctagtccatatgatttacctagttttgtgaatcttttattattatgtaccaggctt

SEQ ID NO: 548232 - DNA, 1076 bp, Homo sapiens
aaacaataggctaggtacgaggcctggtgttaatcggccgagggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaaaaaaaaaagaaaacacaacagagcaaaaaaaaaaaaaaccccgggggccttcttttggcggggggggcggcacaaaggcggggtcagagacaggggccccaggggccaaaggggtgttccgggcccccatttctttggtccacaagggggaaaatcgcggcgggccccccaaaagaggaggggaaaaaaatggaaaagaccgggtaaccgttaag

SEQ ID NO: 548233 - DNA, 204 bp, Homo sapiens
tgacgtgtattcagctactgcggtgcatgcatccctggacaagtacctgtcgagactgtgagcaccgttgctgacctccagatatctgttaagctggagccatggtcgacgtgtattcaccactgcggtgcatgcctccctgtacaagttcctgtcgacacgtgagcactgtgctgacctccaaatatcgtcaagctggagcct

SEQ ID NO: 548234 - DNA, 1081 bp, Homo sapiens
gtatcaacgcagagtgcccattacggccggggcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaaaaaaaaaagaaaacacaacagagcaaaaaaaaaaaaaaccccgggggccttcttttggcggggggggcggcacaaaggcggggtcagagacaggggccccaggggccaaaggggtgttccgggcccccatttctttggtccacaagggggaaaatcgcggcgggccccccaaaagaggaggggaaaaaaatggaaaagaccgggtaaccgttaag

SEQ ID NO: 548235 - DNA, 1078 bp, Homo sapiens
  misc_feature (18)..(18): n is a, c, g, or t
gggggggggggaaaaacnataggctaggtacaggctgggtggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaaaaaaaaaagaaaacacaacagagcaaaaaaaaaaaaaaccccgggggccttcttttggcggggggggcggcacaaaggcggggtcagagacaggggccccaggggccaaaggggtgttccgggcccccatttctttggtccacaagggggaaaatcgcggcgggccccccaaaagaggaggggaaaaaaatggaaaagaccgggtaaccgttaag

SEQ ID NO: 548236 - DNA, 356 bp, Homo sapiens
gtgtcttggagcttccacaaacttcaaggtgtcaacgacattgaggagggtttcttcagtgcccgaggtcatcgaccccttgacaagaagagagaagaggctcccagcctgaggcctgccccaccgcccatcagtggaagtgcatatcggactcgttcagcctaagcagctgtcactcataagatagtagaaagagaagcccctgatgctggaggctgtcttcacgctgacccacacctgtatgcgctgtgtcctacaggatgtcagtctgcatgaggctctgctacaacacgggccaatcatacatagtgctgatgagttaatattcaatgtggaagctgtccagcctgctcttc

SEQ ID NO: 548237 - DNA, 1072 bp, Homo sapiens
  misc_feature (37)..(37): n is a, c, g, or t
gaacggctaggtacgaggctgggtgtgtaatcggccngggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaaaaaaaaaagaaaacacaacagagcaaaaaaaaaaaaaaccccgggggccttcttttggcggggggggcggcacaaaggcggggtcagagacaggggccccaggggccaaaggggtgttccgggcccccatttctttggtccacaagggggaaaatcgcggcgggccccccaaaagaggaggggaaaaaaatggaaaagaccgggtaaccgttaag

SEQ ID NO: 548238 - DNA, 338 bp, Homo sapiens
  misc_feature (15)..(15): n is a, c, g, or t
  misc_feature (264)..(264): n is a, c, g, or t
tgttgtgtgaaagantcaattcatcaactgcagtagccgcatggtgagtaatcatgtggctggtagatcctgtattagcacagagaaatggcacatttccatcacaacaggaagttctggtggacagccctgagttagaatattttcaatctgctcgtcctcaattaagccctgttgttcatggtgatgtcctcagtggatgggtcataatgttccatgaaacctctcaaggacacaattgcatgatccttgtaacccttaccncctatatctcgctctggtgagttctctttcagctacctataaagtttgacttcctagtccgtgtaaaaaaaaaa

SEQ ID NO: 548239 - DNA, 183 bp, Homo sapiens
cagcaacgggttcggttcagtatgtttctcctccccagaagaagccactaaagcagtctcagaaatgaccggtagaattgtggccacaaagccatcgtatgtagctttagctcagcgcaaagaagagcgccagggtcacctcactaaccagtatatgcagagaatggcacgtgaacgagctgt

SEQ ID NO: 548240 - DNA, 190 bp, Homo sapiens
agtagaagtaaaacacaatggataatggggtgtggcagaatccatgccacttggtcccatagacagatctctctcatgcttggtcagattccactttggagagacatgggctcgtagggacagggatggcctgggtgcagggaacacagtgtactaactggtaccagtttcgctgaacacttcaccactt

SEQ ID NO: 548241 - DNA, 161 bp, Homo sapiens
aagagaaaacaggaggtgggaggagtgatacacctatgggaacacgcgctcgcgtctgaaatcattcatcacgcagagcctggtgctccgccatgcatgagagatatgcttcaatgttcagtcacctccctccaggcccccacatccaacactggggattc

SEQ ID NO: 548242 - DNA, 226 bp, Homo sapiens
cggcatcactacaatcaacaatgtggcttgtcttctatggagagggcaaagcattgaacgggctcttatttatggaagtgacacatgggatatgcatttcaggatgtgcaccctgtcttcagtgaggatagattagtgcgtctgcagaatagatcccactaatcagttagaaagataggctatgacacagtgttgcagtgtccaccatcaactctttctctcccta

SEQ ID NO: 548243 - DNA, 149 bp, Homo sapiens
ccccccgggggccccccaaaattttttttttttaaaaaatttcccaaatcgcgggaaaaaataaaataaaagcccccgggcccccccccccccttttttccccatttgggtttggttttttaaaaaaaaaaaggggtcccctttgggga

SEQ ID NO: 548244 - DNA, 338 bp, Homo sapiens
aaaaaaaaaaaaaaaagaagaagaaggaggaggaaagaaatcccagacttccggttttttacccaaaaaaaaaaaaaaaaagaagcagcagcaaaagatctaggcacacatttcccacaacagaacaataggctggagctgaatgggactgccccctccaccaatgccttcctcttctaagctggtccccacctggtcactcgtttacagcacttgcctggctcctccagacatttgaatcaatgactcctgttgtagatcacagggagggatgttggttgcttgctccttttagaaactgccctcttgaatgaatggacttattcaggaaaaaaaaa

SEQ ID NO: 548245 - DNA, 713 bp, Homo sapiens
gatggtgcagctgggcatctgtgccttccgctcaaatgggactgatcaataggacgcatcacacatcgccctgctggacatccagctcgagtggccgagccaaaggagcttctgggccagggcctgctgctgcgcacctgcaggatcgcaaccaggagcaggacaaggtggagcggcggcgtcaggttcccctttccacgctgtcacatcaatcctggagctgctgtgagttgtgtcgtaccgtggtgtctgccagtgctcctggtagatcccctacatggccgccatgagagcgatgcccgctcgatcgcatgatcagcaagcagttccatcaccagcatgcgcgtgggcgagctgatagcccctgctgggtccccctgagtccatgcggagaacagtgtggtcgctgcctccataggccatgaagatgggtgactggaagacctgtcacatgttttatcatcaatgagaacgatgaatgggaaacgtgtgggaccttttccccggtacgctgaccaagtccgaagccatgctggttacgcgaagagtccatgaagacgtcactgagagacctagctctttactacccgtagtgtctatgacctccatctagggtgtgagacgctgccaggacatgtttgatgcaggagtctggccactgtggctccatcatcagctgatagtgatcattatgaggagctgatgcctcccgc

SEQ ID NO: 548246 - DNA, 210 bp, Homo sapiens
tctcttatcacagtgcaaggctcagctagtgctgtctcccctgagaccctggtcgcgcgtatctgggcagccatctgggcctcaacaggtggagctcccagatctctgacaactttaaagctgcaggtagaccagcgataaccctgaaaactttccatgtaacccccagggcgctggccagtccaagagcagcttgcacatcaggctggt

SEQ ID NO: 548247 - DNA, 194 bp, Homo sapiens
accgctcctgttacaacagcacagacagaaagtaccactcagctattagaagaaacatctatatgggaaggaaaaatatcccccagatatacaacagcccagttacaacagacattcaattgatcattcattagatcaatcatattttcaatatccatgcattgaaatgatggatgaactaccatcgacatgca

SEQ ID NO: 548248 - DNA, 887 bp, Homo sapiens
  misc_feature (640)..(640): n is a, c, g, or t
agcgggctggctccgacggtcgccggctcccagacgcaatgcggagggcggcaggggatggggcatggcggcgcccgggagggaggcaccgggtccgctgggccaagccgtaccggggcgtcacaatttgggtctgcagcagaaatgctttcaggaacagacagcagcgctgggagacaatgcatgggaatcaatgaatgtacagctggtatggacgcagagccccaggtggcaaaggggaagccaggaagagcgggcatggagaacagtaccaggacctctggtagcacctgtgctgtgaccttgaagaggagccacagtgcccttcaggagaaggctcatgtctgctccctgggttcctgcaattccccaggaggggaacactggagactgggagatggcagcatgcagcttcttgtcggctggatcagcagggcctggtaaccatcaaggatgtgtcactgtgcttctctcatggaggagtggcggactcctggacccctctcagacagactttcatggagaatatgtcatgcaggaacaactgtgggatagtagtctctcgtgagatttccaattcccaaacgtggacagtgctttctcaacgtagaaggaggagaagaaccaatgggtccctganccccaggacttagaggagagggacattctgagggtcacatatacaggagatggaagtgaacatgcacggggataccccatgaacctagaagcagaaccttcacagaattgtttatccagccgtgttttgaaagatacttggttctcttggaacccggagcatgattgagaggtggggattccatggccctggaaaggtccagagggaatgctcctgggggccccctttttttccagggaagaatatg

SEQ ID NO: 548249 - DNA, 888 bp, Homo sapiens
tacatatgcatgcttatataagctggcaaatggttagttctggtgatttcttgatggttggaagtctatgctgggaataaattccatcactacactattcatgcttcataataggagctggggatctgttagtttgtttttgcaaattgcttgcccctactttacaacaatttgctatgttagttgtgaagaactaaggtggggagcgagtgactacaagttgagtaatggtatgagtatataccagtaattctgattggctagccagttttattgaatcagaataacacttggtttatggaagtgactaatgctgaaaaattggattattttgattagataatttctctagctatagacttaaactgtcaatttgctctagttgtcttattagttaaactttgtaaaaatatatatatacttgttggtccattgtatgcaagtttggaagaagatagatgtaccatttcatctgttgtatgttggattatgtatggaaatgtttgtgtacgattgacataatgtaatgcgatgatatgattgatttattcaaataatttaggcctttcttagaaatgtggaatcacaaactaatgcaaatcttaaagggccatttaagagtgctgctggttcgtgggctgactttcccaaattccttgtgattcacattatgcgtcctgtgatgttgtcccactaatcgtatcacgttagaaattgaacatgagtgaccttgccataaaactaaggtccggaccaatctcctcattcaaatggtgccatcatcctcactgcggctggcaccgcgagtcccactcatgatatacccgcgcataaagttgggtccatcgcaacccacagccactggcggccacccccctcagctactcc

SEQ ID NO: 548250 - DNA, 383 bp, Homo sapiens
tgttctgagggtacccggaaggtcggacccaccgctgactcgggaatccagaactagggcagagctaacaagcattgtatgcggaacagcggcaggcatgtttatatcttatcataaggggctgtagcaaacatatgaactgaaaaaacacgcatttagtaatccaaatatggatattctttacaccaagccatcaggctccttttatcagatagcattcagagtatttgaatgtccaccagacaccagccccggggggcacagagagaacaacattcctctctgtcaacatcgagaggctggtccttgacactttgaacaatggccacaaatgcatccctgacatccccagacatctccttcttggtgggtcagaacataag

SEQ ID NO: 548251 - DNA, 447 bp, Homo sapiens
tcacaaatgttgacctctagtgacactggctgttcgacgagtgtaaaatgtggtcggaaacaccgtggcttgtagatgcagagagaagctataggaagaccagataccgaccctggtcgtgttctgacgagacgatcgttcataaggcacagcacatcgcagagatgagacagttgttaataagagctgtggctggaaacatggctgttaggaacagcgtcaaggaaccttggagttcatatttgcacaaatacttaataaactatagagtccaggagctgtcagccctaagtctgtaggagcagacaccttctgacttgaccaaacaggcatatgggtttaggttggctcgtcagatgtcatatgtctctgatggggctgcaagtgctacctcgcgcttgtacactgtctgctgtggggctccgagcatggcggtgaagagctgca

SEQ ID NO: 548252 - DNA, 316 bp, Homo sapiens
  misc_feature (123)..(123): n is a, c, g, or t
gggttttgttcttattgcccaggctggagtgcagtggcacaatcttggctcaccgcaacccccgcctcccgggttcaagcaattctcctgcctcagcctccagagaagccggggttgcaggcnctcaccgccacaccagactaatatttttatttttgtagagacggggtttcaccatgttggccaggctggtcttcaactcctgacctcagataatacacccacctcagcctcctaaatgctggcattacaggcgtgcagaccaggagcattctctagtaacattgctgagtcttcaaagattcaactgtatcag

SEQ ID NO: 548253 - DNA, 520 bp, Homo sapiens
  misc_feature (423)..(423): n is a, c, g, or t
cacgaggccgcatatgactttttttttaagtgcaaagtccagaggggaaaaatggactatgcacttaaaaaaaaaatagcataagggcaggcacgatggcccacgcctgtaatcccagcactttgggaggctgaggtgggcagatcacctgaggtcaggggttcgagaccagcctggtggtccaggtgaccagcatggtgaaatcctgtctctactaaaaataaaaattagctgggtgtggtggcgggtgcctgtaatcccagctgctccagaggctgaggcaggagaatcgcttgaacctgggaggcggaggttgcagtgggctgagatcacgccattgcactctagcctaggtgatacagtaagactctgtctcaaatttcaaaaggatatatatagacttgtacatacatacacacatantatatgcatatatgtctacatatatatgcacgtatatgtgcacacatatgtgtgtacatgtatacatatatgttcacatatatacatatgtgtgtgt

SEQ ID NO: 548254 - DNA, 809 bp, Homo sapiens
gcgagcatgaggcgccagtcatggcgagtggacatccgccatagacagtggaccgaaaaggttcggcgacaaggagccccaagagccagagatatctatcctgaaggctgtattggtcatgcttatacaaggttaactgtccagaagtaaccaattccactattcaaccaggattgtagttgaataaggttagtaatcatgaagtaagcaccaaccggacacgcacgtctgctcgcctttcccgtgattgatccggatagatgaagctttctctgggtgctgggaaaatcaattacggccgtggttgtggggaccatattctgactgaatggtgcgcggtatcaaggaggtacccgatactgaaaggtatgtgcactgcagcgatgagcagtcgtgtgccgcatgcggcatcctcagggcaagggggcaagatcctcactttcgaccagtctggcccctggactcccctaatgggtctgtggacactgtcctgctctccggtcctcgtcatgggtccgagaggtgtaccggtcatttcggcaaggccccaggaaaccccgatcagcagcaccaaacctacgtccgctccaagggccggaagtgcgagcgtgccagaggtcgacgggcagccgaggctacaaaaagtaaccctggatcctactctcttattaagaaagatcttgtgtcgaggaacacaagacggggacatcgacggcctgatccgggctgggccacacaaggtatgaacggggacatggactaggttggtcccgacccggtgtcctttccagggggaagatgcgcggtcc

SEQ ID NO: 548255 - DNA, 910 bp, Homo sapiens
ggaagtcggcggtcccgcgggtctgtctctttgcttcaacagtgttgggacggaacaagatcgggggactctcttccagcctccgaccgcctccgatttcctctcggctatgaactttccgggaccatcttctcggcatctcctgcttctgggaccggccagcaccgtttggtggttagctccttctgtgccaaaccaaccatgagctcccagattcgtcagaattatcccaccgacgtgaagcgcagccgtcaacagccgtggtcaaattggttacctgcaggcctcctacagccataacccctttctctccttggggcttacaaatttcagacccgcgacaatgactgttgggctcttggaaaggccgtcgagcccaacttttctcccgcggcgcaattggggccccgaaggaagaaaaggccacggagggtgctacacagacgccgtactccttggaaggattgccacacacaccaatgctaggttgtgggcaccagcgcgcggtcctattttccaggggactattcaaagacaggccccagctgtgaaacgcactgaggggggggataacacccccaagaagggcccaatggaacacggttgccaaagggccctggggacacaaaaacgaacggtgacgaacccgggccacgttgtgggcaatcctgcaagggccagggagttcctaggccaggagaggagaccccacatcatggtggcggaactccgtgggggaactacattcccttacgatggcaggcaggtcgccccctcatcccaagaacgactgggttcgccacgctgggaccaacttgccacagggcaggagagggcccggaagacaggacacggcagaacaacatctaacagaaaagcgtcaccctccaagccagcatgaacaagcttg

SEQ ID NO: 548256 - DNA, 488 bp, Homo sapiens
actaacgtattactagtaccattggtgcgcggcgccggcccaggttagggtaaagtgtagctactggtcattatgctccgtagcgcatagtcagtagtcctgtgatcatatgatcgtatgtgtgcttgggtcatccatcatcacaaataaagcacaggccgctgagcggaaccggtatcctgatatctgaatccaagttctcgagatgcaagatcgttgagtgtctgtgactcgtgtctctatggagacatggaaaggtccggaagggctcgaaaggcttctgaaataatttagaagccttaactggcccccctgccccctgtggaacgacgcacacacgacccacgcaacagagaccaaacgagcctcgcgcgccacacgaaaccaaacagcggagagcaaagccacaggaacacagaaacacacgcataacggccatcgggccacagacaaaacgacaaaacccacgcgaacacaaccacaggacg

SEQ ID NO: 548257 - DNA, 354 bp, Homo sapiens
  misc_feature (13)..(13): n is a, c, g, or t
  misc_feature (35)..(35): n is a, c, g, or t
  misc_feature (299)..(299): n is a, c, g, or t
  misc_feature (310)..(310): n is a, c, g, or t
gacatgacaaagngaccacctcagaaacgaaagcnccgtggctactatgagcaactttgtaggccaataaattggaaaatctagaggaaatggatccattcctaggcacatacaacctacaaagattgaaccattaagaaatcaaaaacctgaacagaccagtaaaaagtaatgacataaaagccgtaataaaacattgcccagcaaagaaaagcctgcgccctagttgcttcactgctgaattctactgaacatttaaagaagtaataccaatcctcactgaaatcagaaaaatgagnatgaggaggtnaatcattcccaaatcattccatgaggttacccaataccaaaacc

SEQ ID NO: 548258 - DNA, 188 bp, Homo sapiens
caggtcgccacgttcgaacgcgactctatttcaccagtgagagccatgtctcactctctgctcaggcctacaaaagagtgttttttaatagccagttagtggtgcagacacctgtggtcccctctacttggtagggtgaggctcacttgtgcccaggtggcggaggatgcgatgagctgtgatcagca

SEQ ID NO: 548259 - DNA, 284 bp, Homo sapiens
  misc_feature (204)..(204): n is a, c, g, or t
  misc_feature (269)..(269): n is a, c, g, or t
ccagaggcacaagggaggcacagcaactctgtctggtaggtatctctggtcagcttcccctcttgtgagtctcgcagggtcgctcacccatccagaccttaaggccggaggcttgccagtctctggacggtacagggtaaggggggcaggcacaatctccgggggcagatgaaggtaatcacggagatactgggataccctcantgggtaaggtaccaagtggaaatgtctccaggcaaactggttccttcactgtagcctccgggacntggaggagactggca

SEQ ID NO: 548260 - DNA, 506 bp, Homo sapiens
cagggcttccagggctggctcacgccatggtgagttcggagagaagggagaccagggattctggaatcagaaaagtcgcccaggccatggctaaaggtggccagggcctggagcccaggcccaaaggtgaatcgggagactacaaggccacccagaaaatcgccttctctgccacaagaaccatcaacgtcccccctgcgccggggaccagaccattcgcttcggacacgtgatcaccaacatgaacaaacattatgagcccggagtgggaagttcacctgcaagtggcccggtctctactacttcacctaacacggccagctctcgagggaacctgtgagtggaactcatgcgtgtgctggagcgtgcacagaaggtggtcaccttctgtgacttatgccttaaaacacgtgtcagggtcaccaccgtgggcatggtcttcaagctggagaggggggagaacgtcttcctgtagggcaccgaaaaaactaactaatggggcatgg

SEQ ID NO: 548261 - DNA, 290 bp, Homo sapiens
gaggatccgacgcatccctaaccagagagagaatgctaatgggaagataaggagaagattgggcagggttttagtatgtatgagggcaggaaaataagggaatagaattacagagaatctttacttcggggttctggtgtacaaaagtaatgggtagatagagattgccttatgtttttctcccaagtgggcattatagctctagggctggtattaaattacatgtttggtttggtaggtagagacagagtctcacactggtcatgcaggcccgagtacaggggtacgat

SEQ ID NO: 548262 - DNA, 1065 bp, Homo sapiens
aagtataggctaggtagcgaggctggggttgggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaaaaaaaaaagaaaacacaacagagcaaaaaaaaaaaaaaccccgggggccttcttttggcggggggggcggcacaaaggcggggtcagagacaggggccccaggggccaaaggggtgttccgggcccccatttctttggtccacaagggggaaaatcgcggcgggccccccaaaagaggaggggaaaaaaatggaaaagaccgggtaaccgttaag

SEQ ID NO: 548263 - DNA, 860 bp, Homo sapiens
aagtctttaagtggacagtacgcatgcgccaacttcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctc

SEQ ID NO: 548264 - DNA, 1066 bp, Homo sapiens
aagtctttaagtggacagtacgcatgcgccaacttcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctccaattgcaaacacacacaacaaaatcaaacaccacacgggtgccacagaacacaaaaaaaaaactttggggggccggcccaagaaattaacaaacctcggggggcggcccaaataaaaggatcagggcaagaacgcgcgaagggggggccacaaacacggggggggggacaacacgcggggttgtctacagcccaaccccgccaga

SEQ ID NO: 548265 - DNA, 235 bp, Homo sapiens
gggggtagagatcgacgtatgtattcgagtcgcgggcggcacgatccttgaccccgaagacggtgcagcgcgggtggctgccagatccgcacagaactggacttggagtgggtaccacccacacgttccggaagtcggtggcgacgatcctcgatggcgagggactgtccgcgagctaggctggtaccaactcgggccgcgccggtttcgatcacgccaggatgtctactacggt

SEQ ID NO: 548266 - DNA, 1248 bp, Homo sapiens
aagtctttaagtggacagtacgcatgcgccaacttcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaacaaacaaaaaaaaaaaaaaaaaaaaaaaaaaaaaagggggggggccaaaaaattcccccggggggccccttttctcccctttttttttacaaggggcccctaaggggctatataaagcaaaggccggcgcggtttaaccccgtcggcgggaaaccggctcgccgggcgctcttggggagaccgcctcctcgggcgcgtctccctctttggcccctccccggggattacgcctggaaatttaacttcggttttgtgtgctacccggctgctcccggtgaaatttgtccggctttgagtcgcggcgcgatacagtcgagggcgcgtgggcgtccacgttaaggctacatccgccacctgtctctttcgccgccatcctctac

SEQ ID NO: 548267 - DNA, 204 bp, Homo sapiens
gtcaaggctgctctctgccaggatccatctaaacgggagtgatggtaagcagacccagctaagagtcctcctttctttctaaagcccttatgctctgggaaggaagtcctctaagcttcagcttcaactcacagctctctccaagacatcacccgtgggagttccctggagggtttcctcataaaatggagggcggcacatagg

SEQ ID NO: 548268 - DNA, 916 bp, Homo sapiens
  misc_feature (914)..(914): n is a, c, g, or t
aagtctttaagtggacagtacgcatgcgccaacttcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaaaaaggaaaaaaagtcgacgcggccgcgaatttagtagtagtagtnga

SEQ ID NO: 548269 - DNA, 525 bp, Homo sapiens
aaattccagtactgcaggacacaacaggtgcctgtgccacagttatttgcactggagagactgtgtccatgtgaacggggcctgatcagtaaactcgttgactatggaagcatcccgagagccaagttcccagagtgccagccacgggccatctgacctgtttcgaatctcaatttcctgatacagagaacaaatggtagggcataattgatttttacagacgttaccccgtgatcctgctctctagtccccagatttttccagggcttttgtgcactaggtgtttcccgtttgtaaaccccttggtggttaggttttatgggattttacaggacagatggcagctgcaggagtcttgtactgtccctgacttgggtcatcccataggccctggcaccatcctcctgcccttcctggctctcctgtctgtttctgctcctgcatccgaaagtgatcataggctgcctgtgcctaggtcattgatagtgcagggagaggaacgctgaaagaggttgtccccgtgta

SEQ ID NO: 548270 - DNA, 924 bp, Homo sapiens
aagtctttaagtggacagtacgcatgcgccaacttcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaatggcacaacaaagggggccgctaaagacccaaggccaattaaggccaagtatgaaagggcct

SEQ ID NO: 548271 - DNA, 191 bp, Homo sapiens
tggccctccgtgtgctccccctggtcgtggtgggacagacgggctgcgtggtacgtacgtggtgaccaaggtccagttggccgaactggagacgtaggtgcagttggtcccccttgcttcgctggtgagaagggtccctctggaagaggcaggtactagctgcaactcctgtagcactccaggtcctacag

SEQ ID NO: 548272 - DNA, 175 bp, Homo sapiens
cagtaatcgacattccaccttaagagagacatatcttcctccacagacggctatagtacgtcgagtgtcatagggcactcgctagatagagacctgatctcaatctatgcacacaataacaccagctcagtcagcatttcattgttactctagaggatcatcattcggacgatca

SEQ ID NO: 548273 - DNA, 444 bp, Homo sapiens
  misc_feature (127)..(127): n is a, c, g, or t
ccggcgacgggataatggtactacacacgctgctattcaagttatctgactgaacttctggtactgaggctctacacactaagtcttgctcatacaggtgatcctatcaaaacctttctgttaatancaggaccaatccatctgtgtactcaggatgttcacatcctgaaatagtatgaaataaaaataggacacacttacattgatgcctatgttaatttctttccttgactgtgtctgaatataatgttgaagtgtgatagaaacaatcctttatctttctaagctaagcagaggccgaagtttcacttgcactggtcaggattatacaggcaagccttactttttcaggaagtaggtaatgtttggatttagattagtgacacatgaataactctgtctatgactcaccttccccccaatccccggtcggggtaccgagct

SEQ ID NO: 548274 - DNA, 976 bp, Homo sapiens
  misc_feature (868)..(868): n is a, c, g, or t
  misc_feature (872)..(872): n is a, c, g, or t
  misc_feature (875)..(875): n is a, c, g, or t
aagtctttaagtggacagtacgcatgcgccaacttcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcgaaaaaanaaanaanaaacccaaaaaaactttttggggcccgctggggcccccggaagaaggtttttagaaaccttgggttgggcgccggggccccagtggtatacgggcccctgg

SEQ ID NO: 548275 - DNA, 184 bp, Homo sapiens
tgtaaggattcatagacccactttcattaaatagtcccagaagatatctaactaacatgtgttcagatagaacctcacactgcataggtggataacaaacaaacctaagatatgctgacagaaatcacattgagttcgcaagcactcaaatagaaaacccaagacctccggcaacaaattagaa

SEQ ID NO: 548276 - DNA, 1334 bp, Homo sapiens
aagtctttaagtggacagtacgcatgcgccaacttcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcgaaaaaaaaaaaaaaaaaaaaaaaaaaaaaaaaaaaaaaaaaaaaaaaaaaaaaaaaaaaaaaaaaaaaaaaaaaaaaaggggggagagcgaataaaagacaaccccaggaggaggacacgaacacatgacggccgacccaacgacagttgtcgtgttaagcaaaaagaaggagtcagcgccacagaagagagataggaccgactgaatcaaataggaggaaggagggagagccaaagtaaaaacacaggagcaggggagagagaaacaaagaggcatcgagcggagccatctgtgggccgaagaagacaaacactcacattgcgaaggtagcacaaaacatgggcgaaacaacacaccgaagggaaaagtaccgagcacgcagggacgacaaataaaccaaacggcgcgagataagagggaaacaccaacgcgaacaagagcgaccagcaagacgactgcgatgaagagacat

SEQ ID NO: 548277 - DNA, 755 bp, Homo sapiens
gctttcgatcaggcccgtgggggccgacgggatgggcaagtgtcgtggactgcgtatctgctaggaagctccggtagttcagcgtacgagatcagacgtggcattgataaacagttataagaagagctcatttgggcagcagcgctctaagaggccaatcccttttggagtgtgcgttcgtccatgcacatgaggacatcgtgctgggaaaacacggtagggaggttggaaagccaaaacggccaagatccgtgccgagttgagagagatgtgctgataagggtgctccacgctagactcacagcagtcggcccagaacactcacagacctgttgataccacaagtggacggctatgcctctgaaacctttactacgcaggacaacatgcatgaacgttcctggttgctaggcattacggtcgcagaagcgtcatggctgtcaggtggatatctcctgcgagtccgcattatcaaggttgtcaaaggtagccaaatgttcaactctattaggggaccctcatacacaaggccaagacaggacaagacccaacaggcatccacgtcacaacattagtttaacatcggggtggacagaaaccagctgggtcaggtacactacgcgtcgtgcgccaattattggcccagggacaacaagagcgaagagacggacacggacacacagaggcacgcacgaccggcgcgggcggcgcgcacagggcgccagcaacggacgcagtcgagcaggcaccagggc

SEQ ID NO: 548278 - DNA, 158 bp, Homo sapiens
cgtctgagcatgttagcctgcccatccttgatgagtcactaaccctataccccgtatctcactgtgtgcgggccttgtcatatcctgtccttcacggtcacaaccacctaggctcgggcactcttggtgttggagcctctgacctaagcaagccaagc

SEQ ID NO: 548279 - DNA, 1345 bp, Homo sapiens
aagtctttaagtggacagtacgcatgcgccaacttcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcgaaacaaaaaaaaaaaaaaaatctcgagacatagtatctcatttcttcatcttccatcggtgccgaatttcggacaggaggccttccagactcgaagaacattccgtgcaaaatggcaagaaccaagcaagcctcgagaccccagggttgtgggagtgaggcgcttgaccccggtctgaccatcattgtgcatcgtgagacaaacgtgggggcaaccgaacaactgcactgcaccccgaaatgaaagggggcaacaggatacctatagagggagccaccttaaaagtaaagggccttggggccaaaacagaaagacccaacaaaacattctcaaaagggcgccggcaccctaaggagatacgtgaaagattggaaattggcatacccagagagggcgtgtcgccaaatgacatacaggggaacccgggaaggaactagagagagacgcaggcagggcaacaaagacgcggggggcacaaaagaga

SEQ ID NO: 548280 - DNA, 112 bp, Homo sapiens
tgcggcgccgcgtgctgcttcttgggcttgctcttgttgctacccagtgtcctggtagaaggcaggggctgtcccagaggacctgggaggcagcctgggggcgggcagaggg

SEQ ID NO: 548281 - DNA, 136 bp, Homo sapiens
atttattgtagcagcgagtcatatgggcactgcagtgctcagcactactctataaccgccagcggaagatcaatgaaatacagactacaacaggcccaaaaagggacccccatgaaacctgaacacacaagccacg

SEQ ID NO: 548282 - DNA, 811 bp, Homo sapiens
ttgaaaaaaaaaaaaaaaggttcaaacagcaatttaagggctgggcacggtggctcatgcctgttaatcccggcattttggaaggctgaggtgggcaaatcacctgaggtcaggattttgaaaccaggcctgaccgacatgtggttgaaaagttaaaaattacaaaaattaaaaaaatttagcttgggttgttggtgtggttgttgcacctgtgttagctcccttacaaaaattacaaaaaatttagcttgggttgttggtggttgttgcaccttgttagctcccagcttactcgggaggctgaggcaggagaactcgcttgtggaacccaggaggttggaggcttgcagttgagcccaagaattcacgcccatttgcacttccagcccttgggttgacagagccaagacttccaatcttcaacaacaacaacaaaaaggaatttaaggaggaagccaccgtggctttcctaagaattagactttatggcttaagtgggatttatatttaagctggtttaagtccaggaccccttaccaggaagaactgaggttccatatttggaggttggtctcacccttttgggcattttggtcctactaattaataaatttggctgtaaaaaagcctcattaaggagatggactgtgtgaacagagatgagagagcaggcctgtttgcaaggctggcccttgggtggctttgaaagttggattcagggaggtcccatactcctaatgataaagtgtcctgtcctaatgtcgtcacatgtggtgccaattgtctcgggtcattcattttggagatggaa

SEQ ID NO: 548283 - DNA, 1387 bp, Homo sapiens
aagtctttaagtggacagtacgcatgcgccaacttcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcgaaaaaaaaacacaaaacaacaaacacaaaaaaaaaatttggacgcgagccatggagcccgcgaagaaacgctcgtcaaacacaccagcgcttgaggagcgcaggggcaccaaagaagctaaaggaacacggtggcaaacaagcagagaccaaagggagaccccgggaccaaaaaagggcggcgggagcatactcccaccagaaggaaaaacaacgcccgcgcggagggaacacacagagcgggtccagacgagaataacccgcaggagtggagagccaggaaaggccgcaaaacacggggaccatacaacgaacaaaagggggagcccaagaggagagccgccagcgagaagaaaaaaagaaaaagggcccagccaaaagggaggacaacgagggaggcaagaacggcctaacagcagcaacccagcgcgagaaggaggcgcaagcagcgacgacagcagcgacactacacacaaaaagaaaagacatgcaaggacacagaaccagacaaaaccgactagaccgga

SEQ ID NO: 548284 - DNA, 343 bp, Homo sapiens
tcctcctccctccccacccctgtcgcatccacgtgcgacctggaggactggtcagaaccgttactgtgaatgagtgaagatcctggaggaccctgggccccaggccagctcccatcattggggaaacggtaaacccccatgtgttcgtgggggagggggggggaggcaaaaaaaaaaaaaaacctcaaaagtttttttaaagtgggggaaaaacatccaagcactttaattccaatgtaccaggtgaactgacggagctcagaagttttcctttacaccaactgtcaatgccggaattttgtattctgttttgtaaagatttaataaaagtcaaaaaacttgc

SEQ ID NO: 548285 - DNA, 1825 bp, Homo sapiens
  misc_feature (1)..(1): n is a, c, g, or t
  misc_feature (388)..(388): n is a, c, g, or t
  misc_feature (728)..(728): n is a, c, g, or t
nttgctcgtaggtgcgcgttgtcttgtgttcttctgtcgttcgttcctgtgtaggtgtctctactgaagtcgtcgtgactctgtatggtgtggtccggttccagtcaagtctgtgtttgctgttgttgttagccgtcgttgaggggattttcatctttttccgtcgcgcccctcgtcgtgttgtggtcgctctcaccccttgggcgccttttggattgtgtggggagccgtcctttgttagtactgccttagcgtggtcctctttggtgggctcttctcactgtttctgtgtatcaccacgagagtggttgtatgtggcgcgctgcactgagttgtcccccctatcacaacttatgttgagatgttgttaatctcccctcttgctggntgtgttgctgcggtgaataggtagtttggtcacccaaaggcgccccgcttggtacaaccacctgtggggggtgttgtgtgaggccgccattttttcgttgtgatgttgactcagcgcccgtgttgtttgtagcgctccctctccttgcgtggaggtcgtttgtgtggcgatgctatacaggctcccaggggggcccgtctattgtgctcctggtccatcagtgttgagcagcccctcctttgtgattgctccatcacggtaagttgtgggtgtccgctcccccgcgactggttttgtttgtgatgagagcgcctctttttgtttgtggggcccacacagngtgttaattgccccttgttgctctgctctctgcgtgcgcaaggagggatgttgtgtgtttgtgcccgaggcctccttgtggccacagaggggtgtgccccgttttggggtcaccagtgtgaggttcctttggtgggcgccccttgttcgtttatgtgagcaaagatgctccccccttgtgtttcgtgtacacgacagggggtcgctcgtggggattctcacccgtgtgctccccgctcgccacgttctgtggccgttcctcggttgtttgcgccgcgcctccttggtgctctgctccggaggatttttcttcatagaagactgtctcccacagcacacacctttttttaataaagacgtctctctcctcctttgcaaaggggcacacagaaaatgagcacgtctttctctctctcccctttcatacagtcctccccacaattttcgtcacacgcctctccacacattctttgtggagagaacccacactgtgatgagagccacgctttaacactcctttcactcctctcgtgagagagacaccctttgtcgcatccacagcttctgccttctgtgttgtgtacacaccagaggtcgtggagagtcctgtgtgcccaccctctctctgcgcgcccacggcgtctgagagagtgtgtggacacagagattctctttgtgtgtcacagcgtaagactctctgagtgtgtgtcctcttggcgcccacactagccacacacagccttgtgctctcacagggcgcacacgtgtcacatagtctctctgtgatgtcccactcttcttgtccacgagaggcggaccacgagaccacactgtgttctgttttaaactggatccctgtccctgtccctcaagagattgtcctgtgtctcccgcgggagaggttaatgcactttacaccccccgttggggagatttgaggttatatacgaaattgggatctttctgaggagtcccctcggaggggtatgaattgggaggggaaagcttcaaacagaatgtcccttttgtgaagagagggagatggaaattgttttttttcatttgttaaattagtggagttaagattttataaatcca

SEQ ID NO: 548286 - DNA, 534 bp, Homo sapiens
  misc_feature (14)..(14): n is a, c, g, or t
  misc_feature (26)..(26): n is a, c, g, or t
  misc_feature (54)..(54): n is a, c, g, or t
  misc_feature (93)..(93): n is a, c, g, or t
  misc_feature (159)..(159): n is a, c, g, or t
tatggcctgcaaanttagaggctttngttaagaaaggaaaacttaaataaaaangggctgttcgtgtggatgtactcgcagcccccctccagngactaatatgtataaatgttaaatgatattaaatatgaacattagaatttaaaaaaaacacccacnccaacatcacctttcactcctctttaaccaactctccccaaaaaaccccaaatattttccaccccccattccgcccgggattgtctttggcccctttttttaaaaaaaccctcggggccaaccccccggcccataattttccccccgcttggaaaaagccttacactttataatgaggttttcccaaagtccttcttttataagggggattttccactccccccctcgggacccccccctaaaaaaattgttacgccccccctgtctcccacaaatataccaaaaaaacccggccccccccctctcttaaaaaggcttcatttctacacctctccggggcgactaactctcccccaaggttccctacttctctcg

SEQ ID NO: 548287 - DNA, 1725 bp, Homo sapiens
  misc_feature (416)..(416): n is a, c, g, or t
  misc_feature (420)..(420): n is a, c, g, or t
  misc_feature (579)..(579): n is a, c, g, or t
  misc_feature (1558)..(1558): n is a, c, g, or t
gcgtgcccctgagctctccgatgtcctcccgtaccgcctaaccgaggcgagctcagtatgcccaggctcctgctgggaccctagccacgcagcggccgcagagctatgtcccgacgctagtcacgcggcctatgtgaccgggcttgtgaagcgcgctacactctgacaaccttcatggcaggagcagggcacctagtcaggcagcgcggatcattccgctagtgcgactcacctacatggcacttcagccccgctccccggtaccttgtgtgcgctgttctgctaccccactgcgggcatacatatcgttatcctgattcgacaaccacttccacctgccccacgcctttgacgcgctaggcgctgctccgttgtgctattggcctaccaacgacccagtggtaccatacgctttnattntaaactgatacgtcacagtcgcgacgccttgcatcaagccttttgagcagggcgcccacacggaaatacttcgtttaccccgtgcttggaattccccggggaggaccgtacgaaccttgggccattggcccactgcgcactggcgctgcagcaaacttntcttaaggccacttgtggcattcgtatacaggctaaacaccaacaggctaagccaaccccggcggttgtggggtgccccccacagacccgatttcgtacatttggttcataacagtggttacatacacattataagtaacttttgcacccacaaggcacgtggctttcaagtccacctttgcgttttgaaattgcgcgggcccaaaacgcgccaatgcgcggtcgggtacccaagccgtgtggattggaggattactaatgagaaaataccaaacaaaccaagaacgcgaaaaccacttgtggttgtcacgtgcggaacaacaacttggtggggccctttacccaccaaacatcgattttccctggcgggcgagggtcttcacaccaatgggttaactatatggaacccccattccgggtttccttgggtccgccctttttcccccccacgttttccaagaccgcgtggccctaccccgcccaacgcgaaaggccttttattggccgatcccgacgcagttatttaccacctgttcgccccgacaactttaaccagcgcatcacacctgaaatacgcaccaactcctatctaacgtttctattactgtagcgaggtggcccacacgtatatagcgcgcccgaaaattaaaccgcccccacgtttaacgtttatggccgttgggtcccccacaactaaagaccccagaccacattggggcggccttgggacgggggggtgcccgtaatggggtccttggggcacattgcgcgcaacctagtccagctacgcatttaccccgcgcgcgtttaaactccgatattattccccgttccccccggatggtatggctgggccttcggggctaaaacaacgtttttatgtggctctatatgaggagagagaacaatacgctatgtggtctccctggacaaagctaaccaaccaaagcagcaaatcattcacacacaccacaacagnatcagcaacaccaacccaccatcaccagatcgcaaccacacacacacacacagcaccacccagcacacataacacacaaatagcggcgagcgcgacccacatcaagcacagcatcgaccctaccacggcacagcgccagcccacacatcatcatccagctgcatcct

SEQ ID NO: 548288 - DNA, 980 bp, Homo sapiens
  misc_feature (567)..(567): n is a, c, g, or t
  misc_feature (667)..(667): n is a, c, g, or t
  misc_feature (915)..(915): n is a, c, g, or t
  misc_feature (931)..(931): n is a, c, g, or t
cattttgaggccaagcatcccagcccccttctcacatgggattcccctctgcccagagatccctctttccagattcacagaaaatgcctgcccctccaagattaaagcgctttgtcactctctctccctttcccactatgaatattaggtatttcctgcaggtaacttttttgtctgcgcaacagaacttctttggactgccagcaccggccttgagcagcttggccctgcagaaagctcatgatgggatctctgctgagttaagcttattgcattaggaactggactaccggggcctgtcttaggtctgctctggaggcatcacgggagaattttcctagggagactccatatacagcgtgaataaaagagcaggaatatcttgccccctctcacctcacctttttaagagagctgtgagccccaagcatatccaggtttaaatgttatgcttttacctgaagttaaaatattagatacttagccctggatgcacccccctcaccgccgcggtctctggaataaacgattagtcaacttgttctttgttatgttcctgaaacaccnctatttcctctcttgaaggtttccctgatgatctgttcccgtagctcctcctcccatcccccttacccggcacattggtcagtctctgctgattctctgntcttgccagtttgagctggcactgagcctgtaaagatgttctgctttttaaaaaacaaatggtgttgaggctgcagccctgtgcgccctccagtctctgattttgagcagttccattggaatcaaacccgactggatcgcagcatatgctatgcctcgagagagccttttcaaacaaagctcgaggtgaaagactgggaatgtatcttatttaaggaaaacttaattcctcttctttattttaatatnaaactttttacatatnacagggagagaatgggtgagtcacggggggcatgggattggaaaggttt

SEQ ID NO: 548289 - DNA, 248 bp, Homo sapiens
  misc_feature (95)..(95): n is a, c, g, or t
  misc_feature (161)..(161): n is a, c, g, or t
agagattccctgtgtgaacctaggcaggtcccatcttccctctggaccaagtactcagtctctttgttgacgaaagggaataaatgactgacctnactggggactgactgagacagatccaggaccacagactatgacgaacactacttacttaaacaganctgacactgacactggggtttgaaccaacaaaaccaaaccaaaccaaaagaaaaaaaaagtttgtgttcaactatgttgcaacagag

SEQ ID NO: 548290 - DNA, 527 bp, Homo sapiens
gatggcagattcttcttctgagatgatgattggaactcatgaaacatgacacatttagacagcccagcgttgatgattagaaggcgatactttcggttggagttgagaaaagaatggtccccgtgcagcagcttctcagatcctgagtcagagaaaagaaacacctgtgtgttgagagaaccaatcgtggctcagtaccccgagttgacaagagaaagtgaaaaaatcattgcaaacttcaagaaaaaaatgaaagttaaaaactggggaacattatttgaattgcatagaacaacgtttgggaaagtaaccaaaaattcttcttccgattaaggtagtgaaacttcttgtacgtctcagtgactcagttgggtacttattctgggacagtgcaactacgggttacgccacctgctttgtttttaaaggattggtcattttaacttggtcggcatggtatagatagcattgtgggagacggaataagagccagtaagtgggccaccactattggtcactgtgtaagg

SEQ ID NO: 548291 - DNA, 1069 bp, Homo sapiens
  misc_feature (297)..(297): n is a, c, g, or t
ttactatcgactttcatactctctgactgccgtggaactgctacaacctttatacacagacctgtaacctgtctgatcactcctgcccttctgcccctttgcccattggatgattcaatgtatctttcgacgcagttaaacgattatactcaacctcgaggagcccgcttcgatctagacggcatggctattctaccgtagtcgcttatgactcccactcaaaatactgccgtggagccccgtcgtgcgctttcctggtatcatcattttacctgaactcctcatttattaattaanaccaccacccttcatctcatgtgatcaaatacttagcactcacgcgcatacaatcatagtgaccagctaattgtaccctatgaaaggtcatataaactatgatactattcagcgtccaagaattcctaatggcataaccagacgtgttcattttaaaatttcagtaaccagtaatttccccgtccatgccagttcaccgattcggaacttcattacacctacctgagtgcagagaacagactttcctaatccatctccatcccgctgaggcgactccaactgtatattgacgattgtccttcgcattaccccagttaacaaatgctgcgcacggcattccgcgcgcattccacgaacctcataaagccactaaggcaacagggcccgacgttaaacaaacgttcgcagaacttggaaaaaacactgctaaaccatggggggaatcttgttaaaagagcaacctttagtggcggcgggtggtgcccattagtttgggccaaactttatgcttacacagaggatttgtacaccgcctcttaaggggtacaatattaaaacagtgcaacacggtggtatacgtgtggtaccacccacgctgcaatatgctaggaatgttggaacaggttagtcttactggaggatgactactgagcacggttgtatacccagaggggagataaaccaaaatatacccctcaggccgataaaacacacggtatatgtgaaccacacgtaatatacaaagaagagagtaaaacgataaaaaaaacac

SEQ ID NO: 548292 - DNA, 159 bp, Homo sapiens
gggtatatacacatatgtagcataaaatgcgtcagaaatttgatctattcttgatctgtactcttcgcatggactgggaagttcttttaacatcattaaatattaagacgaccatctcttctattaaagttacacgtacagtgttcggatccagtttcg

SEQ ID NO: 548293 - DNA, 252 bp, Homo sapiens
  misc_feature (118)..(118): n is a, c, g, or t
  misc_feature (126)..(126): n is a, c, g, or t
accccccgatatgcttttttggaatagccaaaaatgaagtttaaaaaaacgttttccacatgcctcggcgtcctgggtaaccggtggtcaggcaaagctccctctccctggggggtgngggggggntccgccccaggaggctcccgcccctcccagatcccagcccctgacccccgcccttcccgggccgttgggctccctgttttcaaataatccaccaggtccaaaaacaccaggtggatgttttggcta

SEQ ID NO: 548294 - DNA, 197 bp, Homo sapiens
ctcatctccagtgtcacgtcatgggggcaggtaagttgggcgaggcatgaagtgcagagggtgtcacccctgcctgtatggaggtagaatatacataacataaattatgcattctaagtgtacatttcgtcagttgtagacatatttatacacccatgaaacgaccacaatcacggtacccatcaggtatcacagcc

SEQ ID NO: 548295 - DNA, 871 bp, Homo sapiens
  misc_feature (212)..(212): n is a, c, g, or t
  misc_feature (703)..(703): n is a, c, g, or t
ggtagtctgagcgctacccggttgctgctgcccaaggagcgcggagtcggacgcaggcagaccatgtggaccctggtgagctgggtgggcttaacagtagggctggtggctggaacgcggtgcccagatggtcagttctgcccgtgtggcctgctgcctggaccccggaggagccagctacagctgctgccgtccccttctggacaaatggnccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtaacaactccgtgggtgccatccagtgccctgatagtcagttcgaatgcccggacttctccacgtgctgtgttatggtcgatggctcctgggggtgctgccccatgccccaggcttcctgctgtgaagacagggtgcactgctgtccgcacggtgccttctgcgacctggttcacacccgctgcatcacacccacgggcacccaccccctggcaaagaagctccctgcccagaggactaacagggcagtggccttgtccagctcggcatgtgtccggacgcacgggccnggtgcctgatggttctacctgcttgtgagcttgccaagggggaacgtatggctggtgacccaatagccaaacggccacttgctgggtccgatcacctggcactgtggccccaagaacactgtgtgtgacctggatccaggaataacgtgcctctccaagggagaactg

SEQ ID NO: 548296 - DNA, 464 bp, Homo sapiens
agaggacaccggtcagtaaggtgtgccacggaagtgtgtgtacactcgctgtgtgcccctcacagagataagatacacagagggctacgtgcaaagtatcctcccggccccccacatacagacaggggtaccattccagatcaagggaggcatatccccagcagtgagcatgtcccctcataaacaagtatccctccaaaagacaggcacttcttccaaaggcatccatctctcatatacacgtgcatgtacacacacacacacgtaatagcattttttttaacaaggaatgtgatattgatgtctcagaaacgggttgttactaaaatctctataacctttgggtgtccaatgaaaaggttaccagaaagaaaagcctgtaatttgggaagctcttttacaattattttcctgttgtgctgaagtaatttggcttttcacctttcttaaccctactataatat

SEQ ID NO: 548297 - DNA, 223 bp, Homo sapiens
acaaaggtataatacacatatgaaccctgggaataatgcaagcaacaactagaggaaaactctgtaaggtggtaaaaggctggctaactggtttaggatcccagtattggataaatagcacagtagcagggtgtcttatgatcctccccctatccaacagaacaaggtgacacagacccagcatttcctgatccctgacagaacagcagatggcagcccaggt

SEQ ID NO: 548298 - DNA, 842 bp, Homo sapiens
  misc_feature (183)..(183): n is a, c, g, or t
  misc_feature (674)..(674): n is a, c, g, or t
aaggctgtgcggcggatttgagagtgatggacgcggcagactattgcgcctcgtgagcgttgggtgcgttacagcggtctgatgttgacacacaggcccatatggtcattctgtaatgtagctgctgcctggaccccggaggagccagctacagctgctgccgtccccttctggacaaatggnccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtaacaactccgtgggtgccatccagtgccctgatagtcagttcgaatgcccggacttctccacgtgctgtgttatggtcgatggctcctgggggtgctgccccatgccccaggcttcctgctgtgaagacagggtgcactgctgtccgcacggtgccttctgcgacctggttcacacccgctgcatcacacccacgggcacccaccccctggcaaagaagctccctgcccagaggactaacagggcagtggccttgtccagctcggcatgtgtccggacgcacgggccnggtgcctgatggttctacctgcttgtgagcttgccaagggggaacgtatggctggtgacccaatagccaaacggccacttgctgggtccgatcacctggcactgtggccccaagaacactgtgtgtgacctggatccaggaataacgtgcctctccaagggagaactg

SEQ ID NO: 548299 - DNA, 270 bp, Homo sapiens
  misc_feature (159)..(159): n is a, c, g, or t
cgcatcgggtatgggtggggggatcatatagtcactccaggtttatggagggtcttctactattaggacttttcgttcgaagcgaggttctcaaatcatgaaaattattaatattactgctgttagagaaatgaatgtgcctacagatgataggatgtntcatgtggtgtatgcatcggggtagtccgtgtaacgtcggggcattccggataggccgaggaagtgttgtgggaagaaagttagatttacgccgatgcggggggtaccgag

SEQ ID NO: 548300 - DNA, 305 bp, Homo sapiens
  misc_feature (22)..(22): n is a, c, g, or t
cccccccaaacggggggggggnacaccccccccaacttttgggtggggggggggggaaaaaaaaaacaaccccggcccgttaagggagagattcacccctctcccaggagcaaagccacccaccccgacatgactcttttggcggaggtggccctcagaccccctctgcaaacaagggcctgacccccgggcccctccccaggctcaggggctttggggccaaatccaaaaaaatttgctctgctgccctgaactcttccggcaatttaggtttttccttttttttttctttttccatatggcca

SEQ ID NO: 548301 - DNA, 1112 bp, Homo sapiens
aagtctttaagtggacagtacgcatgcgccaacttcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaatagaccaacaaccaacaccagaccaagcgcccagccacacccgccccacaccaccgaccgccacccaccacacctcacaccgccaaacacaccaccgctcgcggcgccaccccggcaccccgcacgacgactcacacacacacccgaggggcggcgcgccgaccaagtgtacacaagaccgcgcgcacgacgcgggcccaagcacaccccgcgccaacaccgcgggggccctcccgaaacagcgccggg

SEQ ID NO: 548302 - DNA, 518 bp, Homo sapiens
  misc_feature (4)..(4): n is a, c, g, or t
  misc_feature (62)..(62): n is a, c, g, or t
  misc_feature (174)..(174): n is a, c, g, or t
  misc_feature (176)..(176): n is a, c, g, or t
  misc_feature (200)..(200): n is a, c, g, or t
  misc_feature (214)..(214): n is a, c, g, or t
  misc_feature (221)..(221): n is a, c, g, or t
  misc_feature (240)..(240): n is a, c, g, or t
  misc_feature (244)..(244): n is a, c, g, or t
  misc_feature (304)..(304): n is a, c, g, or t
  misc_feature (331)..(331): n is a, c, g, or t
  misc_feature (343)..(343): n is a, c, g, or t
  misc_feature (350)..(350): n is a, c, g, or t
  misc_feature (353)..(353): n is a, c, g, or t
  misc_feature (360)..(360): n is a, c, g, or t
  misc_feature (368)..(368): n is a, c, g, or t
  misc_feature (403)..(404): n is a, c, g, or t
  misc_feature (441)..(441): n is a, c, g, or t
  misc_feature (475)..(475): n is a, c, g, or t
  misc_feature (482)..(482): n is a, c, g, or t
ccgngctgtctccctcctccagggccaaggagcgggccccgcgcgcgcggcccgccagcacntctccgtccccgggcgcgcacggccggcgcggcggcccagaagggaagagctcgtcgcgcagcccggcccgcacccccgctcctggagttccagccgctcgccctctaaatntngctcgcgctctgggagaagcggcnccacagccccagcngctcgcngtcgcccaagaagcccctnagcngggacaaggacggcgagggccgcgcaaggcactctgaggccgagggcacccgcgcccggngccgctcccgcagctactcgcccatcngcaagcggcgcngggattngtnaagcttnatggagcngcggcgcatcaccagcgcccgcaagcgccctattnnatattaatgggtcagctcctttttttttttcagctgnttgagcagcgaatattcgaatcggagctatagcngcagccncagccccggctacagctacgggagctacagcagttg

SEQ ID NO: 548303 - DNA, 358 bp, Homo sapiens
  misc_feature (358)..(358): n is a, c, g, or t
agagaaacatgagattgagttttaaaatctataaaaaacatattaatcatgctctcctctatagcagaatcagatatttagacacagaacaggattttatgtaaattgctttaaggttggggaggtggaacagggtatcttttcatcaattagaaggaaaggttgaaacttctgaatacctttataggggtttctcttactaatcggctcttgctagaactggtccaacccaacttgctcagagatctcatattgaagcaacatacaggcaatccacatctttctttccctttgaagcatagccattggatgggatgagaggacacaggctgttggggtcacacaggcttgcctgtgn

SEQ ID NO: 548304 - DNA, 1354 bp, Homo sapiens
aagtctttaagtggacagtacgcatgcgccaacttcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcgaaacaaaaaaaaaaaaaacgaaaaaaaaaaaaaaaaaaaaaaaaaaaaaaaaaaaaaaaaaaaaaaaaaaaaaaaaaaaaaaaaaaaaaaaaaaaaaaggggggagagcgaataaaagacaaccccaggaggaggacacgaacacatgacggccgacccaacgacagttgtcgtgttaagcaaaaagaaggagtcagcgccacagaagagagataggaccgactgaatcaaataggaggaaggagggagagccaaagtaaaaacacaggagcaggggagagagaaacaaagaggcatcgagcggagccatctgtgggccgaagaagacaaacactcacattgcgaaggtagcacaaaacatgggcgaaacaacacaccgaagggaaaagtaccgagcacgcagggacgacaaataaaccaaacggcgcgagataagagggaaacaccaacgcgaacaagagcgaccagcaagacgactgcgatgaagagacat

SEQ ID NO: 548305 - DNA, 126 bp, Homo sapiens
ctgctacgggggaagtgtaaagccttttctgcttgataagagaactggccaaggtgccgggctgagggaaatgaatgcccaatccctgcaggatgcagcgcagggaggaggaacctccgttgcagg

SEQ ID NO: 548306 - DNA, 150 bp, Homo sapiens
ccgtactgcagccgggttcatacacatataccacacattggggtctgtaccaaacattctattactctgccatttctaccaacttgtcagtttaaaactttattaaggctgtaatttgtccctactcagttgcaccatgaagagaaaata

SEQ ID NO: 548307 - DNA, 103 bp, Homo sapiens
ggatccaccccgatgagccaacaaaccaggactctgccccttctgtttccattttaatcatgtgggatagtcagctgtaccaagcgcccttggcccttatcga

SEQ ID NO: 548308 - DNA, 1192 bp, Homo sapiens
  misc_feature (875)..(876): n is a, c, g, or t
  misc_feature (1192)..(1192): n is a, c, g, or t
aagtctttaagtggacagtacgcatgcgccaacttcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaatgcacacaaaaanncacaacacagggggacagataaaaatccccgagggccccagataagcgaacccacatcgggccaaggggccccaagggaacacgatatacgcaggccggcagacccccacaccgcgtgcaggaaaagcgcaggagaaccgacagaccacaccagggggacacacgaaaagcccggaacggacggcagcaaacaaagtacggagaccacataccggagaggaacgtgatatcgtcaacgaccgacgacaccagccaacgaaccacacagcaagcagaccagcagcacgataccgacgccacacaacgacgaaagcan

SEQ ID NO: 548309 - DNA, 866 bp, Homo sapiens
aagtctttaagtggacagtacgcatgcgccaacttcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttcaatttgagagcaggtactatttattaaccaaccagcttag

SEQ ID NO: 548310 - DNA, 472 bp, Homo sapiens
aacggttgccgggataacggcgggcgtcaaactcactctaatcagcttagtggcgaactgactgccttgtagggagtcgaagctccacattttcacctttcctcgatttatgaaggacacacatgtcgcttttaaaaatcgcctccgtggcctgtatcgccttgagcctgggtgcttgccagagcctgttccaaccggcctacctgaagccgctggacaccaccgccgacgcctccgagcagatcaaacccggctgcagcagtccggattgcccgctggtaaatatcgatactgtgcacttcccgtccgagccgcagttggaccagatcatcgaacagcgcctgctgcagatggcccgcacttcacctggccaggccatgcccgacaccctgaacgcctaccgcgacaagttcttgcgtgagtccccggaccgcaacagcatgtacttgcaggccaaggtacgtgagcagca

SEQ ID NO: 548311 - DNA, 390 bp, Homo sapiens
ggtcacaccattctcctgtctcagactcccgagcagatgtgactacaggtgcctgccaccacgcccggctaattattttatatttttagtagagatggggtttcacatgtgttagtcaggaagggctcgatctcctgatctcgtgatccacccacctcggcctcccaaagtgctagggttacaggcatgagccaccacgcctagcttcttgagtggttttgtcatggggtgctgaattttgtcagatgctttttctgtgtcagttgagaagatacgtgttttatgtggttttttccccttcatatctgttaatgtgctgtggtacattgattgatttcatatgttgaactatccttgcattccagggagataccacttgctggtggtgtt

SEQ ID NO: 548312 - DNA, 860 bp, Homo sapiens; identical to SEQ ID NO: 548263

SEQ ID NO: 548313 - DNA, 1234 bp, Homo sapiens
aagtctttaagtggacagtacgcatgcgccaacttcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaaaaaaaaaagaaaaaaaacaaaaaaaactttggtttggcgccggctctcgggcccttcgagaaaaggttttcataaaacaattctcggtttgggcgcgcggggggcgcccatgtatgggtaagttagaactggggcacgaatgagtggttcccgtaggaaagactccggcgctcattaggacacggttggcttggagttcctccttacacaaataaaaaaaccggccggggggaaaccgagagcgcggttcttggaacaaaatctccaaaaatgagagtctcggaggggcaccataacgtggggactcaactaaacagggagtcacacggaagcccagaatttcaattatagccccgggctagtgc

SEQ ID NO: 548314 - DNA, 208 bp, Homo sapiens
accaggcagcctgaccgcgatgatcagtgataaacctctggcaagttaatgatctctacagcctggcaatggtactctgttggggttcaatgtgcgggtgtatcggctgtcagatcgagggtctcagcctggcggtgcaggctggagagctcactgcagcctcgacttcccgggctcaagtcttcctccagccccagcatctcaagaa

SEQ ID NO: 548315 - DNA, 860 bp, Homo sapiens; identical to SEQ ID NO: 548263

SEQ ID NO: 548316 - DNA, 689 bp, Homo sapiens
gcagccatgcacctgatgactgggtacatcgtgatactcgatcaatgtggcgcgtccttgctggtctcgtgtgtgggcaatcgctgccctggcatgtgtgacgactcctgatgacttggactcctcgaggtcccccactcgattcctcccccatgtggcttgtaggcgaattctcgcccaaggggagaagcaatgacgttgccacccagtacagcatctaggtactagcgactgcacgcatcacgagtagcaattcaagcgcaatacctaacacctcaaaaacgctctatagagcctatcccgaagtccatcgaacccaccaaaccgacgatcagagacaatccgcacgctttccaagcgctcctcctccagtgcacctctatatatcgccagtcgcactccctatgtgtctatccaagccacaaacccgctcgagaagcgattcgccaacaccctaaaaatacctctgtcctacagtctcgatcccacccctaggggccatggtcatgtgcgagcgtccgtcccacgttaaacttaatgtcccacactcatctgttccgaccaggctgagccttctcagtccaccacccttgcggactgcgcacaaccgcccaactattggcgcagacacttgtaaatactacatcactggtcccaaacgcgtgactcttgaccattaacaaccctcc

SEQ ID NO: 548317 - DNA, 914 bp, Homo sapiens
  misc_feature (872)..(873): n is a, c, g, or t
aagtctttaagtggacagtacgcatgcgccaacttcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcggttcattcatnnaaataagcctgttgatctggtcctccctgttgccagcatct

SEQ ID NO: 548318 - DNA, 129 bp, Homo sapiens
  misc_feature (44)..(44): n is a, c, g, or t
  misc_feature (77)..(77): n is a, c, g, or t
cacagactcagagagaacccaccatggtgctgtctcctgccganaagaccaacgttaaggccgcctggggtaaggtnggtctgtacgtggcgagtatggtgcggaggcctggagaggatgttcctgtcc

SEQ ID NO: 548319 - DNA, 303 bp, Homo sapiens
ggggcgggttaccattttcccccgggaaccgcttttgccctttggccctttttggtggccccattggaccaggttggcccaaaagccggctgggtccgggtcgggatttcccggatttcggtcccaggttttaccttttttttttaagccttccggtttgctttccattttttgggcctttgtttttggtttggcccgccgatggggccattttgtttctttttttgttttggcccttatcctggtttttagcctttattgttttttgtattttgttaattataaaaaccctggacaaaggga

SEQ ID NO: 548320 - DNA, 340 bp, Homo sapiens
  misc_feature (1)..(1): n is a, c, g, or t
  misc_feature (111)..(111): n is a, c, g, or t
  misc_feature (129)..(129): n is a, c, g, or t
  misc_feature (131)..(131): n is a, c, g, or t
  misc_feature (157)..(157): n is a, c, g, or t
  misc_feature (159)..(159): n is a, c, g, or t
  misc_feature (165)..(165): n is a, c, g, or t
  misc_feature (172)..(173): n is a, c, g, or t
  misc_feature (180)..(180): n is a, c, g, or t
  misc_feature (191)..(191): n is a, c, g, or t
  misc_feature (201)..(201): n is a, c, g, or t
  misc_feature (205)..(205): n is a, c, g, or t
  misc_feature (211)..(211): n is a, c, g, or t
  misc_feature (226)..(226): n is a, c, g, or t
  misc_feature (229)..(229): n is a, c, g, or t
  misc_feature (267)..(268): n is a, c, g, or t
  misc_feature (271)..(271): n is a, c, g, or t
  misc_feature (275)..(275): n is a, c, g, or t
  misc_feature (287)..(287): n is a, c, g, or t
nacccatcccaccgcttcaagggagaggaatcggggtgggggcgcccgcagcaggggagagacactacacagggcctgggaccgccaagcacaccagctgcgagctcctgnagggcagacacatggacncncggacactgaaaccacgagcacggcncngccacngggaggnntggtggngctggaggccngacctcggcngctnctgccncctgctgccctcttntgncacgagttccttggcgaggagccttgtccgtgttactnnagngccncgtgactttatntgatggcagaacgtctcgctttctgcatctgtaagctgggccagtacaccgta

SEQ ID NO: 548321 - DNA, 906 bp, Homo sapiens
aagtctttaagtggacagtacgcatgcgccaacttcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgagaaagaccaccatttgtagaagtggagatgctggcacagggagagacagatcacaggttattagaagatgactagtgtgtaccggatattttctagcggtgggtataaaagtctgtctcatgaaaaaaaaaaaaggggttttgggggaaaggtaaagggggtgttgcctttgtgaagggatcggccaagggtatgaaga

SEQ ID NO: 548322 - DNA, 829 bp, Homo sapiens
aagtctttaagtggacagtacgcatgcgccaacttcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgagaaagaccacccattttgtagaaggtggagatgctggcaacaggcttattagaagaatgaactaaggtgtctaccatgattatttttctaagctggttggttaataaacagtacctgctctc

SEQ ID NO: 548323 - DNA, 161 bp, Homo sapiens
gactatagcatgtttcttgtatgcggaagtctctgaaatcagatagcgccagatccgcaaaagcgaggaaacccgatgtgtccggcggaaggaaccgccagtacaacggccctgaggcgagaaagagattggtcactgaaagaactcaaagaagtcctgtg

SEQ ID NO: 548324 - DNA, 167 bp, Homo sapiens
  misc_feature (75)..(75): n is a, c, g, or t
tgctccaccgctccaagatggaaagttacgcaacttatgggacgtttcagtcactggaataagaacttgaagatngatatgacatgatctaatttagatttttaaaagctcattcgtatagctctgtggagaacagggtatggctagaaggagcggtgagctatcgg

SEQ ID NO: 548325 - DNA, 208 bp, Homo sapiens
tcagcttctttctgatgtcgacactagaggagtccccccatggtagacacacaccaagtagcactcctagcccgtgaatataggaaccagcccgaacccgaggttatctgatttttggttcctctgaaaattagcttttgctggatgctagattcagttctggacttactgagtagtctctgggtttttgacattgttaggctacctg

SEQ ID NO: 548326 - DNA, 834 bp, Homo sapiens
ctctagacgatcccttgtctttactagatgccctgtacataccaagatgattttttattctcccttctccccatgtggtttcttctgcatagagagtcctattgatcagtctgacccatggtatttagaattgcgatccctactgtttcattattcctttttctcccccatgttgaaaaaaataaatgtcctgagatgcaagatcagggacactggagcactgacatttagttcagtgcaggaactgaaggcagatgtaattcttaagaagcgtacctgttattatgaaccatcctcaacaaattgtagtggatcttgttttctcatagatacagcagttaaattttttaataaaagtaactaagagttatttggatgtattttagcatgcactgagcggaaagtacgacatttcttcattgggtaagtcctgattctttatgatcctcacttggttccagggccccatgcatctaagggtgtctcagagcatcctgcagtgctccagcatgatcgcagggaaagctataggaggaaagagtcaataaagtttagtttctcacctccacctcacccatatatgacagctggttatcatgagacacgtgcacaccccacacgccctgtacatgtttactcattgggatagcatgtcaggccagaaggctccatggtcatttctatgaaggtactttagcaggtcttcaagaaggcaagtggcctgggtccctgcctccccaaattgcaagctccctgctttatgtaggagacctatgtgtatattacagttctgtgtaagattattttgttattcttacccccacacccaccccc

SEQ ID NO: 548327 - DNA, 471 bp, Homo sapiens
  misc_feature (1)..(1): n is a, c, g, or t
  misc_feature (136)..(136): n is a, c, g, or t
  misc_feature (162)..(162): n is a, c, g, or t
  misc_feature (190)..(190): n is a, c, g, or t
  misc_feature (202)..(202): n is a, c, g, or t
  misc_feature (217)..(217): n is a, c, g, or t
  misc_feature (230)..(230): n is a, c, g, or t
  misc_feature (242)..(242): n is a, c, g, or t
  misc_feature (250)..(250): n is a, c, g, or t
  misc_feature (338)..(338): n is a, c, g, or t
  misc_feature (348)..(348): n is a, c, g, or t
  misc_feature (381)..(381): n is a, c, g, or t
  misc_feature (385)..(385): n is a, c, g, or t
  misc_feature (413)..(413): n is a, c, g, or t
nctactctcggaagtcagaagctgaaattgatatggaactatttcatcagaatcatcttattgtgaaggttcctccctatcatgaccaacatataacttggcctgtgtcagtgggaatatatgtagtgaaaaatgntggaagatctcatgatgtccacccantcacttacactccagacccagcagcagntggtgcttggantgtaaatgtgaaganggaaatatctagnccagcaagaccnggctcttnggaggaggccatgaaagcaatgaaaactactggatgtaatttagataaggtaaatattatccctaatgccctgatgactccactcatnccaagcagtntgattaagagtgaggatggttactccaatggangtancgggagaaaaagatcttccactattttnaagatacaaggctttggggctcaactcaggaaacattaggaacatctcaaacatggag

SEQ ID NO: 548328 - DNA, 665 bp, Homo sapiens
gtactatttatttgtgcttttagagccagaagatgggtattcttcaaactatcattgatttctgatgtctcctgagatgctattatttaccataaattcctaaggagttcgattaatacagtgcgcattatctccagaccctatattaggaatgaagtccaaatgttcacagcagaggtagtttggactgtggggagctcattgaattgagacgaactttatatgtcatgtttacccaggctctggacttaaatgaagcgggtttaatacctggatggttttctccgacatgtcttaaagatgcaacatacggggggaatacttgagctgagaggctattgcggcttattatctgtgttgaaggaacagatgctggctttcaacccgacaagtagaggaacccgtgcagatctgccgtggttcagctccttgctcttttgctagatgccaccagcgctagggggtatcgatcacatagtactccctgcggcaacctgacttgggcctctaggcctttcacatgcccgtcaatgaaatgtgacagccctcatgatggaagaggcctaggcacttgctgctccatagaaatgcccgttcaggccggacatttcagaacaacttttcaacgtttatattcgggcagccttgaaatcttcatgtggtat

SEQ ID NO: 548329 - DNA, 424 bp, Homo sapiens
  misc_feature (33)..(33): n is a, c, g, or t
  misc_feature (405)..(405): n is a, c, g, or t
  misc_feature (417)..(418): n is a, c, g, or t
  misc_feature (420)..(420): n is a, c, g, or t
ccctaaagatatgggtagccttataaaaaattnccttaatagtaaatgggacatgaaaaaggtcatttgccttacatctcctaaattcattttgatgggaaaaatagtggaaaaatgtttgccagatacccttttgtttgtttgtttttttccataatagataattgccactaaaattgaagaatggcccaggtccgttggctcatgcctgtaatcccagcactttgggaggccaaggcgggtggattacttaagctcaggagttcaagattaacctggccaacatggcaaaaccccgtctctactaaaaatacaaaaaattagccaggtgtggtggtgcacacgcctgttgtcccagctacttgggtgactgaggcatgagaatcacatgagcctgggcaacanggtgagactctnngnccaa

SEQ ID NO: 548330 - DNA, 237 bp, Homo sapiens
  misc_feature (99)..(99): n is a, c, g, or t
tgggtcagtctagagatcccgccacggtagattgagccacaatatattgtttggagatgaggggcagcagttttaatggacttggggtacatgaatcangcatgcatcatgtggagggctccgccagctctgacctgcaggactggcagccagtggtgcacatctccctaccgagcccagagctcttctctgtgcagagtcactgtgtcatcgatgagcggactgatgtcttgtccc

SEQ ID NO: 548331 - DNA, 89 bp, Homo sapiens
tggccaagcttttcatctttgtgtctgcagagctctgaagcaactcttgcgtcgcggggtctccctcctgttgctttcctaaaccactc

SEQ ID NO: 548332 - DNA, 198 bp, Homo sapiens
ctctcctctaatggctcagttcttgtactcagagggctctagcattccatgtgcaacctgaggtggcactgaagagaggacagaactagaggagatggacttaattttacagcaggagggctggcacgttagacctcacacgaggaactccctggtgctggcgctgctatacgtgctcgctgagggactcctctagag

SEQ ID NO: 548333 - DNA, 391 bp, Homo sapiens
gcgaggccttgtctctcatccatcgtcggagggcaacatctcagcacctggtgccgaaggaggtggggtgggtcctccttagcccgccctgccccggctcaggccccagccgtcagccctggggcaggcctgggatccccatggttgcccgggcagcacatagcaaggctcaaggaagagcaggctgatccctgaaccctgactcaggacttggacgccatagtggcccgggaccgagaccttcagcagttgaggctggggctagtggtcccagcagcccagcccccaccctcctggcagcagcgccaggaaggctttgacaattacctccgtctgatctacggctctggcctgctgggcatgcagtctggaagggggtcccagcagtgga

SEQ ID NO: 548334 - DNA, 387 bp, Homo sapiens
  misc_feature (265)..(265): n is a, c, g, or t
cggtcaccatgcccatattttttggtatcttgggtagagatggggtttcaccatgtgggccaggcgggtctcgaactcttgacctcatgatccacccgcctcggcctcccagagtgctgggataacaggcgtgagccattgcgcctggccaatgtctagtttttctaagagctcttagtgaagtagggggttcagactttaaataatagggcatggtgataagtaccgtgatagggcacttgtgagtggtaaaagagcatagggnagcagaataatatatcctttcctatttccacggctaataatttgaagttcaaagaacctgtaatttatggagcacccattagggggcttgcttttaaaaaacaagaagggtgcatgggggac

SEQ ID NO: 548335 - DNA, 187 bp, Homo sapiens
gggctcgactcctctaacacacactgtctccctctttccaacgggccgctatgggcagctgtgtaagcaggcttcaggggtggcaccgtgtagcgatgacaactacgtctgttggtaaccttttcactaccatgtgccttggtgcctggattacgtgtggatgattacatcacgtcacgatctgcca

SEQ ID NO: 548336 - DNA, 320 bp, Homo sapiens
  misc_feature (154)..(154): n is a, c, g, or t
tcactatctgccagctcggctggtccagccagggatgctctgtgcatttccactgtcattttaatgttgcaatctgtcacgacagcagcacacttggcatggtgcattcaaccagcaacactcaaccattcttgtgcaaacagtttcccacatntggcagccatcattgcacattttccaccctcagtcccagccagctcctgcgtgcctccagttcaacatcacagcatgcaatgcaagcacccccattctggcacaagcacacttgtgccctgctggtcccagcagctgcatgccatgtgcccattgcatggcagtca

SEQ ID NO: 548337 - DNA, 407 bp, Homo sapiens
  misc_feature (143)..(143): n is a, c, g, or t
  misc_feature (191)..(191): n is a, c, g, or t
  misc_feature (244)..(244): n is a, c, g, or t
  misc_feature (274)..(274): n is a, c, g, or t
  misc_feature (380)..(380): n is a, c, g, or t
  misc_feature (394)..(394): n is a, c, g, or t
gagtttcaccgtggtagccaggatggtctcgatctcctgacctcatgatccgcccgcctcagcctctcaaagtgctggaattacaggcgtgagccaccgtgcccgggctcttttcaatctttttcatgttggttcctccttgngatcattttgataacgctcgtcagctcccagtgtccccttttccttgntcttaaatttccttgccctgcataactctgtggagcaatgagataaaataganaataaataataaccgttcaaccacaaaaanggaccttttttactttcttctgggcccaggattattttatttcgggtaccttccatgctctaatggcccatgattggccacccatcggtaatttctttccaccttntaccaaccaactgnagctacttggggg

SEQ ID NO: 548338 - DNA, 243 bp, Homo sapiens
gacaacgacgctggacgctgtgtggagaaaacgctgtacccactcagagaagaccaacaggaaccatagctatcggactggcttgaagatcaccagccttaccgggatagagtgtgggtaagacttgtgcaaccagggcaactctggccgggctgtcacctatacccgaagccgttacctcgaatgcgttcctctagctcatcagacatcagctgtgagaggggccggcaccagaggctagca

SEQ ID NO: 548339 - DNA, 367 bp, Homo sapiens
  misc_feature (241)..(241): n is a, c, g, or t
agttcggcacgcaggggtggacaccatataatcagctgctagtgtggctaggataaaattgggcagcggaacttggaaagactagactggctgagtcttctggctttcatctttctcccaagctgggtgcttcctgccctcgagcattggacttcaagttcttcagcttttggactcttgggcttacaccagtggtttgccaggggctcttgggtctttggccacagactgagcgcagacnttcggcctccctgcttctgaggttttgggactcagactggcttcctttctcctcagcttacagatggcctagtttaggacttcacctagtgatcctgtccgtctagagaaccctgactaatacaga

SEQ ID NO: 548340 - DNA, 474 bp, Homo sapiens
  misc_feature (70)..(70): n is a, c, g, or t
  misc_feature (243)..(243): n is a, c, g, or t
atctgcaacacaaaaaaaccctaggccacagctccattcctccttttaagaaaaaaaaaaaagtaggcancaatctgaaaaagaggaaagacaagaatgatccactttgaggtgccgtgttagttttagggtgcctctctttgcaagtgtttgtgcaaaatgaaaaagtttgagggcatgccaggtttactagtacccaaactagttacatattatggtctgttttgcacattttaagctaanaggcaaattacatcaaagaaaaattcatagcccaaaggtcaatctgcaactcaagagttcctaagttctctacttctctattttcttttctgcctgctttaaatctgctgttacttttctactgagacaaaacccactgtttagatccaatcttcttcctttctgtaaaccagtgagtttgtattaatatcttatggcttaagttctgaaataaaaaatgggatctttcta

SEQ ID NO: 548341 - DNA, 177 bp, Homo sapiens
gcccgtaccgatcagcctacgcagcacttctcccactttggcccaatctccttctcccccagctagggggacagggactggcaactccctgactggtgtgctgaggcatagtgactcttatatctgtgtgtctttggctaaatatgcccttttcatattaataaaagatgatttgga

SEQ ID NO: 548342 - DNA, 902 bp, Homo sapiens
  misc_feature (777)..(777): n is a, c, g, or t
  misc_feature (785)..(785): n is a, c, g, or t
  misc_feature (800)..(800): n is a, c, g, or t
  misc_feature (840)..(840): n is a, c, g, or t
  misc_feature (851)..(851): n is a, c, g, or t
  misc_feature (854)..(854): n is a, c, g, or t
  misc_feature (863)..(863): n is a, c, g, or t
  misc_feature (870)..(870): n is a, c, g, or t
aagtctttaagtggacagtacgcatgcgccaacttcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgagtggatgagaaaagacccccatttgtagagggggatgctggcacgggggccgatcacaggtttgaagagnctagggtnccgatattcctacgnggaaaaagacgtcataaaaaaaaaaaattgggcgcccaanttaactggggnccngagagaagnagaggangggcaaacgggggacatggtgtacaaccgacg

SEQ ID NO: 548343 - DNA, 255 bp, Homo sapiens
  misc_feature (179)..(179): n is a, c, g, or t
  misc_feature (208)..(208): n is a, c, g, or t
  misc_feature (242)..(242): n is a, c, g, or t
tttccccgggaattcaccttgaattgatttctattggagatagatatccaatctaatttgcctcatatggataaccacttgtcctattactgctgtaacaaatttctacaaactaagtggcctaaaataacacaaacttgtcatcttacactgtacacaagtcagaaatcaggcatganttttagtggactaaaatcaagtttgtcgncaggcatgtttctttatggcggctagggtagaanccatatcctgggc

SEQ ID NO: 548344 - DNA, 625 bp, Homo sapiens
acgcgctgcacgtctgggctcggtgctgatctcgtcccttcgttggctccctcagaaactgcgcttcttctctcgtcctgccatcagtgacgcagagtgacccttcgtggcaccctccagggtcgcgcctggctgggtaacccacatcgctactaccccgacagttcccggatcatgatccttctcctgcttctcgtagatacgaccgatctagtcatgttggatagagctgatccagggatgagatccaactatggaattccacagcgtgctctgcggagcgttcactcccactgtttgttacgtgatgtggttactctcctcatgtattggccagttttgcgcctcttctaggctccttgggtatggaatcctctgcgcctcgtgggatctcacagacgggcagccaccactgatggcgactttgtgtggccattaccaaggatgatgctgagtgtggccttctcctctgagcaaccggcagattgtctctggatctcgagataaaaccatcaagctatggaataccctgggtgtgtgcaaatacactgtccatggattgatgagccactcagagttgggtgtcttgtgtcctgcttctcgcccaacagcagcaaccctatca

SEQ ID NO: 548345 - DNA, 358 bp, Homo sapiens
ataagaaaagaggaaggtagtaaaaggaagaaataaagaaagttataaccatgaaagggggtgggtgatagagaacaaaagggaaagaggaaatcgagtaagaaaatagaatttattagtataaccgcaggacaaatatacatactaatttaatagaagacataccagtgtcacaaaagactgttcctctaagaactaacagataaatttacaaggggatttagaggtttcaataggcaaatttaaagttgaactaagattctatcttggacaaccagctatcagggggctgggtaggtttgtcgactctacctataaatcttcccactattttgctacatagaaaggtgaatctttt

SEQ ID NO: 548346 - DNA, 1009 bp, Homo sapiens
  misc_feature (18)..(18): n is a, c, g, or t
gggggggggggaaaaacnataggctaggtacaggctgggtggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgagacaggcttattagaagaatgaactaaggtgtctaccatgattatttttctaagctggttggttaataaacagtacctgctctcaaattgaaaaaaaaaaagaaaacacaacagagcaaaaaaaaaaaaaaccccgggggccttcttttggcggggggggcggcacaaaggcggggtcagagacaggggccccaggggccaaaggggtgttccgggcccccatttctttggtccacaagggggaaaatcgcggcgggccccccaaaagaggaggggaaaaaaatggaaaagaccgggtaaccgttaag

SEQ ID NO: 548347 - DNA, 996 bp, Homo sapiens
ggtggccattttcgttgcgtggtgttcaagttgtaggcgcgttgcatggctctagataacagccaagatgctgcggaatctgtctggctcttcgtcagcattgggcagaggacgataagcactgcttcccgcaggcattgtaaaaataaagttccggagaagcaaaaactgttccaggaggatgatgaactttgccactgtatctagaagggtggggtagtcgtgatgccctcctgtatagagtccaccatgatatcttacagataggtggaacaagatatgccatatatgaggctggctgtggcttcatttacccaagaagcaggagtgacttcagtcatcccagctaatcgcttggtatcagtttcattcagctctctatggaccagtaatctgatagataaccgagctcttcttaggggatcaatatttattgacttgtaggtaactgccgaccaagtaagacgcagttctcttgaccataaggaatagacaaaaggtatcagtatcaaaatgaaggctagtaatgagtgaaaatcgggccccggagaaaggaggccgagacaagcactgcagcttgggccagggagcccccggggaggacgccggtacgcaacgagtcccaacacaagcgtggccctgcagaggcaagcacacgcgcgcaggcacgggcggacggcacgacacgagcgacctcctcagcccatatggaaggaactcgccccgccgctaaaacacacgcgcagtaacagggaacccaacgcccgcggaggtgagggtccgtcgaaggcgaacaaacagcaggggacgactgattgcaaacagcagggatacccccgacgagccaaccaaagagacaaacagtgaagcccacggacgaccaggggaaaccaacgaccaaacgagcgacaacaaaaccattgcacgcacccgcacagcaaccaccacactggctgaagcgagaagacgcaaaaacggcgagagtgcgaaaagaca

SEQ ID NO: 548348 - DNA, 139 bp, Homo sapiens
gttcatcgagctcggtccatttcatatttagcagtagagaggtagttgatgtctgcatattcagaactactgcctgctgatgagaaccaataagctcgaaactgatgtccacataatatgttctatgttctgattttta

SEQ ID NO: 548349 - DNA, 826 bp, Homo sapiens
  misc_feature (25)..(25): n is a, c, g, or t
  misc_feature (105)..(105): n is a, c, g, or t
  misc_feature (112)..(112): n is a, c, g, or t
  misc_feature (117)..(117): n is a, c, g, or t
  misc_feature (138)..(138): n is a, c, g, or t
  misc_feature (182)..(182): n is a, c, g, or t
  misc_feature (206)..(206): n is a, c, g, or t
  misc_feature (230)..(230): n is a, c, g, or t
  misc_feature (258)..(258): n is a, c, g, or t
  misc_feature (264)..(264): n is a, c, g, or t
  misc_feature (324)..(324): n is a, c, g, or t
  misc_feature (448)..(448): n is a, c, g, or t
  misc_feature (453)..(453): n is a, c, g, or t
  misc_feature (460)..(460): n is a, c, g, or t
  misc_feature (530)..(530): n is a, c, g, or t
  misc_feature (569)..(569): n is a, c, g, or t
  misc_feature (575)..(575): n is a, c, g, or t
  misc_feature (599)..(599): n is a, c, g, or t
  misc_feature (601)..(601): n is a, c, g, or t
  misc_feature (608)..(608): n is a, c, g, or t
  misc_feature (621)..(621): n is a, c, g, or t
  misc_feature (822)..(822): n is a, c, g, or t
gtccccacctccccaagacgggganaaggaggtctcattccaacagcttcaactcctttcacctcccattcaaggctcaaggctcaaccagaggggaggggatangcaaacnggganggggaacctccttaggctcanacacttctttcttctcccttctccccattcccttcccttcccancagaaccttgctggcccttggcanaccttaggcccaggaccagcttanaggaggttgattgggacagagcaccaangggaangggccctcggcccaaggggggaggaacctaccccccacccccctacagctccccacttanttcacagcacagagaacacctctcccccaacaactccacatggaggtataccaattccaggggtcaaaggagcaggtgggttacaaattggcaggggcatttaagatgacagcaggctcacgangggantttgcanaaacttcctcctacccattggaggagacgattgggccacttttattcctttttgtggtcattgcattcanctcccacctgatatcattaggcaaacaggacttgtctantttatncttaatcacggccattttgcacanantcttcanactagggctaaantccaaaatgtgtaagtcagaatgatctataaggtcaaattcatctcccaggccttcctcaggagatggactggtaccccaaagaggacaatcttgtcaccaacaatacagcagcactggcgccggcggggacatggccccttccccttcggttcaatctttttccaggtaaaggacacaggattaaacttccaaaggtcangaaa

SEQ ID NO: 548350 - DNA, 667 bp, Homo sapiens
aagtctttaagtggacagtacgcatgcgccaacttcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagcagataacagctagaacgatgaatatgaatgtcgaatatcggtactccttcgcatacaggatatgatacatgatatcgacatactggataacgttcgcga

SEQ ID NO: 548351 - DNA, 1363 bp, Homo sapiens
cgctcggggaccctgtgagcctgctgttggcgcctggtgattgatgttgctgccaaggggctgggggagcgggtgcgtgcgtgtgttgtgcggatgtgcgaatgcgaggtgagtgccggccttgagtgaaacctggagctacaaagaaggggagagtccgggatgcgggatggggctgcgatggtgagtgatgcttgctgggctgcctgtgggcatgctcctgactgcacctccctgctgggggatgggagccccctgtgggtgcctgctgagtgcctcctgactgctgggggccctggccctcggctctgcctgtcccctgtgctcctgggctcggctggtgaattgatcgaatgaaggaaaccaaatttccctggccaatggctgggtggaccgtcagtgattgggaaaaccaaggcaagcccttggcaaccaggccctgaggaagtgggtcagtggataggtgatccccgggacagcatttcatggcgggggaaaacgcggggactttacgcgagcgtgggaggcatttcgggagagagggcctgcagtatgtcgagttgcatgcacacaggggggtggagcaccagggctccatagcaaagtcgtccttgaagggagaggggaggggttagacaaggcaactgcgggaagacaggagctacctctcaaacgaaggggctagttttggacccccttgacgattgcaacttattgcagaaaaggctgtagaacgagaaggctccgcgggcacgctcccgaagcaaggcgtgggtagggccaaaggaagacggagctccaattagccacgcaggctatcgcttcgatatggccccgaacgttccgagatagcaaggtccgccgggttaaggcagcggggcgcaccccaagaccctgaagtactatcgcgtggggcacgcgtgtgaggttcgaaagcaacggagggagcggtgaaagcaggtatgggagatccaaatgccaccattcagacctaattgacgctatcgaggcggggagggcgaaaggaaaagctcggttagttctcttgggcactggaacggatcgacccgtgttatgcatgggaagggcaaacggctagatcgcttgggcggatacccgcaggcttcggggagcaggggcacaaagaattccatgacagatcccgcggtgcggcacccccctaaccgaagggggggacgcccattactggtcgatggtggctgtcgcgggtattctaagcactccgcgactggtgcattgcctcagaccgcttcagccccattgcttccacgtggataggcgtagatcgcctttccgaccttggggtgacgctcgccgtggatatggagcatgaaagatagtg

SEQ ID NO: 548352 - DNA, 413 bp, Homo sapiens
cagctccacactttctgcggtctggctggaggctctactccagattctgtttgcctgcggtatcaccagtggagtgctgcagaagagcaaagattgctgcctgttcctttctctggaatcttcgtcccagaggggcacccaccagattccagccggtgctctccagtaagaggtgtctgtcgacccctcctgggtgaggaatgccccatcctgcttctggggtgtccctcggtgggctgtaccctctgtcttagcagcccctctgccatgagctgggtacctcagttagaaatgcagaagtcacccgccttctgcattggtttcactggttgctgcagactgtaactgttccttttcagccttcttgccccgaatccaggaagaggactttataagttagagtctcttatagg

SEQ ID NO: 548353 - DNA, 160 bp, Homo sapiens
accgacgttagggcgacccatttaggacacagaatatccagttgatcaatactaaaacaacatacaccaacattagaaggtatgtttgctgttgggcttaagggaagctttgttttacttttaaaacgatagtcctaaggaaaggttctaagtggccaga

SEQ ID NO: 548354 - DNA, 841 bp, Homo sapiens
ggtcggggggcaagatgggcaaatcacttgagtctaggagttcaagaccagcctggccaatatggcaaaaccctgtctctactaaaaatataaaatcagccaggcatggttggcgcacaccttataatctcagctactcaggaggctgaggcacgagaatcgttgagcctgggaggcagaggttgcagtgagcctgagatcttgccactgaacaccagcctgggcaacacagcaagactcttgtctcaaaaataagtgacctaaaaataaaaacctgccaccaaatatttctgggaattctcttcactaatctttttttccttttttggtccttttttccatttctagattccattttcaaagtcttggatatattcttgtgaaaaatgagtagtatggaatattaagattattgttcccttatactcagaatacttttaatgagctctctgtggtttattgttactattaattcccttgaaaaaaaagagaaaatatctacaaaaatgttcatcgtgtcatgtaattttttcttgcttggttaccaattgaacttttgccctgttgtggtttggggggatccagcaggattcctacagtgtccatccattattgtaggtcatgattgctgagcgtttcgctttggatttcaatacctataaagtccatcttgagttggtccgagaacggtgaattactcctaattaagcgactccgaaccgcgcgcttgctcattcggtaccacccttattcacaggacaactttttcttggcaacctacaccctttccggtttctttcaagaacagactgtgccacccgccaggtgggatttcggggaa

SEQ ID NO: 548355 - DNA, 1526 bp, Homo sapiens
  misc_feature (351)..(351): n is a, c, g, or t
aagtctttaagtggacagtacgcatgcgccaacttcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctattaacattgctatagtagccctcgcttagaaatcctcacatatttagtgnctggttctgctctatcctgacatcctacgaggtagtcgagactggatagtgacgccgcattacagtgttctgaaacggctgttgcacgtcgttcttctgccttctgtctcaaatcttcaatggaacctttgtgaagctcaacaaggcttcgattaacatgctgaggattgtagagccatatatgcatgggggtaccccaatctgatagtcagtcaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaaaaaaaaaagaaaaaaaaaaaactctccgagagggcattcttatattgccgggtgtgcgcgggaaaaagagggtgtcatagaaaatatggcgcaattatgggccataaaagagctgtgtacccatggaccccaggtattttttttgtgtcaccacagggggtgacaaatattgacgcaaggagttccccccatatatagggaggaggccgcgataattataaatcttcgcgagatattagagccccccaggtgtttatacccccggtcgcgtctttataaataggactcctctcgcgcgcgaaagaaaaatgaccacccaggcgagaaagatgtgataatatacgaacgcccccggcggaccggactctatcagatcagaagagcgcacgggggagagcgagtttcatacagttatagaggagatgtacagcacgaacgagaggagtagatactctctcagagcgcggagaacatacctacgccaatgatcgagatggctagtcgagggacgagacgatataacactcggtgggagagtgttgatatcgcacacaccaacaagcagaaaaaacaacacccacgcggcgatatacaccg

SEQ ID NO: 548356 - DNA, 634 bp, Homo sapiens
aagtctttaagtggacagtacgcatgcgccaacttcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaacctacaagcgtgcgtttggcctctcttgttatattcggctcacctgcacggtggcatcgccttaatggacctattctgtatctaaacccttcatgtggcattgattctcgtgggcctt

SEQ ID NO: 548357 - DNA, 839 bp, Homo sapiens
aagtctttaagtggacagtacgcatgcgccaacttcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatatgcatgggggtaccccaatctgaagtcagtaaatgaactaatctacaaggcgtgggttatggagaaaacaaaaaacgaaaaaaaaaaaaaaatgttgttgggccgcgcctggggcccggagaaaggttttctaaaaacccatgggttgggggccggggggggccgccgatagggttaaggtgaactggtgggcaacaagtgtgttctcaaagagagaactcgggccatgaacaggggcttgggatttcccgccaaataaagaaagccgcgggggaacccacagcgttttggaaaccaatccaagaggggagtccggagggcaagagggggctcatcccggggagtccaggcaagtcgtattcatc

SEQ ID NO: 548358 - DNA, 626 bp, Homo sapiens
  misc_feature (571)..(571): n is a, c, g, or t
  misc_feature (576)..(577): n is a, c, g, or t
  misc_feature (591)..(591): n is a, c, g, or t
  misc_feature (602)..(602): n is a, c, g, or t
aagtctttaagtggacagtacgcatgcgccaacttcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatatgcatgggggtaccccaatctgaagtcagtaaatgaactaatctacaagcgtggttatggcaaaatcaataagaagcgaattgctttgacagataangcttnnatgggtcgatctcntggtaaatacngcatgcttcttgagtaaagcgcag

SEQ ID NO: 548359 - DNA, 527 bp, Homo sapiens
aagtctttaagtggacagtacgcatgcgccaacttcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatatgcctgtggggtaccccgctctgtgtccgtggatggctgatcccgctacgtgt

SEQ ID NO: 548360 - DNA, 1119 bp, Homo sapiens
aaacaataggctaggtacgaggcctggtgttaatcggccgagggaaccatggagggtgtagaagagagtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcgaaacaaaaaaaaaaaaaacgaaaaaaaaaaaaaaaaaaaaaaaaaaaaaaaaaaaaaaaaaaaaaaaaaaaaaaaaaaaaaaaaaaaaaaaaaaaaaaggggggagagcgaataaaagacaaccccaggaggaggacacgaacacatgacggccgacccaacgacagttgtcgtgttaagcaaaaagaaggagtcagcgccacagaagagagataggaccgactgaatcaaataggaggaaggagggagagccaaagtaaaaacacaggagcaggggagagagaaacaaagaggcatcgagcggagccatctgtgggccgaagaagacaaacactcacattgcgaaggtagcacaaaacatgggcgaaacaacacaccgaagggaaaagtaccgagcacgcagggacgacaaataaaccaaacggcgcgagataagagggaaacaccaacgcgaacaagagcgaccagcaagacgactgcgatgaagagacat

SEQ ID NO: 548361 - DNA, 483 bp, Homo sapiens
aagtctttaagtggacagtacgcatgcgccaacttcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcattgagttagcccagagtcgaaggtttcagctctcgcctcgtcaatcttcatgaccttgtgagtcacagctcgtacatgctgaggtgtagggcatatattgcatggggtcactctagtcagtatactatctca

SEQ ID NO: 548362 - DNA, 299 bp, Homo sapiens
catcatgcccctgtgccaattttcttgcccatgcacccaggcagccagcaggtccatttacactcatcaattgcgtccagccccccagcagcatcagcaaccacttggcagtgccacagcacacactcaatcacatttcagatcaaccagtagcacagactcccagatgtgttgcatttcaccatccattgtgttgtcaacacatccagcagtgtttgcatccttgcattgtgtagcagccaacaaatggtgttgcctctcagcattgtgtcatcagcatgcagcagcagcagcacagc

SEQ ID NO: 548363 - DNA, 566 bp, Homo sapiens
  misc_feature (1)..(1): n is a, c, g, or t
  misc_feature (74)..(74): n is a, c, g, or t
  misc_feature (103)..(103): n is a, c, g, or t
  misc_feature (197)..(197): n is a, c, g, or t
  misc_feature (211)..(211): n is a, c, g, or t
  misc_feature (223)..(224): n is a, c, g, or t
  misc_feature (232)..(232): n is a, c, g, or t
  misc_feature (274)..(274): n is a, c, g, or t
  misc_feature (298)..(298): n is a, c, g, or t
  misc_feature (318)..(318): n is a, c, g, or t
  misc_feature (320)..(320): n is a, c, g, or t
  misc_feature (343)..(343): n is a, c, g, or t
  misc_feature (412)..(412): n is a, c, g, or t
  misc_feature (434)..(434): n is a, c, g, or t
  misc_feature (439)..(439): n is a, c, g, or t
  misc_feature (557)..(557): n is a, c, g, or t
naaggaacaaaaataagtacaaaaagtaggcttagtttagttcacaatataaatcccgtgaaaacacatttttnatctctgctgttttataatactctacgtntatgaatttaaagcagtgaaagcgagacatttgagaattaaattggtaaaaaaaaattgtaattgaattcagacttcagaaaattgtgaagtgnaaggccatgatggngagatattaagnntctgtagnattactaaactgtcacagtattattttcgctttacaaaagcntctcagtgaaacaaaaactacagngaacgcaaagtaaaatcagngnttttggtttagtactttccctgngtctcttgttttaaaaatcaaagtgaggccagttcaaaattgacccacaggtcttgcctcctccatgcngccatggggggtgcatttaagncaagnggctacgcatgtgggggtggtcccagggctttattcaaatgccaatttgcccgtgtcactgccacagggttatctgacccactgctgcgtgtgggcttgaagagctgtcaaaattctntcttggcct

SEQ ID NO: 548364 - DNA, 278 bp, Homo sapiens
ctcggcaatctagcaaccttagccaagaccatttactccaataaagtataggctatagaaattgaaacctggcgcaatagatatagtaccgcaatggcaaagatgaacaattataacccagcataactatagcatggactaacccctataccttctgcattatgaattaactaggaatcactttgccaggagagccaaagcttagatccccgaaagcagacgagctacctgagaacagctaatagagcacacccgtctatgtagcagaatagtgagaa

SEQ ID NO: 548365 - DNA, 798 bp, Homo sapiens
tggccgacgaagagttcctaatctgtgtacgacggacctctttgaggggggcccctcttggtggtggggggccgtgtttggagattacgtctttcttgtcctcgttcataattcttcttcttcttagcaactaagaggtagataaacaggctggagctatgatgtacgaggtgcagcaacatcccctcctgtggctgcagtatgcttgacctccaataatctcctcttgtgttctgtgtttttttttggctctcgctccttgtggttctgttctactctggctgcgcgttttggcgtcttcgcctttgggggcgtggttgttttgagcgctgcgtcgtggagccttgtgtgttggggatttctgtatgacacatcttgtgttgagaatatcttaaggagtctttggcggaaacttttacgctcattgtgtattaatctctctctgtgtctctactagaactatggttgaattatcttgatcacgtgtgtcatgtatctcatgtacttatttacgtatacatttcccagtagtgtaggggatgactagacacgtagatgggcggcttctggttaagagaaagaggggatcacaacaagagactggttagaagaggcccccctgggcatccaggcctgtccatcaggaagtaaattttagcagggcaccaagctttgcccccctataatccctcaggtgttctttgttcatgacaggcaggtgttcatgccgcatttgatgtggaggcagtgaagggcttgccctgctggcctctcatccccctaattcccacaccttgg

SEQ ID NO: 548366 - DNA, 993 bp, Homo sapiens
accaatggaccaatatggaaaaggctggaaagagacttatccaatccagtgctgctggtggaatagatgggaagggagaagagctgagatggagtttgaagaactggggtcgtaatccaggaaattgccaacatactcacagaatcctgctcggctgcaaagaggagacagagtaatggtgatactgcccaagatcccagagtgtgtggctttgcatagtgtggccgtgtctggcgaacagggaccgagttgttaaattccaggaaccactcagtctgacccgagatagagacatcctctatagacgtacaatctttcgaaaagctacgtgcattattaccgatgatactttggccccagcagtagatgccgtggcagttaaagtgtgaaaatctccactccaaattaatgtgtctcagcactccagagaaggctgggggaacctcgaggagatgatgaaatatgccagtgacgaagccacacttgtgtggacacaaaaacgagcgacgagatgatggtcagtctacttcaccagtgggacaagctgggcctcctaagatgatggacagacccagagcagcttggtaaggatggtctgtccatggaaggttctgggctggattggatagcctccgatgtgatgtgggaatacttcagataccaggctgggcaaagtctagcatggagtagtggtaatgtctcccatggacgcaaggagctggtgtgtggcacactaatgccccgattgaatcacttccatctggaacctgtccaagttcccatcaatgttgttggcttgaccagtgcttacggatgttgtccaaaaagactggcgtttacgtcacacggtgaagactggtgggctgagaaccattacccggggggggagcacggcaaaaagagaggcagaatataagttggcaagaacagggatggaaagaggaaacagcagcacagaatcgcggcggagaaaaaaagagtcgctgaggaaac

SEQ ID NO: 548367 - DNA, 260 bp, Homo sapiens
caagctcttctgaagtctcgtgagatgactgaatatgaaccaaagctgcactgcgctgtacttctcagcttcaacagggaatactcttccaaggataacagcagctccagtccctgaaggcgtgcgtgccaccagcacagcggtacactgccttctctaacccagttcgctcactagtactatagcatctgtggacacaatcttagaaaaaaagatctactcccccaccctcctctcttcctttgtaaagaccatcccaa

SEQ ID NO: 548368 - DNA, 102 bp, Homo sapiens
gtgatgtcggtctcataagggtcttcttatataggctcctctcatttcaccaccagctttggggcccaaggtcctaaggtagtgttctgaagccaaattccc

SEQ ID NO: 548369 - DNA, 325 bp, Homo sapiens
  misc_feature (51)..(51): n is a, c, g, or t
  misc_feature (74)..(74): n is a, c, g, or t
  misc_feature (251)..(251): n is a, c, g, or t
  misc_feature (307)..(307): n is a, c, g, or t
cagaggagcagtgtccggccagagcgcgcgcgcagcttgggagctaggcanggcctggcgctggggtcgggctngcgtcatgcgtgccacgtctcctctacgcgccggaccctgggatgctcttcggccgcatcccgctgcgctacgccatactgatgcagatgcgcttcgatggacgcctgggcttccccggcggattcgtggacacgcaggacagaagcctagaggacgggctgaaccgcgagctgcgnagggagctgggcaaagggcttgccgtttccgcgttgagccaacttgactaccgcancttcccacgttcgggttc

SEQ ID NO: 548370 - DNA, 844 bp, Homo sapiens
gtgtccacgaacctttctcagctccgagttggtgtgtgttcgcccggggtgggccagaccctgtgggcttgttgagggacccaccccgcctgtctcacctctggggcgcggtcgccacacaagggttgtttatttggcgcagaccccccgccttgctgttgtgtaacaaaaccagctgggggttggcccgaccgactcctaaaaaaaccgcgggccaaaacacaaaacggggggggtaacacgcacgttctgagaatattttctggaagggaggtatggcgcctctgtatttattaatgtcttttaggaggatgagacctccctcgtcctggttcacaactccaaggtgggctgcccagaagtcaagatatttcttggcttattccattatgcctcttgcaccatcccccctaggtctccacgacctaatttgttgttcgctcgttggtcccgcccccacaacgtgctgcgggtttatatacaagcccacacccccccacccagccccggggtcaagaagtcagtgttcttcaatttcccacggggtagtcatccccccccaatattggaacattgtctaacagtccttgttctccacagagggtggtattgtgaacggtgtggtatcatagggcggtctaccacgaaggagagaagtctgtatgcatatattctggtgcgaattcttgaaacggtaaagtttacgtcgccggtcgtgataccgcgtggagaacaactctttaatacgatacggtaccaaaactcatgcacccgaccccgcccgtcgtctgcccccccgcagtcttaaccgattaaaattaaaaagaaaatttcccaaaaaaca

SEQ ID NO: 548371 - DNA, 211 bp, Homo sapiens
gttgcacgttactctccaaccacgcccagattccagctggagatcaggtgcttgtgatgccgataatgaccgacgaaacgtcatcaattacactcgattactttcaagtctctctcaggtcttcaccggccatcagggactctgccgtctgtcccaggtactctccaaccacgcccacatttcagctggagtccgttcgaggcaccccgga

SEQ ID NO: 548372 - DNA, 226 bp, Homo sapiens
ccgagaggatcacggatatgggtgagccactgtgggcgaaaagaacacacaactctgtacaacaaaagaacggtagtacaaatctttccttcaattaaaaccaatcagacttggctgtgttttaaccccaaggtaaaccaaaaccgggaaaagacggaacccggggagcaatccgggtcccaaacccttccggccggtcctttacccgggaggctacccaccggaa

SEQ ID NO: 548373 - DNA, 466 bp, Homo sapiens
ggcgtcatgctgaggcgactctcagaggatccctcttcccgaaaggacattaatgaaaagtccccagatggcatacaaagtatccccggtacacatatattcattgggagtttggatatagaggcacattatctaaaacattttgtagttcccaaaaaccatcttaatttcttgagttcctgaattttgaacaggattacctggagcctggagccactttaagttgtacttctgactaaactggaattatgagtgaggaagagtgtttactaaataaatgactggggcaagcaaaatggaggaggaaattagaaactgtttgacaaactttaagagctacttgaaataacagaagtcttgattaatatgcaaataatggctagaaagtatggtttaactggaccctattatgccttttaaaaataatttcagtaacccataaatacatgttgcctttcggagaaga

SEQ ID NO: 548374 - DNA, 220 bp, Homo sapiens
gctgttaatcgcaagtactgtggagtcgaggtggcagaatcgcctgaacccaagaagcggatgtgtcagtgatgcagagatggtgccactgtagcccagtcctgggcgacaaagcaagactccatcccaataaataaaaaataaacacaacggggactggtgcagtgggtcatgcctgtaatctttttttttttttggagacggagtctcgctcttgtgg

SEQ ID NO: 548375 - DNA, 1116 bp, Homo sapiens
  misc_feature (477)..(477): n is a, c, g, or t
  misc_feature (511)..(511): n is a, c, g, or t
  misc_feature (562)..(562): n is a, c, g, or t
ctgttcttgaactcctgacctcaagtgatccgctgacctcggcctcccaaagtgctgggattgtaggtgtagaccattgcacctggccgtgataacttttaacaatttatctaaatatttttgcattgatcttcatattcaatctgcacagctcttcgaagttcattttacagctgagtgaactgagaaaagtcaagcaagcaatccatctgcttcagcctcccaaagtgctgggactacaggcgtgagccaccgcacctgtcctggaaaggaagcctttttatatgagttgttttctacacagtaagtacagaacaacgtctatgaccatgactgtataatatttctattaattcctgtaacttaaaacatgtagtttgtaacatgacgagaccaaggagtgccacaaaaacatgagatgcatgtggttaaatccatttcatggtgctagttcctagccattcacttacaggtggnggtgaccattctttggcatttgaatgactcattntctcttctttcagtgcacttaggtggacatcaagaacttctggacttatgnttcttagaacaacatgtcttttataattctttatagggcatgaagctctctgtacctatggtcttttttcatgattttcatcctttgccttggactatagatttttgcttgtaaaataaagggtaggtttgaagttgccagcttagcaagtgcctgatggaattgcattcggagcatgtttgacttgggcatttataatccatgccttgataccggccttaaaggggtggttaattcaaagggtaaggacactcatttaaagggaaattgttatgcccccaggctcttaaaataaaccccgaagaaaaaactgtgccccttgccaggacttaatcgcaacttttatcggccaatcgggctattggcattcccctaagggctcgtaaaattggcccgtttacacgggatcgggaacacgggtcaccattaacctttgccctttcgcacggcctatcaagccccccatgctttccaaatgtccctcctggcaagatatgggcctcatttttccgcaatttgttaaccctttttaacaccgcggtgcactcttttcc

SEQ ID NO: 548376 - DNA, 967 bp, Homo sapiens
  misc_feature (518)..(518): n is a, c, g, or t
aaacaataggctaggtacgaggcctggtgttaatcggccgagggaaccatggagggtgtagaagagaagaagaaggaggttcctgctgtgccagaaacccttaagaaaaagcgaaggaatttcgcagagctgtgaagatcgaatgcgcctagagaaagaaggtttgccctaagaagagtgcttcgcaaaggctaggagggaagcttcatgtatgtaaaaagcaatagctagctatcaacgaagggaagtcataggctaacgatgtgactagaagctgaggattcgatatggtcgaggattggccaagaaaagctggcagacttcatagtgttactcgtgcgatgaagaccctatatagttgtgcgctttggtccatcgacgtatagtctagcatgtgtatccaactaggaaggtgagacccaacatgcgttacgaaccaaggtgattgacagacgtgtcattcggcacttgcgatcaaagtcgttcacagtggaagccatattgatgaatgcatcaancataggccttcgaattaagcactgctgagggaatgggtagaagccagtatatgtgcatgaggggtaccccagatcgtgcaaggtcagtcacaatgagactcaatctcaccaaggcgtggattatgggcgaacacatccacaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgagaaagaccaccatgtggtagaaagtggagatgctggcaaaagggaggaccagatcaacaggcttattagaagaatgaactaaggtgtctaccatgattatttttctaagctggttggttaataaacagtacctgctctc

SEQ ID NO: 548377 - DNA, 615 bp, Homo sapiens
aaacaataggctaggtacgaggcctggtgttaatcggccgagggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctctaaaatggaaaaaaaaagtctggtatcttttatctaaagtaaaaaccttggggggg

SEQ ID NO: 548378 - DNA, 321 bp, Homo sapiens
aggccccccccttccgttccccggttccctttttaagggggaatgacccctttcaattttttttggggccggccaaaatttttgttttcttcaatttcccccttggtaccctgtttttggtgcttgggggtgttaccttagaaaaatttggtgtgttcccccccaaaaagggccccccgggttttttttcgggggttcccgtaaaaaatcccaagggcaacatttttccccctcgcttttccaccttttttttttttggcaggggccccaacccttgttttttttttccccaagaaaagggtttcccccccccccttttta

SEQ ID NO: 548379 - DNA, 365 bp, Homo sapiens
ccccgaattatgggccgtttactctatcctctgatcaggatgagcatcatactcaagactacgccctgatcggcgcactgcgagcagtgagcccagacaatctcatctgaagtcaccctatgccatcattctacgatcaacattacataattaagtggctccatttaaacatcatccacccattatcacaaacacaagaacacactcatgaatatacatccatgacaatcatgaaccctagagccaataatagtgaatatatcatcacacactaagacagagaccaaaccgagaccccccattcgaaccattgcagaaagggagagtccgaacctagatctcagagcttcaaacatcgaaatacg

SEQ ID NO: 548380 - DNA, 140 bp, Homo sapiens
tgttgttcatgcatagatcattcgtttgttacgaatcccagtgtggctgatttgttaccgttctagaggctgaactgtatgaagacctcaactaccattcacaaggtgcagttaagagacttttggacagttcacagtgt

SEQ ID NO: 548381 - DNA, 886 bp, Homo sapiens
  misc_feature (31)..(31): n is a, c, g, or t
  misc_feature (228)..(228): n is a, c, g, or t
  misc_feature (339)..(339): n is a, c, g, or t
  misc_feature (363)..(363): n is a, c, g, or t
  misc_feature (439)..(439): n is a, c, g, or t
  misc_feature (522)..(522): n is a, c, g, or t
  misc_feature (534)..(534): n is a, c, g, or t
  misc_feature (699)..(699): n is a, c, g, or t
  misc_feature (714)..(715): n is a, c, g, or t
  misc_feature (718)..(718): n is a, c, g, or t
  misc_feature (720)..(720): n is a, c, g, or t
  misc_feature (724)..(724): n is a, c, g, or t
  misc_feature (730)..(730): n is a, c, g, or t
  misc_feature (735)..(735): n is a, c, g, or t
  misc_feature (742)..(743): n is a, c, g, or t
  misc_feature (760)..(760): n is a, c, g, or t
  misc_feature (765)..(765): n is a, c, g, or t
  misc_feature (768)..(768): n is a, c, g, or t
  misc_feature (774)..(774): n is a, c, g, or t
  misc_feature (783)..(783): n is a, c, g, or t
  misc_feature (791)..(792): n is a, c, g, or t
  misc_feature (794)..(794): n is a, c, g, or t
  misc_feature (797)..(797): n is a, c, g, or t
  misc_feature (802)..(803): n is a, c, g, or t
  misc_feature (810)..(810): n is a, c, g, or t
  misc_feature (885)..(885): n is a, c, g, or t
ctcttttctcatagaaatagattattttttntaatacaaaaaaagaccaaaaaacaaaacaaaacaaaacatcaacagcaacaagcccgtaggaacatctttaagcgattactcagggcccggctgacagttacacgtgggttgcgtcagtcccgtgtacacacgcgttcagccatgtttaaaccgattgcatcaacttcgaaaccggcccgcccgccggcgcctggngaggggcagagggagaagcagagagtttatcattcatctgtacacatagacgtttcttctttaaataacaccacgggcgggagccccatctgcatgtgcggttggtttggncaaaaatatagatatatatatatnatagggtattaaaattaccgacgggctccccgcgctgccaagtgccccagtgccaaagttttgccggcgccgccgngggcgggggcgagggcgcgggcgcgggcgctccccggggtctcagccccggccggcagggggacgcgcgcgggggccgcgctngcagtggccggnggaggcgagcgggggctcgggcagctgcttgaacaagttccgcagggtgctgagctcgcgcgacacctgctccaccttcttctgcagccgctcgttctcggccgtgagctccaggaacttgtgctgcgtctccaggttgcgcatcttggccttgtcgcggctctngcgcacggcgatgtnntgncnctcnccccgnatctngtgctcnncgctgtgcttgtccacngtctnctnggcctngctctgganctgcgagnncnccngcgcnnccccgcntacaggcgggtcgggggcgcttggctgcacggggctccgcgtgccgggcggctggacgaggagactggagagctnc

SEQ ID NO: 548382 - DNA, 100 bp, Homo sapiens
ctcactgttatgatgaggttacggtgtatttgctatcatcatgtctgttactatgatcaaggctcttccctgagacttctatgccattaagcttctaaca

SEQ ID NO: 548383 - DNA, 2284 bp, Homo sapiens
gatgccaagtatcaaccagatgatccagaagccattgatccgatgacggacttcttgggcaccactgctttaatgagtgatttggatgactttgaagaaggcgacggcgcggtgacattgatgacgttacatgcagccaaaggcttggagttccctgttgtctttttggtgggcatggaagaaggcatcttccccttgtcacgcgcgttgatggctgaagatcagcttgaagaagaacgacgcttggcgtatgttgggattacccgcgccatgaaaaaactgttcttaaccaatgccttttcgcgtttgttgtatggtcgaacacaatctaatgaggcttctcgctttattaatgaaatttctccagccttacttgagaccgaatatggtcaaaatacacgggtaacaccacgtcgtgatttgccgtttgatcggaaaaaccagcgcgcgcaagcaacaacttatcgtgcgaccccagtgactaaaacaactagtggcacgactggtggggatcaaatcacgtgggcgccaggcgataaagtctctcacaaaaagtgggggattgggacagtggttgccgttagtggtgatcgttcggaccaagaacttaaagtggccttcccatcggaaggggtgaagcagttactggccgcctttgcaccgattacaaaggttaactaaccaagtaagtgcgactttaatatgagattaggaaaataggatgttaccagaatttacaccaattgaacaattgtctacgtcagcagcacaacaagaagttgcccagttgcaagctgatctcactgaatatggggtcgcctactatgaacaagatgccccgctggttgaagatcatgtctatgatgcgctttatgcgcgattagtggcgctagaatcagcttttccacagtttgtgacgcaagattccccaacccaaaatgttggtggtgccttgacaaaatctggcttagccaaagtggaacatccggcaccaatgttatctttgggggatgtttttagcttagaagagttagcagcttgggatgaacggacgaccaaaagtctcggttttcaatcgccttataaccttgaattaaaaattgatgggttagcggtggcgttgacttatgttgatggccggcttgtccaagcgtcaacccgtgggaatgggacaattggcgaggatgtcacgcgtaacgtcaaaacgattaaggctattccacaacaattaacggaacccttaaccattgaagtacgtggcgaaatttatatgcctaaaaagagttttgccgctttgaatgtacaacgtgaagccgatggcttggaaccgtttgctaatcctagaaatgcggcggctggctcattgcggcaacttgacgcacaggtgacgaaacaacgcgaattatcagcctttgtgtactatacggctgaaccagaggtacttggtgttactacccaaagtggcgcgttggcccgttttgccgagcttggtttgccgactgatacgcataatcaagtgattgaaaaaatggctgatattgctgattttatcgccacctatacagctaaacgtgacacgttggcctatggaattgacggggtggtggtgaaagtcaatgcgctggataatcaagtggagcttggtaatacggtgaaaattccgcgctgggcgattgcctataagttcccaccagaagaagccttaacggtggttcgcgatattgaatggaccgtgggtcggacaggtgccgtcacaccaacggctatcatggatcctgttcaactagctggaaccacagtgcaacgtgcgagtttgcacaatcctgattatttgcaacaaaaagatattcgcatcggggatacggtcacgttgcataaggctggggatattattccggaagttggccaagtgattttatctcagcgaccagccgatagtatcgcatatccgataccagttgcctgtccagcgtgtgggtcagaattagtccacatctcaggcgaagtggcgttacgttgtattaaccctttctgtgcggcacaaatccaagaagggttgacgcatttgcttcacgtaatgcgatgaatatcgccggtatggggccacgcgtgattgaccaattattaaaagccaactatatcaaggatgtggcgtcaatttatcgcttagatatgacgcaattattgtctctggataagtttcaagagaaatcagcggctaatttgttagccgctattacgcaatcaaaagaaaattcgttagaacggttattatttggtctag

SEQ ID NO: 548384 - DNA, 760 bp, Homo sapiens
  misc_feature (275)..(275): n is a, c, g, or t
  misc_feature (278)..(278): n is a, c, g, or t
  misc_feature (292)..(292): n is a, c, g, or t
  misc_feature (301)..(301): n is a, c, g, or t
tacggggtgtcgatccagccctcgctccatgcgaggggcccagcagtatctccagtcagcactagaggacattgggaaagctagaagaagaacacatggtgatatgtcatcgtcagagacactgcctagcccaagcctgtctttcccagcgtcatgtttgtgtcacaaaagcagttattttaaaatctgatcccctctctacccgtaccactttggctttgaattatctcctgggttattttggttcatttgggtggggatcaaagtcctgtccnccnccaaaactaagttnttagatttngggggatttttttttttaaacgatgagaagggaatccggttatgttgactattcatagcttgtacaacgactacatgtctgcatgatggcattcatgatactattatactctaacttatttttgacccacactgactatggacaagtctgctcagataaaaaccctttgacagaggatggaatttttcaaacctgttcagagtcctggtttaatcaatcaagctaagaagaagtcgaagacatccctagtgcatgtacacgaatgccctacgatcatccattccagcaccactgcatgcatgggtcacctctcggactctcaaattcttcaggctcagtctggactcatacttatttacactcatttacatcttggcatgacagcaggcaagcttcagatggggctgtggaacgtggcacacaacgcctgagtacgagacacatgcaaaggaagggatg

SEQ ID NO: 548385 - DNA, 455 bp, Homo sapiens
  misc_feature (275)..(275): n is a, c, g, or t
  misc_feature (278)..(278): n is a, c, g, or t
  misc_feature (292)..(292): n is a, c, g, or t
  misc_feature (301)..(301): n is a, c, g, or t
tacggggtgtcgatccagccctcgctccatgcgaggggcccagcagtatctccagtcagcactagaggacattgggaaagctagaagaagaacacatggtgatatgtcatcgtcagagacactgcctagcccaagcctgtctttcccagcgtcatgtttgtgtcacaaaagcagttattttaaaatctgatcccctctctacccgtaccactttggctttgaattatctcctgggttattttggttcatttgggtggggatcaaagtcctgtccnccnccaaaactaagttnttagatttngggggatttttttttttaaacgatgagaagggaatccggttatgttgatttttagtggacaaaaaactgtctgcgggggttctggatttttttattttttgcccacctgtatggaaagttgtcagtaaaacctttgccaaaggatggattttta

SEQ ID NO: 548386 - DNA, 169 bp, Homo sapiens
ttgaagggtagcaattcagtcagccactggagtagtatcacatgaagtgagaagaaaagctgagatggagtttgtagggcagctggagttcaagcatctctcctcacagtcctcttcttgttccagcatcatttttgtcacctttcacctgtcatttccaccagggtcc

SEQ ID NO: 548387 - DNA, 173 bp, Homo sapiens
tgaaatgggcctaattccctgaggtcatcatatctggcagaagcacaggactttgttcatgtcctctgacctaacagtaactaatgtgggttcgaggaagaaaggaaaagaaggaaccaggtaaagtctctacgtgactctgatggaaccctcttatgacaggcagagtatca

SEQ ID NO: 548388 - DNA, 361 bp, Homo sapiens
agggtgacagttagtacaatatttttaagacgcttcaaaatcttttaccactaatctagaagaatcatctcttcagtgtaagaaagaaagccctaacagaaagacgtttaaactaagctgatgttcaatcctcttagaacacacaaaatgaaaaataatggttgattagctaagctttgtgctataatcaatctaattaattacagtgattctaaatggcaacagcccatctgtctggacagcttgacagttcagaatgcttttgcaatgattttttagcgcaaagacgctaaaatgatccggtcacgcaatgttcctcatatgcactctgcatctctgtgccaatcttgtaggtaaggat

SEQ ID NO: 548389 - DNA, 194 bp, Homo sapiens
tcgatctcattgccactgcagcctccgcccgacatgtttacgtcggattctcctgcgttagcctccctagtaggtgggcttacatgcgcgtggtaccacgccctagctaattttttgtatttttagtagagacagtgggtatcaccatgttggccaggctggtgttgaactcctgacctcaggtgatccactca

SEQ ID NO: 548390 - DNA, 434 bp, Homo sapiens
cagattccccggccgtcacagcttgtcacgccacggaggatcacgatgcacgctgatcatccattgaaactgacactgacactgctgacaccacgttgttgccaacaacgtaacccccgctgacaccagcctcattgacctatggcctgtccacggggaacgggcctccacactccaggatgagcccagggtcgcccacgccaccctcgggtactgaggtcaccctggcagaggtgcccctgctggattaggtggctccggagccactgtctgccagcaggcgaaggctgtgccacccttctcaactttgatgagctgccttatgccgccagccaccttctgtgacccagaggaagtggaaggggagcccctggttgccccccagaccccaactctgccctcagccccttgaggagctggagcaagagctggag

SEQ ID NO: 548391 - DNA, 102 bp, Homo sapiens
gtagcgcttgagatggtgacaactgactgagagcagattgcagaatacaaagaagctttttcactcatttgacaaagatggtgatggaactataacaacaat

SEQ ID NO: 548392 - DNA, 162 bp, Homo sapiens
  misc_feature (50)..(50): n is a, c, g, or t
ccccccacacttcccgcagtccccacacttgtaacacttcatgtggaagnttttgtccagggcgaccactcgcacagtcgcatctcggccaggctcaggcatggggctcagagcagacggagcacctcggggcgtactgcttgtggtagtcggggacacagt

SEQ ID NO: 548393 - DNA, 350 bp, Homo sapiens
gcgtcgcctactactactaaattcgcggttgtgtcttttctgaaagggctttaaaagttaggatgtagactgggcatggtggctcatgcctgtaatccctgcattttgggatgctgaggcaggtgggttgtttgaactcaggagttcaagaccatcctgggcaacatggtaaaatcccatctttattaaaaatatagaaattagccaggtgtggtggcactcacctgtggttccaggtactcaggaggctgaggtgggagaatttcttgagcccaggaggcagaggctgcagtaagcagaaatcataccattgcactccagcctggatgacagaacaaggaccttgtctc

SEQ ID NO: 548394 - DNA, 183 bp, Homo sapiens
ttccagcagttggaggttgcagtgagctatggttacaccctggatagcccctgaactccagcctgggcagacagctgaccctgtctcaaaaaaaaacaaaacggaacaaaacaaaaacccaaaccaaaaacagtggaagagggaggcagaagtggagagccagagggaaggaaacccacagca

SEQ ID NO: 548395 - DNA, 878 bp, Homo sapiens
  misc_feature (1)..(1): n is a, c, g, or t
  misc_feature (121)..(121): n is a, c, g, or t
  misc_feature (878)..(878): n is a, c, g, or t
nctggccggcatcggtgtttattttttgttgatttttttcaatcaaatggaattgcttaattaaaaaaaacttatctcttttgtggggtagggtggtacagacaacctcattttatcgcancagacacctaggaacaaaacactggacccaccagagaaaactgggcaataaaagcatcagaagttcaagtcaactatggaagaattactgttagctggcagctttcaattctaaacagaaggggggggacctattgggcttgacaaaagtttcttagaactggggagctgggaatgttggactccttttaattctattccaatcatttcctgtatagggaaattaaagtcaatgcatcaaatgaagacccaaagaaacatttaaaaacttggttgactagtattcagtatgtgagattattaagtaataacttggccacctagttaaccttggtctggaatatatataggggatttggagccgccactggtataatattttcttgaaggatgccaagctgtatgcaggatctttttgctaaaggccagaactgggggcactgagtttgggttttcctccgtttgccccccaaacacactttttggggggttggaggataaccccggagcttggcgtttttcccttcgaagcctaaaggggaacataacccttgggggtttttgtgcgaacattcagagaaagtttgtgtgaggggcggtggaataatgaccctgtggggagcccttgcaccacgcctcgaattgtgtaaagatggggggttttcataagagggaaaacggttggtgcaggaggaacataaacctggggaaactgggggggggggtttcattattgaggagccagagttggacaaggn

SEQ ID NO: 548396 - DNA, 1478 bp, Homo sapiens
  misc_feature (44)..(45): n is a, c, g, or t
  misc_feature (51)..(51): n is a, c, g, or t
  misc_feature (65)..(65): n is a, c, g, or t
  misc_feature (71)..(71): n is a, c, g, or t
  misc_feature (84)..(84): n is a, c, g, or t
  misc_feature (87)..(87): n is a, c, g, or t
  misc_feature (94)..(94): n is a, c, g, or t
  misc_feature (98)..(98): n is a, c, g, or t
  misc_feature (120)..(120): n is a, c, g, or t
ccaccccatgcccaacaagccatattgtcaataaataaggaatnnctgaanccagaccctttagnaagagncagaaattccatnacncaggaanccantcagtgaagatgctgatagttntgatatgttcttatgccctgcccccttcccccaaaaaaccacctgcagaaccaaatgtttctcctcaaagcccatcagcacagattgataataatatcactatcaagccagggctagtgcttctctacatactgtactgtcacaggtacaaagcaagccctggacagatactgtctccctgcccccacaaatccagggagaaaaagaccaggaagcttgatttccttggatttaaacctcatgttcaaaaaggataataaaggtgctcgtacttgtatcttcttccctcccccaccatcaggaattctgacattttggaagtaccaatcagaataacactggaaaggaagagccttgttttcaaaacatagtgccagctcctctgcaactatttcttccaggaaaccaagcctccacctcctgagtttttcactggagccagggaagctgaaaatcccatcccccacccaatgggagctaaattcccagccagctccccactctatggatatgaaacactcgagaacactgactgggaagaacatccggctcttatcagaatccctagttaggactctaccaggattccttttagaaagttaggggcaggcccaaggaatctaggaaacacgctatggaaatgggattgccatcactcaaagaaaccagacaccctgcacacaacaccccacccccaggccaagtggaggagcctgatccaaggcctagctcctacccaggccctggcaggccagttggctcctctctccacctgcctctcatacagccaggcccctcaaattaccaacacgctaagcaagggccctggagacaagcaagcctgttttgccacttaggaagctggaaagaattttcgagtcaagttaacccaaccccctcttcttttcacatgtaagcacactggctcagccagaactcaggtctttcaacctcacagttggtgaagactcttacatgttggttccaagttgctcaactctcagggctcagcctacaaaagactcgcgcatttcgaccagctcagtccagaggactccagagaatgactgctgagaccaacccactttccaacccccactacagacacacaaaaagaacagaaaacacaaagtctatctcacataccccttgagtggggttgggtgtagggtcttctctgctcccctccaacccctgtgcttcatccctgacctctctcaatactgcatctatcctcaagcaaacaacgggcctttggccacaagtaaccacctttggatccagaactccccgggtctaaatccggctccaactcctcagtcccgagggctgggtacacaacatggggtgcacagggg

SEQ ID NO: 548397 - DNA, 488 bp, Homo sapiens
tgaatgtgtataaattaagatgcatatacccctaaacatataatatgaaactaaaatgaacacagtaagtatatatctaggtttgcagggatttttgtttttgatattgtgttttcttccttttatatggaagaaactcagtacctaacaagggtaaacaaaggatagtagtaactgaactaccatgtactcatgcaccttccttcaataattagccaatttatggccataccgttgttgtcatctatatccccacccactcccccactgcacatcattgttggatacaatccaatgtcgtgatctatttcattctgcactctgtaaattatttcagtctacatctctgagtaataaccacaatataattatcacagtctaacgattgaagcaattagatgacgcttaagtagctctatgatcgtccgatggtttagaagtacatatcaagtgacagctcatgaatttctactataagcaagtgcatc

SEQ ID NO: 548398 - DNA, 493 bp, Homo sapiens
gaagcagctgatgagcatatcacagagttatgatgataccaaggggaaagtaaagagcttagcttcgaagacacagaggattccttttgtagactggaaggaaaagaggaggagctaattggaacaatacaagagaaataaatgctagttgacagaaataagatgcacataaagtggatgacagcaactatttttaaaggcaggctgcctgcacagagggagttcagcaaggcaagactttatgaaagggttcgcagttcttgcattgattgcaagaagtccaagaagcgagggaaggaggaatagggaccatcacagggaacacatggatgtgagtgactctttctcacggtgagccgagtcttgaaaagcgattgccagatgatctccagaagtttcttatagaattgttattcaggattctatggcttctggatgagaacatctcattgacaataggatggatcctagctccacaacttctaaggttaag

SEQ ID NO: 548399 - DNA, 723 bp, Homo sapiens
  misc_feature (178)..(178): n is a, c, g, or t
  misc_feature (380)..(380): n is a, c, g, or t
  misc_feature (407)..(407): n is a, c, g, or t
  misc_feature (430)..(430): n is a, c, g, or t
  misc_feature (462)..(463): n is a, c, g, or t
  misc_feature (488)..(488): n is a, c, g, or t
  misc_feature (528)..(528): n is a, c, g, or t
  misc_feature (558)..(559): n is a, c, g, or t
  misc_feature (593)..(593): n is a, c, g, or t
agttcagaagaatcaaccctagagagccttaaataacaataccgaaatgggacatatgccattaaatctgtccctaacttaaaaatgtttaactagatgctacaaaaaaaaaaagtaatacttggctaatactttccagaaagaaggatggaggggagaaaataaatacacgtaaaanaggactccttggatcttttccagtaatggtgggaatggctcactttaatgggaactatgattcaaacggcacctataagaaccaggatcaagatctacatgttcaaatggttgggaaattttctgaaaacatctaattaggtctggaaaattttcaaacatatgattagctctggttcccaattcttataggtggcagtttngttatagtaccgttaagtcagaatatntgaaacttcagttagaagggaantaaggttcaagagatctatgggaaaacagggnngactatagttaataacaggtatggngttcttgaaagtggttaagagagtagattttaaatattcnggcaacaaagaataagttatatttcatatnnataaaatatatattcataataatacatatgttanttaccccaattgaaccattccataaggtatacatggtttcacaaatatgtggtatgcaatacaaaacaagttatatcaggtggtgcaaaagcaacggtggtcttcgcattaacagttacgggtaactata

SEQ ID NO: 548400 - DNA, 129 bp, Homo sapiens
taaagagagagacagacagacagaaaaagacagagacggacagagagagacagagaaacagagagaaagagagaaagacagagagagcgagagagggagagagagagaaacagaaaaaagtcgtatcga

SEQ ID NO: 548401 - DNA, 428 bp, Homo sapiens
  misc_feature (201)..(201): n is a, c, g, or t
  misc_feature (204)..(204): n is a, c, g, or t
  misc_feature (420)..(420): n is a, c, g, or t
  misc_feature (426)..(426): n is a, c, g, or t
gcaaatcagcacacacagtgctttgcgagcccatacgccccctgggtctatgtccgattgtgttgtcatgtgttgctttatggttctctgaaggcttcttgcttcagcttcaatacaggttttaacaaataataaataaagggttgcgaacccacgttaatgtcaacttcagcggtcatgcccggtgaaatgcgcagggcnatncagaggcatgccaaaaaatgccttgtctgtgctcacaatcaagcggtaataggggccggtttcttccgtaccagggtcagtgtcagctgcaatttgggtcaccttgccgggcaaagtgccatagcgcaaaaagtcataggcagacaccttcacttccgaagtttgatccatgcttacataaccgcggtctgcgggtgaaagtcgggtttcaaccancaacanct

SEQ ID NO: 548402 - DNA, 257 bp, Homo sapiens
ctggcacttctggagcatctagaacgagctgcgcggtactcctcggcggcgcccgctcttccggcaaaggtatgatttaagcttggatgaaatgagagctttgacagttcagagagtgaagtttgccatggacctgcctctgttaaaacgtgcaggtcaggatctggcagagaaaacaaagaattttgtcagccgaagccttgtcataggagaagtcctctccatggcggacattgccacagaagtgcgcctgggtg

SEQ ID NO: 548403 - DNA, 115 bp, Homo sapiens
ctcccacatcacgtctagcatacagggccttgccaccattcacgcctacaataaagggcaggagtttctgcacagataccaggagctgctggatgacaaccaagctcgtcatacg

SEQ ID NO: 548404 - DNA, 235 bp, Homo sapiens
aaagttacccttagcggatgacagcgcaatcctgatttctagagtccatatcaactcatagggtttactacctcatatgttgcgatcaggacatcccgatgcgtgcagccgctattaaaggttcgtttgttcaccgattaaagtcctacgagatctgagttcagaccggagttaatccaggtcgttttctatctacttcatattcctccctttttgaaatgactctactcgtaca

SEQ ID NO: 548405 - DNA, 87 bp, Homo sapiens
aaaagcccaaaattaaggaatgttaaattgcaactaagagcaaaatttggcattgtaccagcctggcaacagagcgagactctgtct

SEQ ID NO: 548406 - DNA, 370 bp, Homo sapiens
  misc_feature (21)..(21): n is a, c, g, or t
  misc_feature (26)..(27): n is a, c, g, or t
  misc_feature (29)..(29): n is a, c, g, or t
  misc_feature (33)..(33): n is a, c, g, or t
  misc_feature (46)..(46): n is a, c, g, or t
  misc_feature (55)..(55): n is a, c, g, or t
  misc_feature (66)..(66): n is a, c, g, or t
  misc_feature (71)..(72): n is a, c, g, or t
atggtctgacactatgtggantccanntngggnttagtgtggcccnggcgtccgnttcctcagcgnatgtnngcagccccgagccatggctctcgccgtccgagtcgtttattgtggcgcttgaggctacaagtccaagtatcttcagctcaagaagaagttagaagatgagttccccgccgcctggacatctgcggcgagggaactcccaggccaccggttctttgagtcatggtagccggagttgattcactctaagaagaaggcgatgctacgtgacacagaaagcaagtatctgaagttggtggccccataaagccccttggtcagggtattgccctaaggagagtcaggactttaccacctttta

SEQ ID NO: 548407 - DNA, 103 bp, Homo sapiens
acgaagttagtggccataccatacccatagtaggtggtgttatcctggacatagccttagccagtagtcatagcccctggtagcctcgtatttgctcccagag

SEQ ID NO: 548408 - DNA, 301 bp, Homo sapiens
aggcgaagactgtggaatatcagtattgtaacatgctgtacaggtttgaatgccgtaggagcagataggctataccatatagcctagaggtgtaggagcctataccatctaggtacaagtatgccattttggtgtaagcatgctgtatgatgttcacacaatgatgaaatggcctaatgatgcagtttctcagaacatattcctgtcatgaggcaacatatgactgtaatccagtggtttcgaggtcgggagattgtgcaatcatcaccacaggtcttcgcctgatgggtaccgaggctcg

SEQ ID NO: 548409 - DNA, 587 bp, Homo sapiens
  misc_feature (292)..(292): n is a, c, g, or t
cagcgcgaggtgcgtggaaggcgcacctgtggtgtgcatgtcgtgcgtgcggggacatgtcggacggcgtgctcaaggagggcttgctgttcaagaggggccacattgtgcacaactggaaggcgcgatggttcattcttcggcagaacacagctgtggtactacaagcttgaggggggtctggagagttagcccctctcaagggccggatcctcctggatggctgcaccatgatctgccactgactggaatatgctggaggaccgtgctctgagaggagcgggatgactgngcctttgagataacacgggctattcatgcacggcaaccggggaaagttcaggagctgcacaggctgagaaactcctttaaggtgtcccgcacataagactggtcgcattgtggacaagatggaccgtggaacaccgggattccttaaagtccaacattgagcatggtagcacctatatgagctttcttggctactacctgtgggactggctcatattcaacagatttacgggcaggcgtctggaagggagacactggactccatgctcatggaggagcttctcggcctgtggggg

SEQ ID NO: 548410 - DNA, 343 bp, Homo sapiens
aggctctggtgtgctctcgtgtataagcgtatcatgcgcctaaacccagtgccctgtaaaccttctttgcggagcatctgtggacaggggttctggaacatgctctgggagacatgtgactttgcagtttgtggcagaccccaagcctgtgtgcttagatctggcaagggaaaggcaagtctttggtggagatgtatatgcttgaaaggggcccctcttctaggaaaagacacagttccttaggcattcttagcagggagaagacacatggcagagtggagatagctggtcaagttgcttagcagatcatttgcagttgctttcctagtgctctgtgctgttg

SEQ ID NO: 548411 - DNA, 198 bp, Homo sapiens
gaccatatgcaatgatcttgctgcagtgctctgaagccctaggattcatctttactatatacaccgtaggtagcctggactggcttcggactaatcacccatatatgtaagctaactactccggaaaaaaagaaccatttgggtacatatgtatgtgtctgagctcatatatatccattgggttccctaagggtttat

SEQ ID NO: 548412 - DNA, 122 bp, Homo sapiens
  misc_feature (45)..(45): n is a, c, g, or t
  misc_feature (48)..(48): n is a, c, g, or t
tagtcagcagtgataggtgcacaacatggatggtacatatctcanaanaaattctactgagtgaggccaggcaaggtggatcttatctgtaatcctagcactttgggattaccggcatgagc

SEQ ID NO: 548413 - DNA, 509 bp, Homo sapiens
agcggtcctttcttactaacggtgttctgggtatagcttggcatgccaaagcgtagtacccaatagtaattcaggagcaggttgttcagtttccatgtagttgagtggttttgagtgagattcttaatcctgagttctagtttgattgtactgtggtctgagagatagtttgttataatttctgttcttttacatttgctgaggagagctttacttccaagtatgtggtcaattttggaataggtgtggtgtggtgctgaaaagaatgtatattctgttgatttggggtggagagttctgtagatgtctattaggtctgcttggtgcagagctgagttcaattcctgggtatccttgttgactttctgtctcactgatctgtcaaatgttgacagtggggtgttaaagtctcccattattattgtgtaggagtctaagtctctttgtaggtctctaaggacttgctttatgaatctgggtgctcctgtattgggtactacgctttggca

SEQ ID NO: 548414 - DNA, 279 bp, Homo sapiens
ctattctgctaaaaaaaaaaatacaaaaattagctgggcatggtggcgggcgcctgtaatctcagctactcaggaggctgaggcaggagaatcactcactgtagcgttgacctcctgggctgaagtgattctcccatctcagcctcatgagtagctaggactacagaagtacatcaacacacccaggtaattaaaaatttggttggtttgtctgtctgttggttattgagacggagtcttgctctgtctcccaggctggagtgcagtggccgattttgg

SEQ ID NO: 548415 - DNA, 122 bp, Homo sapiens
gacatcgatacgacttttttttttccccttcatcttcctcctctccatcctcggcagtttcttcttcttcctcctcagccccgttctcctcctcctccaccacttccttctgtcgtcttctc

SEQ ID NO: 548416 - DNA, 147 bp, Homo sapiens
taaaggttctgacaagtatttattaagtgccacatggtcgttataagctgatggacagttttcttcaaaatggtgtgatttttcattatatattttggcaacacaagtaaaacgttggtcctgtaaaaaaatgagaatattcacatt

SEQ ID NO: 548417 - DNA, 447 bp, Homo sapiens
tccttaagaagtcatgaagatattaactatgtctttgaataatgatttactgattaagaattattaaccggctgggcatggtgtctgttcttaatcactgttagttttgctcaaaaaattttttattttacatgaaggagagggaaagtgtgctgaattctccaaaatattgggaaattttcaagtatgaatgcgacttaataataacaatgaggctgggtgcagtggctcatgcctgtaatcccagaactttgggaggcccaggcaggcagatcacgtgaggtcaggagttcgagaccagcctggccaacatggtgaaatcccatctctactaaaaatacaaaaattagcggggcatggtgaagcacgcctgcagtcccaggttgcagcgagctgaaatcacgcaactgcgctccagcctgggcaacagagtgagactctgtctca

SEQ ID NO: 548418 - DNA, 647 bp, Homo sapiens
  misc_feature (123)..(123): n is a, c, g, or t
  misc_feature (246)..(246): n is a, c, g, or t
  misc_feature (273)..(273): n is a, c, g, or t
  misc_feature (384)..(385): n is a, c, g, or t
  misc_feature (485)..(485): n is a, c, g, or t
ctacttctttctttacttggcgtagagcgagagcaataccagtcaacctatgttacacggtgagtttaaaaccaagttcttcccgcattttttgtccttatttttcttgcgtgcccacattgngccttcattttatgagccccaggtttctggccttagatgaaaaaaaaatttaagtcgggggggggcatttagaaagctcctgttcttgatataaaaagccatacactttaaaaaaatgaaagnctttttccaggaaaatatattgtaatnatgctgctgagcctctattatctttctttgaatggtcgattcaggatccctacatcataaatgtttagtattaaacacgcccctgacgcactctaagcccctaaactgctnnaaagcgtatcacactctctcgttcgcccctattataagtgcatccccaaacgttcaactcggcgcttctctactctcgcaatttggttcgccaccccganaggtatgcattttcatttaatgttttcaccactacccatcccccccatctttgtttatattcaaaacacctgtttacatacacccccactcccctctttccttctccctccctttcccttccccccttcctctcacccccctttcatccacttgtgagttat

SEQ ID NO: 548419 - DNA, 754 bp, Homo sapiens
ggttcatcaacgaacactttgctgaggtgatctaccggacctttcttacgccccaaactccaacatcagaagcttcaacctcaaccacaaattgacgggccggatccggatggataaggatgggggctgtggtgaaccaatgtttcagttccacaaaggctctgtcgaccgctggagaccatgtgaacggtaccttgggagagatgagtgcagagaggagggccgccagggtgatgtaaccccaaatgaaaggcggtagaagttagcaaaacccaggaaacgtttcaactggacgtaggttgaggccaatccaccgctgctttcaccaggatccatctggacatttccctcagcgatgatatatcccagaaaggagattgtagagcggtggaacttacacttctcggctttcacgaaagttggttctcgaggaggtgctgaaggacctgtctgacatgaagaacgtgttcttgggcagaccgggaaaaaaatcaggatgtcgtcaaggtagatgaacacaaaacggttgagcatgtcccggagcacatcgtttacctggaagacggtatccgaaccaggtggtaggtctagcttggaaaaaatggtgaccctctggagaggttcaaaagctgaggagagagtgttatggggtaacgattcttaaccataatgtaatttagaccccggtaggcatgcatggattgagttggggcgtaagaaggtacgagcgcgacctcagcatcacctagctttc

SEQ ID NO: 548420 - DNA, 167 bp, Homo sapiens
  misc_feature (62)..(62): n is a, c, g, or t
cgcccgcaggctggggcttggacgccggacagttgatgatgcggttctgcgatcaatgttgngtgatgcgcgcttccagctcgtcacccacattgagcacctgggaggcatcggcaacgcgatcgcggctgatctcgctggcgcgcagggtaccttccacattttcc

SEQ ID NO: 548421 - DNA, 947 bp, Homo sapiens
aagattggaaatttctattgtacgaggtacccaaaagggatgcaaagctgaatgggtgatcttctgaaatacatacctgtgtttgaagattgcttgagccaaacctttaaccattggaaatgtgacaacaatgatttccaggtgaaataattccagtttgtgatataaataccacaaatgaatctgtttagcaacagggtacaaatagtctgttttttccttgtagtgcatgtggcaagtaggtgtgttctggtaataagaaagcatagatctgcgatattgaatgaaacagtagctctgcatattgtgtctggggaaaattagcattctgtgaacaaagtcaacaatgtatctggcgctcgcgattagtgttttcctatgataattaaaacttagtttggccaggcgtggttggtcatgactgtgaaatcgcccgcaatttgggaggccgaagcaggcggatcacggggccaggaggtcgagaccatccctggctagcatggtgaaaccgccgtctgctactaaaaatactaaagaaaaaaaagaattagtaggtgtggtggtgggcagccggtgtagtcccaggtactcaggaggcgtgaggcaggagaatgggtgaacctgggaggcggagtttgcagggagctgagatcaaaccaatggattcctagcctggatgacagaagtgaaatctgtctaaaaagtacacatgcatgagtatctgcaatagactttagtctgacaagtttctggtgtcagtttcaacgtttaatatacagttaaaacgtgcttatgagagagaaatagcgaaaggaaaaagaccaaagctctaatcgtgaataggggaagagggggggagaaggtgatcctgcataaggaaaagtgtggaagaacttaatatattcaagtgagaacatagacaggggtaagcagaattggaaacaaaa

SEQ ID NO: 548422 - DNA, 569 bp, Homo sapiens
aaacttcaggcgactaggctaacactgctgacgagcaggctcccaggctctatcatcatggaccttacaggagacctcgatgcactgaacaaccaggtgtttgcctgacaggagggcatcgaatacacggtgaagatcacctccaaggtcaacaaggagatcgtcagtggcctcaaatgtctgcatcacacctatcgtcggggactgcgtgtggacaaggccatcttcatggtgggaagctacggccccagagcccaggagtatgaatttgtgacttcagtggaggaagcaccaagaggagcattggcacgtggcctctacgtggtcaggtccctcttcactgatgacgacaggctgaaccacctgtcctgggagtggcacctccatgtctgccaggactggaaggactgaaccccacttggggtctgtattcccaatttcttgtcagttgcagagacctgcaagcattccctagacctcccagttggtgaccagatgtcccccactctctgctgtgtcccccctgcctggtgcctattaaatgttaccttgtcttgcaaaaaaaaaaa

SEQ ID NO: 548423 - DNA, 466 bp, Homo sapiens
ggaaactggccaagaagcggaaagagaccatgagcagcacccgacaggagatgactgtgatggtgaactcaatggacaagagctatgctgagcagggcacaaactgcgacgaggctttctcattcatggacacgcacaatctgaatgggagatctgtgtcttcaccatcgtccttcacaatgaaaacaaatacactgagcacatcggtgcctaattcctattacccagacccatttgtgccaactgcaattttagccacgttgtagtgatccaggtgccatttcagcaacagcaacatagctacacacttgtgtaccacctttcataccatgcatccccaggtgctttgcgatgcagatagaagtgaggttcccaaaccaggccctgctcatcaagcacccttggactaaattttcttcagagctgaacttctccgtaaaaaataaataacatatgaataactaaa

SEQ ID NO: 548424 - DNA, 330 bp, Homo sapiens
gggtgaattcggccgaggaggcggaggagcaagccaacaccaacctgtccaagttccgcaaggtgcagcacgagctggatgaggagtagctttgccacattttgatctgctcatccagctcgtgctgcaccttgcggatgaggcagaggagcgggcggacatcgccgagtcccaggtcaacaagctgcgggccaagagccgtgacattggcacgggtggcttgaatgaggagtagctttgccacatcttgatctgctcagccctggaggtgccagcaaagccccatgctggagcctgtgtaacagctccttgggaggaagcagaataaag

SEQ ID NO: 548425 - DNA, 292 bp, Homo sapiens
ggcaaacggattcatcgatgacaggaacgagcatccggcagtcgccaataacaggctggccgacagtacttttaatgcgattcgatacttctgcatttcttttcctttgagcttttaggctgcttttttggccggtgcaccaccgatggcatccagtttgatctggatcagctggcgcgcaggattctttgcatcggttttttcgagcgcaagctggtaggccgcacgtgcttcatccagcttgttttgcgccaccaggatgtcgcctttacgatcactgactacattagcg

SEQ ID NO: 548426 - DNA, 347 bp, Homo sapiens
cagcgccaccttgccagctaattttaaaatttcttgtagaggtggggtcttgcttatgttgctcagactggtctcgaactcataggcccaaagtgatcctcccacctcagcctcccaaagcactaggattacaagtgtgagctaccatgcccagcaggattttgttttaaaatgattgaataaaaattgaaagcagaataacatttgtgaccctggaaaatgatatggaattccagtttcagtgtccacaaatagagttttgtttgtttgttttgtgagatagggtcttgctctgttgcccaggctggaatgcagtggtgctatctcagctcactgcagcctccacc

SEQ ID NO: 548427 - DNA, 246 bp, Homo sapiens
  misc_feature (17)..(17): n is a, c, g, or t
  misc_feature (34)..(34): n is a, c, g, or t
  misc_feature (77)..(77): n is a, c, g, or t
  misc_feature (155)..(155): n is a, c, g, or t
  misc_feature (159)..(159): n is a, c, g, or t
aggatctctctcaacanactgaccccagccgggntgccgcccgcttcccggaagctccagcctgaaccatgtttttnacttgtggcccaaatgaggccatggtggtctccgggttctgccgaagccccccagtcatggtggctggagggcgtgtntttntcctgccctgcatccaacagatcgagatggccaaggcacagagagattacggactgaagaaggccgcctatgacatcgaggtcaaca

SEQ ID NO: 548428 - DNA, 196 bp, Homo sapiens
  misc_feature (120)..(120): n is a, c, g, or t
gtgttacctttctggttcatgttgctgagagtgaaactaaccattccctcctgcctacctttttggccactgggcggcagagaatggcgctatgtgcagttgggcccccggaccatgggnctttgctgcctgctgcagagtagcctgcctgggagtctccaggactagcagggcatctgtggcaggctgagagaat

SEQ ID NO: 548429 - DNA, 292 bp, Homo sapiens
ccctctcctcttccaccctcagtggatgatagtctcaagactcctcccttagctactcaggaggccgagtcgtaaaacccatcctatccacagaggtgtagggtgtattcggtggcccaatctccaaaagccaataggcgtagggcgcatatggtggacccatcggcctacccctagaggcacaggtaggcggaggctcttcggtttcccaaacccgataggcggaggttgagttatttgaccccccgccctttctttcaagcctgggcagttgcaatcaatccgtgggtcg

SEQ ID NO: 548430 - DNA, 580 bp, Homo sapiens
actgagcgtgcctaccagtagagcatgtcgaccatcttttgcaaaacaagaagagggtcctgctgggagaaactggcgaggagaagctcccggcggtacctacaagaagatcggtctgggcttcaagacacccaggggaggctatggagggctaacctacatcgacaagaaatgcgcccttcacctggtagatgtgtccactctcgagggtcggactccatctctggacgtggtgaccaagatgaagatgcagaggagcatgtcatccgctcgagactatctgcatctacatccggaagttacaaccgcgcttggagagagcgccacaagaagcatgtctgtacaggctgtccacccatgtctgtcagggaccgctcgcagatcggatgacaatcgctcacagtgggccgacggggccggccctcatgagcaagacagtgcgcattcaacgtgcttcaaggtccaccgaaggcgtgccggcaccaagaagcagtaccagaaggtactgaggcgtggagcatcggaccgctccccacaatgagagacagcttataggcgtcatgtaccccagaaaaacaca

SEQ ID NO: 548431 - DNA, 391 bp, Homo sapiens
cggctttatttcattagtaggctatagtaacaagcaagttcggggctgcattttgtccctcgaaagatcttataaggcatgggatccttgctgcagattagctagcagaaagattatttctcaggtgatgagaggctggataactgtagtaatgctcttgactgtctcctacaggctcctacccagagattctacccagtgaaactcccacagcaacgcaggtagatggggctgacctggcctctccaatgtctcctcgaactagcaatagccgcatgtccatgaagctgcgtcgttcctctggctcagccaataaatcctaaggagacaagcagcccagcagtgatcagcagtagccaccttagcacgaacatagggttaaccctttcag

SEQ ID NO: 548432 - DNA, 194 bp, Homo sapiens
tgagatgccacagctaagctatcatgctgacttatttagctacccgagtccagtctcctctaccagatttcatcccagtgaaactcgagtacttgttgacctaaagaggagaaatggcaaggacttaagagaatacatggttgcaacacatttacccaacaaatacctggatccacctgacaagaacccattct

SEQ ID NO: 548433 - DNA, 1193 bp, Homo sapiens
gcgccatggcgccctccaggaagttcttcgttgggggaaactggaagatgaactgggcggaatgcagacgtctggtggtgagctcatctggcactctgaactgcggccaacggtgcctggccgacaccgacggtggtttgtgctccccctactgcctatatcgacttcgcccgtgcagaagctagatcccaagattgctgtgtgctgcgcagaactgctacaaagtgactaatggggcttttactggaggagatcagccctgtgcatgatcaaagactgcggagccacgtgggtggtcctggggcactcagcagagcaaggccatgtcttctggggcagtccagatgcagctgattgggcagcaaagtggcccatgctctggcagagggactcggagtaatcgcctgcatttgggtgcgaagctagatgaaagggacggctggcatacactgcgaaggttgtattcgagcagacaaaggtcatcgcagataacgtgaaggactggagcacggctcgtcctggcctatgagcctcgcgtgggccatagggtactggcacgactgcacacagcccaaaagggcccaggacagtacaccgaagaagcacacgaggcatggctcgcagtcccaacacgtctctgatgccggtgcctcagagcacccccggaatccaatttattgcgcgcgctctgttgacctggggtcgcacaacttggcaggtgagatgaactgcacaggcatgatagatggattgggataccctatggtggacatggtagctacacttacagccaccgaataacgtcgaatacaatcacggcaaaacaaagagccacaatcaacgatcccgtacactatagtggtgacgagcaacggcagaacgcaagaccagagaacccggacattagccaacacacgacaatatgctacacgaagggagacgcacggcaacgccccagggagcgcaacacacaaactgcgaacacaaaaacggcaagacgcaacccctgaacgtcggtcagcacaccggcagccgaccacacagtcaaatagggggacagacagcacacggggcccacctcagcaacgagaaagcagtgacgagtacacctgacacaccccgagacacgacacagcccacgcaacgccgacccacacgagacgagagcgacgaaatagagcagcaggagccag

SEQ ID NO: 548434 - DNA, 169 bp, Homo sapiens
tgaccacgcttactaggacagtctggggacatgacagcagagaggagtgctttggaaattgtcggttaataaaaaatgaaagggggtaaatatgtttactttttcaaatatgtagtatttttagagaaacattccctgagctatttatccaaagtgcctcgttaagctt

SEQ ID NO: 548435 - DNA, 488 bp, Homo sapiens
atagctaacccttgcctagcattttctatgtgccaggcactgttctaagcacctcgattctatgatgtcggtagcatttattccattttacagatgaggagactgaggcccagggcagtttggtaactggccacaggtctcaaagtaaaaggatggcttatgtgagactagtaggagtctggggtcagaagtggggtgatggacccagtcagaggaaatggctcttttattattactgttgttattgtttgagacggggtctcattcagtcacccaagctgtagtgcagtgagccatgactgcaccactgtactccagcctgggcaacagagagagaccctgtctcaaaaaacaaaaacaggccaggcgtggtggatcatgcctgtaatcccagcactttgggaggctgaggcgggcggatcacttgagcccaggagttcgattcctccctgggcaacatggggagacctcatctctacaaaaaaaaa

SEQ ID NO: 548436 - DNA, 1294 bp, Homo sapiens
ggtggcaagaagaagccacgtgaaacagcccaaggaagcaggccaagggagatggacgaggaagatacggctttcattgccagtaacacaacaatagaggagcagaagacaactcgaggcagcgtaacaagcgagatggccgcggggaagtgggcccattggctacaggtggacttatgaaatctgggcaaggaagtagagctgtctccttgtgcctgaggcagcatggtgaccctttatttcatctgtattgaaacctctctattccctggcgtacacatcttttgccaggtatagctaggaaattaacgtgtcagtacttggaagctgttggtacagttgaaatgaattagaacgtggtgtaagaagaagatgaaaaagatctctgacgttggactctatcgatgcgtcttgtagatgtgtggcccatcgtaaggtcgtgaccatactcagtaactcgtgaattgtacacagtagaaaccaagctcatgaagtctggcccagagtcgtgtcctctgggtccatatgtcctaccactaaagcttagtattcatgctgaagatttaataccgaaaatcagtttgagaagggacagagagggaagaagaaagaatagggtaataggcgggaagataaggacgacatacactgagaagataacaccgatagaacggtgacgacagctggacaaaaaaacaatggctaagcaagatgtgggaacgcacaggaagaacgagggagaagaccgagccgaaagggatggacaacagtgcaagaagaaggtggtcgatgaattagacagcagggaccatgtacagaacatggccaggaacgggacacacgggaagcacatgttgaaaacaagcaattttccaagagtgtaggggtaatatacaaaaggaagaggtataggtggaaggagtacaaatcagtcgtggaaaggagagaaacacaaattagtaagtatcaaggggtggtaaggacgatgaagaacacatgctagtagtgtacgtgcaaagaaaaacggatagtcacaatagagtagtgactattaggacaaaatgatatggtatgcagagaagggggttaaatagcgaaagcattatttagcaaggaaggagcatatgtgtggggtaaacaagaaagaaaaggtggaataaaatagtcagcgtattgggcatgagacttatcagaggagattgaaaagaataatatgttacagaacaagccattttctaacgggggagacgacgaatgaatagatatacatatgaagaggaaggaaagaaaattg

SEQ ID NO: 548437 - DNA, 769 bp, Homo sapiens
cgcgtgtgttgtttgatctgggcgtgctgctgtctcccctcactctgcccgtctcgtcacgaggtacgacgggcatcactggacgtactcagtgggcagcatgtgcgctgggagcatggattgtgcctttgcggccggggcaggagcaacaggctctgaagtggggagcagcagcgggttaggccagtggtgcttctcacgggcgatacagcaggcatcggttgctggtaaccgacaagagacaccttcgaattaagcacagttcctcgattccaggcaaagcgagcgcaagcatgatcgaaatgagcttcctgagccgcgaggtgttggtgggggacttgatgtccccctttcgagccgtcgggttagggggctgaacgaaagcctaggtctcttagatgattacctggaggaggccaatgcacttcaaacctcatgggttctccatgcgacgaggctaaggcgggctcctccgaatggctggctgtggatgggttggatcagtccctccaagcaagcagcaaggaggatgccttctccgggacagattggactgtggacgaaaatggatttgaaggagttcgacttggatgccctgttgggtatagatgacctggcaaaccatgccagatgaccttctgaccacgtgtggatgacacttgtgatctctttgaccccctagtccaaggagacctaataagcaggcccccagacggttgaaccaaatggacatctcgcagaaagtttaacaaaaccgaccaggttgccc

SEQ ID NO: 548438 - DNA, 173 bp, Homo sapiens
cgaacatcgacctcgtcctcctactcaggcatcacccctgggctcttcagctcagactcccgcggagtggggctcgtacttcaaactactgctatcccctatccatgaggtccacggaggctctcctagagaacccgtggtgtcaccaccaccagtgtacggttgagcggaga

SEQ ID NO: 548439 - DNA, 800 bp, Homo sapiens
  misc_feature (12)..(12): n is a, c, g, or t
  misc_feature (42)..(42): n is a, c, g, or t
  misc_feature (59)..(59): n is a, c, g, or t
  misc_feature (110)..(110): n is a, c, g, or t
  misc_feature (128)..(128): n is a, c, g, or t
  misc_feature (162)..(162): n is a, c, g, or t
  misc_feature (611)..(611): n is a, c, g, or t
  misc_feature (625)..(625): n is a, c, g, or t
  misc_feature (711)..(711): n is a, c, g, or t
  misc_feature (715)..(715): n is a, c, g, or t
  misc_feature (727)..(728): n is a, c, g, or t
  misc_feature (731)..(731): n is a, c, g, or t
  misc_feature (740)..(741): n is a, c, g, or t
gtttaggtcgtncgtggtggagtatctgcccgttctgctcgncgattgcggctcttgtncgagcgcttccagcgtcgcctcggtctcagcaagggccccagactcggctntgggtgaaaaaaaatggnccgaaccaagcagaccgctaggaagtccaccggngggaaagccccccgcaaacagctggccaccaaggcggctcggaaaagcgcgccctctaccggcggggtgaagaagcctcaccgctacaggccaggaccgtggctctgagagagatccgtcgttaccagaaatcgactgagctgctcatccggaagctgccattccagagattggtgagggagatcgcccaggatttcaaaaccgacttgaggtttcaaagtgcagccatcggtgcccttcaggaggctagcgaagcatacctggtggggttgtttgaagataccaatctgtgtgccatccacgccaagagagtcaccatcatgcccaaagacatccagttggctcgccggatacggggggagagagcttaagttgaagcggtttttatggcatttgtagtaaattctgtaaaatacttggtttaatttgtgacttttttgtaagaaatngtttataatatgtngcatttgtacttaagtcattccatctttcactcaggatgaatgggaagagtgactgacctgttcacagacctcagtgatgtgagcnctgngggtcaggaggnnacngtggctaanngcaaaagggcagtgggggaaacaccttggcgttccagaagcaggggccggaggtaagac

SEQ ID NO: 548440 - DNA, 548 bp, Homo sapiens
  misc_feature (149)..(149): n is a, c, g, or t
  misc_feature (209)..(209): n is a, c, g, or t
  misc_feature (221)..(222): n is a, c, g, or t
  misc_feature (233)..(233): n is a, c, g, or t
  misc_feature (254)..(254): n is a, c, g, or t
  misc_feature (329)..(329): n is a, c, g, or t
  misc_feature (337)..(337): n is a, c, g, or t
  misc_feature (405)..(405): n is a, c, g, or t
  misc_feature (435)..(435): n is a, c, g, or t
  misc_feature (450)..(450): n is a, c, g, or t
tcatcgcaggtgcctggtaaatggtggatctccccacccctcctcaacacacagaaaacagggcgggcagcgggcaacactgcactgtcaatgaataactcacctctgtagtgaaccctgggagctgagcaggagggtgaaacgggaangccggtttcccactaactggcagcaaggcaaatgtgggctgtcctatggcccctctgcangtgcggaatggnngggtttgtgancccctttgttgtcgaagacanctccacggggttccggaagtgcttgctctacagacaaaattggggcagtcttgcgccccctgaaaagtttcagantaggtggncccagaagagactccaaggcatgtttggggagcactggcacagcagattaagcttggctgtgatctancaggcctcagatattggaatggcaagaganctggctgtgtaaatngggatgtaagtctggttcaagatcagcctttcattctgccctggcctggtcattaataaaatggggccaatgtgttcctttgagagacctaaaaaaaa

SEQ ID NO: 548441 - DNA, 146 bp, Homo sapiens
gacaaatattccacatctgtgatctctccagtcaaagtctttgagacgagccatcggccttggcaacggagatggatcactgactcacccactacgcggcccgcgaaagcaagttaacggcataacgctgtgactgcactcgcacg

SEQ ID NO: 548442 - DNA, 145 bp, Homo sapiens
aaaccaggtcggcctgccccccgtgacttaagcctaactctctccacccacctcccaggaagatctggcctctgtcctgtgcccacttttgattgtatctaattctcctgagtgttctccccgggatacaggggtaccgagctcg

SEQ ID NO: 548443 - DNA, 124 bp, Homo sapiens
gacctgtctatcgacgacttggcgactggtattgtgttatggcaggaggttttatattgataattgtgtgctgaaattagatggcccctaagatagaggagacacctgctaggtgtccggagaa

SEQ ID NO: 548444 - DNA, 119 bp, Homo sapiens
tacttaagcatttatcatgccccaactaaatactaccgtagtgggccaccataattcacccccatactcctatacactattacctgcaccaccccaatctaatacataattacaacact

SEQ ID NO: 548445 - DNA, 156 bp, Homo sapiens
gataataggacaagcatactttaaaatttctgaatacttaaacaaaagcgcaacatcttgaaaaccagtcttgtcatttaaacctattaattgacacttaaggtcctgggcttcttcttaaataaggagggcaccaaggctttttttagagtgaca

SEQ ID NO: 548446 - DNA, 439 bp, Homo sapiens
aggaggagaaaagtcagcctcatgataaaaggaggcctaaaggtcccacaaagaaaggaagagtgcacccggcttatgaacagatatagaagacagtcagttcaaaaatgttacgctgcaggtgatcatgatgaagaaaaagtgggtctttactggcaccatgcagaacctcccagtgaaaattccagttgcttcaaattcagtgtggaagctgagactccagtgtggatgcacagacagctaagggtgattccataagaactgcagagtgaatgtcaacaaggcccttccttcgggcacttacaattaactctaaagatgggacacctaatctggaaaagcttctaggctaggaaacctggctagaagcctgaattggatccagttctgtataccattaactgtgaagtttcaataaatcatgtaacttctgtctaaa

SEQ ID NO: 548447 - DNA, 869 bp, Homo sapiens
cgcgcccccagaccccgagaatgctcgcgagctccggcccggcggcgatggcgcggagcggtgcgcgtgctggtggacatggacggcgtctggccgacttcgaggccggcctcctgcggggcttccgccggcgcttccctgaggagcctgcacgtgccgctggagcgaacgccgcggcttccgtggcccgcgagcagtaccgtgccctgcggcccgagctggcggatagagtggccagtgtgtacgatagcccctgggtctttttcctggacctggatgctcatcccgggatgccttggacgctgtgcggagatgatgaacgagctacccggacacgcaggtcttcatctgcagcaagccccctgtctgaagtaccaccactgttaccgctgggtggacgcagcaccttggtgccccaggttcgtagacaccgaattatcctgacaagggacaagacgtgtggtctgggtggaccttgctcattgatgacaaggacacagttcgaggccaggcaggaagaccccaagctgggagcacatcttgtgcacctgcttgccacaatcggcacctggtcctgcccccgaccaaggagacgggcttgcttctccttggcagttgaacaagctgtgagggcaggatcttaggattagcaatgcgcgggagctgacgcagcgggggaattgcagcgggcgatttccctgcgaggcaagcaaggctttggacgcttaacgggaacggcgcagggcccacaggtgggacacgcgaaaagcccagagtcgagaggacggcaatcgtgcctggttcccctctggcccccgagtgagtgaagcacaggcagacacccggtaagcgctggtgaaccggggacc

SEQ ID NO: 548448 - DNA, 233 bp, Homo sapiens
gcagaatatagagacgagactcatattattctcatcagttctgcagtctcctgccctatggtcatcccactgaaggagtgtcaataatcatgtcctccagctgctgttgtcttagctcaacgccatgctgggtgccatcccactaggttcttgaccctttccaatttaactgtaattgctgttctcatatctgaactggaagctttatttatcactttctgtgcccatttcaa

SEQ ID NO: 548449 - DNA, 824 bp, Homo sapiens
  misc_feature (51)..(51): n is a, c, g, or t
  misc_feature (53)..(53): n is a, c, g, or t
  misc_feature (129)..(129): n is a, c, g, or t
  misc_feature (138)..(138): n is a, c, g, or t
  misc_feature (145)..(147): n is a, c, g, or t
  misc_feature (153)..(153): n is a, c, g, or t
  misc_feature (156)..(156): n is a, c, g, or t
  misc_feature (174)..(174): n is a, c, g, or t
  misc_feature (192)..(192): n is a, c, g, or t
  misc_feature (237)..(237): n is a, c, g, or t
  misc_feature (247)..(247): n is a, c, g, or t
  misc_feature (254)..(254): n is a, c, g, or t
  misc_feature (283)..(283): n is a, c, g, or t
  misc_feature (297)..(297): n is a, c, g, or t
  misc_feature (311)..(311): n is a, c, g, or t
  misc_feature (344)..(344): n is a, c, g, or t
  misc_feature (346)..(347): n is a, c, g, or t
  misc_feature (378)..(378): n is a, c, g, or t
  misc_feature (389)..(389): n is a, c, g, or t
  misc_feature (420)..(420): n is a, c, g, or t
  misc_feature (469)..(469): n is a, c, g, or t
  misc_feature (814)..(814): n is a, c, g, or t
cggcggcggcggcgggggactcggactcctgggacgccgacgctttctccntngaagacccagtgcggaaggtggggggcggcggcactgccggcggggaccgctgggaaggcgaggacgaggacgacnacctcaagnataactnnnatcacnatnatcatcaaaaaaaacagnaaccacaagtaaaaccanaggtaaaaatttcaaaaaaaaaaaaaatagcagagaagataaaanacaaaaaacngcaacanaagaaaaggcaagaagaaattaaaaacangttagaacaacccnaacaacctaaagtnctaacaccagaagaacaattagcagataaactncnnctaaacaaattacaggaagagtcagacctcnaattaccaaangaaacttttggtgttaataatccagtttatngaatacatcctatcaacccatcttcaacacatcactttacacagtttgnaaagttactaaaacataaaattacacaatatgaaaagtcactatattatgccagttttttggaagtcttagttcgagatgtgtgtatttcattggaaattgatgacttgaaaaaaattaccaattcactgactgtgctttgcagtgaaaaacagaagcaagaaaagcaaagcaaagccaaaaagaagaagaaaggtgtggttcctggcagggggattaaaagccaccatgaaagatgatctggcagattatggtggttatgatggaggatatgtacaagactatgaagacttcatgtgacattttatcttttcttggtgtcatctttatgttgcccacaatcccntgaacatgta

SEQ ID NO: 548450 - DNA, 217 bp, Homo sapiens
ttgtgctttgttgaggcattcagagaaattattgggcatgccactagtgatactgagggtcaggggggtagggggatgatttggttgagctagtgaggcttgttgttggtgaccattccatctgggagatgaatagttagagttgcagctgctgcttcatgtgaatggatagtctcgggggatgtatcgttctggataggggcacaaaatcccgggg

SEQ ID NO: 548451 - DNA, 661 bp, Homo sapiens
  misc_feature (380)..(380): n is a, c, g, or t
  misc_feature (446)..(446): n is a, c, g, or t
tagctctgtcacccagattggagtgcagtggtgcgatctcagcccactgcaacctctacctcccgggttcaagagattctcctgcctcagcctcccaggtagctgggattacaggtgcctgccaccatgcccagctaattttttgtatttttagtagagatggggtttcactgtgttggccaggctcgtcttgaactcctgacctcatgatccgcctgccttggcctcccaaagtgctgggattacaagcgtgagccaccatgcccggactagttttgttatttttatgcagctacaaggaggaaaatgatacatacctttcattactgaagatggaaagatgtgtaagttagataagagaaaaacagatcctgatgacnttccttccaacataaaccacctgtcagaagacggtgcagggagactcaggccaaagggaaggtatntgtcagcctctcctctgactaaaactcccctaggaggggcagaggtcagtgtaaaatatgtattttttgagacagagtctcacattgtcacccaggctggagtgcagtggtgcgatctcagctcactgcaacctttgcctcagcctccctagaagctgggattacagggcatgcaccaccatgcctggctaatttttgtatttttggtagagact

SEQ ID NO: 548452 - DNA, 541 bp, Homo sapiens
tggcagggcaactccaatcatagcagtcatataagataaagtacaaataaactattgtatcaggctcaacaggcagactgtccattagactgactatctattcactgagtcatctgcatttaagtgttctccatatcttttcatggcctgatagctcatatttaatatagtgctgaatgatattccattgtctggatgtgccacagtaatatttatccattcacctccagaagaacatcttggtagcttccaagttattgccagctatgaataaaactgttataaacatctgtgtgcaggtatacgtgtggacatgagttaaccacctcatttaggtaaatgtcctgtccttataacaatatgtattactctcttgttatatataaaactttcctcctcattttagctcctatatcactacaagatttccttagctataaacttgactcaactgaggttaaaattactgctattatggtataccatttctaagaagtataaaggataataagttatctgaacatcccttttaacagcatct

SEQ ID NO: 548453 - DNA, 104 bp, Homo sapiens
tgcccccaagtgtatataacttggcaaaaacaaaaccggccatcggttctgtgggtccagttcagcagcccccataaggtgtggccccggtcccagcatcctgt

SEQ ID NO: 548454 - DNA, 349 bp, Homo sapiens
ctgaggcttatagtactgtgtgatatggtctcagtggtggtgataaaagaactgaagctggtagtactgtgtgaggtggtcttggtgctggcaatcaccaaagtgaacctgggggtactgtgtaaggtggtcttggtggtggagatcgcaaaggtgaatctgggaggactggttgaggtggtcttggaagtggcaattgaagaagagaagccgggagtactgtgtgaagggatctcagtggtggtgcttgaagaagtgaagctgggagaactgtgtgaggtggtctcagtggtaacgatcaaagaagtgaagccaggagtactatgtgaggtcgatctggtcctggtga

SEQ ID NO: 548455 - DNA, 107 bp, Homo sapiens
ggtgactctccggatcttccggagagcttaccttccagcacgacatacttacttccatctacattccacttagaaagtctacaaatccaggagtctacttcatttat

SEQ ID NO: 548456 - DNA, 319 bp, Homo sapiens
atgttttccttagtcagttatcaaaacttcattgaggttggccatggtggttcacacctgcaatcctagcacttcgagaggccaaggcaggcggatcacctgaggtcaggagtttgagaccagactggccaacatggtgaaaccccgtctctatgaaaaacacaaaaattagccgggcatggtggcacacatctgtaatcccagctactcaggagctgaagcaggagaattgcttgaaccgggaggcagagtttgcagtgagccaagatcatgccactgcactccagcctgagagatagacgtgagactctgtctcaaa

SEQ ID NO: 548457 - DNA, 802 bp, Homo sapiens
tgggggggggggggggggggggggggggggcagcacaacaaaaaaaaaagcgcggcgggtcgtggggggcgaggacgacgcaggggggggggggggcgggggggggggggcggcgcctgaggagccgggggggtgatgaatgcaagaacacaccgccccaccacccaccgcacaccccacaaacaaccacccagcacggcgcgaggagatggggccgcgagacaagagtggcggccccaccgaacaagaaccacaagcggcagaccgcgccgcgatgcatgcagaacgccgccgcctgttgagggggccccaccagagcgggggcagcccacacaacaagcaccggcatcccaccgcggggggtggtcttgcgcataaaaaaagaccacagggggccgcggcacgccacacaaacaagcgcggcggtggtcttctccgcccacccaaacaaactgagaagtcgagagggggggcaagccatgtcacacccccgggcgagcgacgaggcagcacagcctgccggcagcggaactcgccccacggtcccggcgcccctgcgcttcgtcgtgttcccgcccggcggggggccgcacccctcgcgccagcagttgggtgggtgtgctcacctatgggcggggccccccccccgctcggcgttttgttgttttacggtcgcctcgcacgaccacctgcccttgttctcgcacacccccacccgcgcggtgtcttttttctctccgccgatacttgttcgcaccaaccccggctcggctactttcgacccgccgcgctgctttctttt

SEQ ID NO: 548458 - DNA, 171 bp, Homo sapiens
ggtccaggtcggggaactggctggaatcgaacaccggggtcttgatacccgccgcgcgctggttgtcgtagtcgttgaggatgcgcatggcaatcttgaacaggaacgccagggcgaacaggttgacgaacgcgagcatggtcatggtgatgtcggcgaaggcgggtaccg

SEQ ID NO: 548459 - DNA, 229 bp, Homo sapiens
ttcctttcctagagtcaccttttagatgataatggacactatagacttgctcattgttcaagactgatttgccccctcaacctgaaatccacctcttcttgtattcaaggctcttggggaattttcttttgacttttctttttaaggggcaggaggcattttaggttaatttgtaggtaaaaggattaggttttctctcccccctcttccctgggggcccagtaaataa

SEQ ID NO: 548460 - DNA, 358 bp, Homo sapiens
  misc_feature (209)..(209): n is a, c, g, or t
  misc_feature (229)..(229): n is a, c, g, or t
  misc_feature (280)..(280): n is a, c, g, or t
  misc_feature (314)..(314): n is a, c, g, or t
  misc_feature (331)..(331): n is a, c, g, or t
ataaaatatatgtaggtactagtctatttcatcatttactaccataaaatatatacaaatctatgataacaagttaaaatttatcaaaacatatacacactcaaaccacatggttccaccatttgcagtcataagaaatgtaaacagctgtaaagatacagtattaaatcatagctgtgtaaaattaaatatagtacgtatttaccagngtaacaatttttgtggccgncacctgtttgctattctggtgtactcaagtgtttgtgaatgtctgggaggnttgaggctacaatgagccatgattgcaccactgncactccagcctgtgcancagtttcaacagcctgtctcaaaaaaa

SEQ ID NO: 548461 - DNA, 387 bp, Homo sapiens
  misc_feature (121)..(121): n is a, c, g, or t
  misc_feature (351)..(351): n is a, c, g, or t
  misc_feature (361)..(361): n is a, c, g, or t
tgctcctctgcatgtttgtgaacagagggatgtcaaaggactgcactccagcctgggcgacagagcgaaactccatctcaaaataaataaataaataaataaataaataaataaataatanagctgtttttttgagacagacagggattgtcagaatgaataaaaaagcaagacttcctatatgctgcctacaagaaacacgctttaaacataaagacacaaatagcttaatctttttcttgtttagggaaaaaaaattgcagctcactgccagcgttcatttacttttacataaacacactctttgaggctgaggtaaatctggactggattttcaatgtggaaaattanaacataaaanctgttcttgggattattttcttaaac

SEQ ID NO: 548462 - DNA, 445 bp, Homo sapiens
agcggggtggtgggggctgtgagcctgtgtctagctgttcgggctgtgcagtggtccatcctcctctgcgcaacataagcccttgcgagaccgaggcggtcgtgagagggggtatagagtgataggcacgtgcgactcgagacggcctgcagtacactgggactgaacacacagagagaggtgcgctagtaccaatcacgacactatctgtaagtagaaaatagaagattaagtcatactagcagtcacatccaataccacggtaggcaacagaaatatacgacataagggtcagacaaaaaaaaaaataaaaaaataaatacaagaagaaaatacgaaacaaacaacaatgaaaatcactaccaaaaaaacagatcttaaacaaaaaaaacaactacataataataaccatacaaaaaaccaaacataaacatttagacataac

SEQ ID NO: 548463 - DNA, 900 bp, Homo sapiens
ggacgcgtgggtcgacccacgcgtccgggctccggcattgagcgcattggcccgttgagcctctaccacatggcctccagcattgagcgcatgggccagaccatggtagcgcattggctctggtgtggagcgcatgggtgccggatgggcttcggccttgttagcgcatggccgttcccatcgtaccgtgtgggccagaccattgagcgcatgggctctggcgtggtagcgcattgggcctcgtgccatcgagcgcatgggcctgagcatggagcgcattggtgcccgtcgaggtatgggagtcgtgagcctgtagcgcatgggccccgtgatggtatcggatggccaccggcctggagctgcatgggcgccaacatatctgcagcggatgggcctggagctgcatgggcgccaacaggctcgagcgcatggtgcctggagcgcatgggtgccattacagcctcgagcgcatgggccccggtccatgggccccggaccttgggcgctggcattgagcgcatgggcctggccatgggtggcggtggcaggtgccgtcgtttgaccgtgccagtcgagatggagcgtggcacgttcggaggaagcttcgcaggtcctttgggtggagctggaacgccatgcacctggggtgggccatgaacgcctgcagatatttgtgagaaatctgccaattcgattccacattggaagatgctaaaggaacaaattcacgagttggcggcacagtgctgtacgccgacatcaagattgagaaatagggaagtccaggggagtgtggcggttaaattccgacttgcaaagtggctaaaactgcgcataaaatggttaactaattgccgaaaaacgtccatgaaaaagcttaaacgccttttaatgtagaac

SEQ ID NO: 548464 - DNA, 102 bp, Homo sapiens
aagttcttctgccagtctggtaactaacagctccccaaaccctagccagctgctgacctccacctaggctcagacatccaactaactgccagacaaccccac

SEQ ID NO: 548465 - DNA, 235 bp, Homo sapiens
tttggcacaccgattaactaggacattgaccataacaacgcaggatcagatctatggccacatctcgctggccgtctgaaggccttggctgtgaaaagccgctggtgcagggcccggcggatagggaacagcacgactggcacagtgagggtcaccgcgagcagcacggccaggcgcacacagaggatgagcgggtccttctggctgtacatgtgcagcatctccgctttggaaa

SEQ ID NO: 548466 - DNA, 262 bp, Homo sapiens
cgtgtttcagttcactggagctccgtctcccgggtttaagtgattctcctgcgtcagcctcctgagtagctagggattacaggcacgtgccaccatacctggctaatttttgtatttctaggtaagacggggtttcaccatgttggccaggctggtctcgaactcctgacctcaggtgatccgcccgcctcagcctcccaaaagtgctgggattacaggcatgagccaccgagcccagcccgagaggatttgtttactgctt

SEQ ID NO: 548467 - DNA, 559 bp, Homo sapiens
tccctttgtgtacccatgggaaggggtctacagtgtatcatgagccaaccctcaaaggacccgtattacagtgccacgtgggaaaacgctacaggaagcatgacctatccacatctttccaaaatagacactaacatgtcatgtcccaaacattagcacggtgggggttgagctcgtgtgcagtaatcgaaatggggagaattggggcagcgcgtgagaagtgctaagctactgtgttttctcacttgagcccgggtaggctgtgtgggccctcactggggattctcagcagttacatgaaagtggtgctgataatctcttctctggtcccaattttagtcaggcagaaaagggtaacacatgagggtgctctgtgtgacttaattttggtcccagcggactaaatggcttatgttatatccccggtcagcggaggggagaatgtcattcatcaataaaccaaagccaatagcgggagaatggacgatctggttgacagtggttagggttaacatgctgtactatcctgaggaattgcgagatattgctgaggggaaca

SEQ ID NO: 548468 - DNA, 893 bp, Homo sapiens
  misc_feature (341)..(341): n is a, c, g, or t
ggcagacactgaccttcagtcgcctcgcgttccagcggccatggtggccctccaggaagttcttcgtggggggaaactggaacatgaacgggtggaaggcagagtctgggggagctcgatcgggccactctggagacgcggcccaaggtggcgggtcagcccgagcggaggtggtttgtggctccgccaccaattattgcactattatcagattctcgcccaggggcagaatgcgtagcatcccagaggattgctagtgggttgccgcagaggaattgtctcactcgagtgggattcatactggggccttgctattagggggagcatctagcaccttgtcnatgtatctaagagtcctgctggatccctcgtggtgtggttcttgggggcgctcaagacgatgacaggccattgtcttgggggggaggtcatgaatgaagctgttttgggcagaatctggtggccccattgtgtctggtcagcagcgtcacctcggcaagttaagtcgccctgtcgattgaggagagagtcggagcatgataggggaaagctgtcactcacgtgcagaaagggttgttttcgaggcatacaaaggtccttcgccaattcaactgtggaaggcgcatggaggaaaggtcgtactagcccgtagtgaggcgtgtgtgaggtcatggggtacttggcatgaacttggtatgagcccagacaggcgccgggaagtaccttgataaagttccggacgaatggtgtaatcccacgttgtttgaagcgggggcagaagcccgtataattttgggggtcctgttgctggggactcggatgagtgtccaccactttttggaggcaccttgggggggtcccaacaattggtttaggccaaggccaacttctcc

SEQ ID NO: 548469 - DNA, 613 bp, Homo sapiens
agcgggtagattggcgtgctgcaaaccagctctaggcggctctgggatcttcagcctgttaaacaagaaaacgaaaaaccccttccacacaacatacgagcattgaaagtgagaacaataaacacagccacaggagaatatgaatcatcatgtggaccgttaaacatggtggcttttgtttatataccaagagaggttgttgcttggttctgttccaaagatgaagaagcagcacaatgataagttatgacagttttattcaagtttggaaggaacttaagtttagaccaagcccttcattgatgtgtatcaggagttgctccgagatgaaacaatatgtgggctgccagagataagcaactgaagcattctgaaggcagtctagcctgtgtaaattaataaagcttcaggcgaatcaagcccgtaagtgggaagcgttcttttcccgaatgtgttccacattttgaatgggtaaaggacgaggaagcatgaaccatgttgtaattctacagcctttccagaggaaacctttccgctgttcatgacgtatatcgagccacttatgggtgatgaccaaacgttatgaacgcttttacacaggaaagaaggacca

SEQ ID NO: 548470 - DNA, 835 bp, Homo sapiens
tagcccggaaggtccagagggcaccacgcaacaaactcgcgtgaccccgagcacccacaaaatattgggtgaaggccataaaacgtggacgggggattaccaaacccgcgggatgggagacaaacagtgcacagtgttaaaaggcgacccgtgttccacccttaggggccccagcccagattgcggcccggtgggcacgaaaacgggcgcgaggtcaaatgcacaccacggggggaaaaacaaacgatctatttggaggaacaatatgagcccctctataggggcctcgccccgtggggtttttccccaaagggcgcaacttacaacgaaagctgtgtttcacgcctcccacagggggtacaccccacggggtcttaaaaaacgggagtctccaatcatccattgtgtcctgtggccataatcgtttatacagaaggcgcacgaataggcgtttcgcgctaatagatcggcggtgggaaccagcacattccaaccgtcgcccctgtgcttctgccgcacccaaagtttcttataactggcgcaacaaggttccaccgcaaccaggcctcttacaaccgggatgtgctgaccatgctctgtttgatattcgtcctgctagatctgcgatacgtttaaacagccgcggcagaaccccgcacaggtgacctaatcacccgttgcagcatggtcataggacgcaacaggcggcgtggaccgagaactccggagcgtacgagcattcatccggtcgaaatttcttctttaggagcagataaaaacacccttgatgattgtttcaacaaaaaaaacagcggcgttatttcccccaacaaac

SEQ ID NO: 548471 - DNA, 117 bp, Homo sapiens
gtttgattattgaggaagattttaattattgcactaggagtttttgctttagcgtgacttaacaaatttgtttgattgattatatgtctcgaaatctggccaatcaaagatgcagtc

SEQ ID NO: 548472 - DNA, 248 bp, Homo sapiens
ggggttgggggggtttttttttccccccggggaaaaaaaatgttttgttaaaaagggggggccccccccggggatttttgcctttggttttcccggtttggaaagaggggcccccccccggggggggggtcctatttttgaaccccccccccccccctccaaagggggcccttttggcccggccccccttgtttccccccctttcccctccctttttttttaaaaagggggggttttgggggggggta

SEQ ID NO: 548473 - DNA, 304 bp, Homo sapiens
atcaaagaccagacacatcgcagttgctcgcgaatcgtcacgttcggcaatcgccagcagtgccggcttcaagtgatttgacagaggcgcagggttgcgcaatattggccacggtttgccactgtatatcgcctggagagtagcccccccccagcaccggcaccgcgttatgggccgccgattacatccacctgtgatcaacggtcgcccttcacgggcagcccaggccagtgtttgcgcttcgtcatccaggtcgacccaatacaaacccgtggtctgtacctccggatcgacgccggttgca

SEQ ID NO: 548474 - DNA, 616 bp, Homo sapiens
tctctttgtgatagaaactgcaaatggacatttggagcgcttagaggtctaatgtggaaaaggaaatatcttcacataaaaactagacagaagaattctgagaaacttctttgtgatgtatgtgttcatctcacagatttgaaactttcttttgattgagcagtttggagggggctctttttgtagaatctgcaagtggacatttcgagtgctttgtggcctgtggtagaaaacgaaatatcttcacataaaatctagacagaagcaatctgagaaacttctttgtgatgtgcgcattcatctcccagagttgaacctttcttttgttggaccagctttaaaatactctttttgtagaatctgcaagtggacatttcgagcgtcttgagtctatggtggaaaatgaaatatcttcacataaaaactagacagaagcattctgagaaacttgtttgtgatgtgtttgttcatctcacagatttgaacctttcctttgattgagcagtttagaaacactctatttgtagaatctgcaagtggatatttggagcacgttggtggctacagtagaaagggaaattcttcacataaaatctacacagaaggcatctgagaa

SEQ ID NO: 548475 - DNA, 972 bp, Homo sapiens
cgcggccgatgcatacgggcagaggcttgtcctcgctgcgaccccttgaggcggtacacagctgcgcagagtccgccgagcagctcgcctgcgcaggccaggccgttacatgcgtatcgggtggtggacggccaccactgtgcgccggcgcgcatggtcggccatggcgggcccgcatgcgcgctcggtccagcctgcgactgcagctccagtgggcttcgcgatgtctgcgacagggaccccgtctccaccgggggaggcctgacaagcaaagctctggggtctgctcgcggggttccgccagagagacgcgggagctcgtggcaggggcgggaaacagaaggggcggactctgccatccctgttgggaagcccaggtcaagtgccccccctactgtctacaaagacccaaaccgacgttgggttaaggaccaccggcggtgccccgtcgagattcccgcttgtaaaccggaaagtcgtcccggtgaagaacgattccgtcgcgcaaggccccctggctttccggggaggggacagttgaccgcttcgccgaggcccaaagcttcgcggttccgagggaggtacctcgggcgccctgggccatcatgccgcccgtggcaagcgttataacgggaaccagcagaattcccccaggacgggactttgacatgggacgaacgcgggaagttggcttgccctggtcgttgcaaaccggacggggccaaagggctgggggcactgggggtctcaggcccgttgacgggtccatgacccgcatcaagccaagtcccccggggccaaggggagtcgtcggcccacagtgagtccttgcgttgggacctgcagtgtttgtgatcgcaactgtgttgatgcgtgtcagtcatctctggtacaccccagtcggctggcccttgcgacgcgaggacttgtttacggccagctgttgggcctgtctgcgcgccccgggaagcg

SEQ ID NO: 548476 - DNA, 896 bp, Homo sapiens
gcgctgttggctgctcgtgttgaatctagaaccgtaccagacatgggactggaggacgacgcaaaacgatgcttaccgaatccggcagatcctgaggaggaggaacgaggaagaggaggaattagtggatcccctaatcaacagtgagagagcactgcgagcagttggagaaatgtgtacgggcccgggagcggctaagctctgtgatgagcgtgtatcctctcgatcacatacagtaagaggatgcacggaggagtctcttgacttcttgtcatgcgaggtgagcattgcgtgggccacaaactctttagacaacttgtaaccataacatgtgtggagcttaattcaccccagatcttcatcatctgggcagtcagaatatttccttatggtgtttggatgtaccatttgttcttcttatctagtgtaagctgtaagattcacatgaacctcatgggtttgggttaggctggtagcttctatgtgatctcgcaagtgattccatctagactcaagaagttctatgatctgcccatggacggaaggccacgtggcttccggagactacgtgctgtgctccggggcggggtcaaacaggctgggccctcccgtagcatcgtgtaaagacacccctttggtgggggagcctagggcgggcgctcgaaaagaatgtgagtccagggcgtgggttacttgcttccgaccattgagagagtaagcccgaaaaagtgcgctcgacacgggggaggccgacaatttggaaaggggccgggttctcggtgttgtggaccgcatcctgggtctcaacagttgcccccctgcttccgccgcaaatgtggctcggtgagggaagtgtggcggaaaagagggtggttaagccgcaggtttggacgatg

SEQ ID NO: 548477 - DNA, 1912 bp, Homo sapiens
tctgctgcagacatcagtggttggggtaccgactctccttctggtggtgggttgcgatggtggtttgtctgtaatactagttgtacaaccttgtttgactccgttgtgatgtgggtgtgtgcttagtaacatgatctgacataggaggttgtggatggtttgtctacttatatactctctctgtgttgtttgtacaatacccatactatgggctggggggctctgcacgtgattgtttacgattgcattagttagtgaggggggcgaaaggcctacattatgatttataggggctgatgatctgcggtaagaggtatggttctccacttcacgtggttgtggtggggggagtgtgtgtttacggggagctgcagtatggtacgcgtgttcaggttgttgtgttgggtggtgttgttgctccttgcagtgtgtatcgcgttggcggtcggaggtgtgtgtggtggagtcgttggtttgttgtgatgtctttattacctgctttgtgtgtttgtactaagcgattaggtgataggattggtgggtggtgggtgttgattagtactcgccctccagtcaggtttgatgcctgcgtggtaatatttttgtttgttgagtgaggggggtcgatacaagaatagttgtggtagcgttaacagtatgtgagtggggctttgatatataaggggtgttgggtgggatgatattaatttgtgagttaaatggagttggttttgtgttaatagactgcggaggaagggtgttggtttagttgttctggttgtgtttgggcgtcactgatgtggttagatgggttgcatagtctagtagattagggtttgggtgtgggttggcgtgtagcataaaattgggggcgtcgctctcacgtttttgggcgtcactttttttgttttgtagattattatactatcttgtgcgtcgttgtgatgagtagtaggtcgtgtgcataatagtattgtttgccttatcatcatgttatgtatcagccgcgacaagtcacgtcgtctctgcgctgcgacgtctgccgctccgaccacttcttcgtcgtctgtctaccaacagggagggggcgaccaaaacagatgatgggcgtcacgctagcgcttcgcgcagtgcgtcacacacaccgctcgtcgctcgcgtcgctcgtcgtcgcgtgtgttgtttgatgagcacacgacatcgtcgtcatctggggtggtgttgtggggtcgctgcgtcatgtgcttcatcgttggtgcggcgccccagcacgcggccgacgtgtgtgtgtgagtgttgtgtgtggcgcgcgacacgcatcgcgcttttgtttctctctactgtgggggcgccgccgtgtggagagcgccgcgcgcactctgggggtcgtctctctctgtgggacacacagggagtatttgtctgtgagaggcgtgtctctctgtgtgtgtgtgctcctcccccgacacctgcgtgtgtgtggtgtctcgtgtgggcgcgtcgtcttagtgcgccgcgctgtgtgtgtgagtgtagtgtgtgtgtgtggtgcgcacactacagccacggcgcgtgggggtctatacacatctgtgttagtctgtctccacaccacacactgtgtggccacacaatcgtgtctgtgggagatgtgggagaggagtgttggtgtcaccacatctctccatctctcagaatatatcatccacacacacagaggccccgctgatagtgtatattctccgcgcgcactccacatatactcctaattgttgtgcttgtgtggagatgatgttggacgagttctctgttgttgtgaacaacgcggttggggatttgtgtgctcctcagggttctcctcaccccctgttttattgcttgttgggggagtgtgaataaaaataataaataa

SEQ ID NO: 548478 - DNA, 1184 bp, Homo sapiens
gaggagctggctggccgggctggctggctggccggcgggcggctgatggctggctggcgtgaggcctggtggcgactgacgcccgctgcgtgcggctgagcgcctgagcgggcacaggcgctgctggccgacgtggacacgctgctgttcgactgctgactggcgtgcttgtggctgcgtgggatgaccgcctgtgccttggctgctgcccagaggccctgcgggcgctgcggagccctgcggtaagctgcctgggcttcatcaccaacaacagcagcaatgaccctgttgctgccctactgcctgaggaatgctcgcggctgcctagggcttcgggcgtgtccctgctggggggccctggctgccaaggccttgtgcagggtctttcgggcaacgggcccttacttggtacctggcggctccttaacctttgctgcccagtcgtgccttgtgcctggtcggccccctcgatgtccccatatggccgcttaacgttgactgggggccaggcccccaaggtccccttgggcccgtcgggcaacgcttgagaggggcccgtggggcgcggtttccggcccgaggccggtatgcgcgtctttggggggccccacggatgtgcccaaccttgtgcaggcgggccagagtgcggtgttccccgtgggcggacgcttgggcctttgtcagaccggcggccgcggctttggtaggccccgccggaacgcggttgcccgtcgtcgtgcgttgggttgggctagggagcttcttggaacgcgcgggcaagcgtttcgagcgcttaacctgtttgaacagggctttgagcccatagagggggccccgatggccgcctaaccctttgcgaacgcatgccccccgggtgcattgcccttaggataccgcttttgaggggccactctaagaccgattttgggcaacctatagcgccggtggctcttttccgcggcgccctttctagggctagacccgggggccccggcgcttttccgacctttcaggcccaggggcggttacgccggggggcgtcttggcctccttgggggttccagtgtatcgggcccctgtatgcgacatagattttgcggcccgcgtcgcccatagaccgggcgccaagtagaggcgccccgggaacaatttcaatttacgtgcgtgagactcgtcccccgcga

SEQ ID NO: 548479 - DNA, 92 bp, Homo sapiens
aaatgaaggtgtattcattatgggcaaaaccattgaatttcacatgggtggtaatatggagttaaaggcggaaaacagtatcatcctaaatg

SEQ ID NO: 548480 - DNA, 395 bp, Homo sapiens
gattatgtgtaacatgctagctacttaaattacttataaaaaacatttattttgagatggagtatagtctgttgcccacgctggagtagagggcatgatcttggctcatcacaacctccgcctcccaggcacaagcgattctcctgcctcagtctcctgagtagctagactacaggcacatgccaccatgcccagccaactcttgtatctttagtagagacggggtttcactgtgttggccaggctggtcttgaacccccgacctcgtgatccacccacatcagcctcccaaagtgctggcattacaggtgtgagccaccatgcctggcccttttttttttttttctgaaatgaagtctcgctttgcccccctttttgaaaaagctttgggggcg

SEQ ID NO: 548481 - DNA, 111 bp, Homo sapiens
gtgtggtgttctagaggatccctgtgtggattttccccgttactggtgggcagtgatacaggaatgttgggcaccatggacacaggtctggccagctggatcgagagaagg

SEQ ID NO: 548482 - DNA, 444 bp, Homo sapiens
  misc_feature (404)..(404): n is a, c, g, or t
  misc_feature (416)..(416): n is a, c, g, or t
  misc_feature (439)..(439): n is a, c, g, or t
tttttttttgagacagagtcttgctttctgtcacccagcctggagtgcagtggcccaacctcagctaactgcaacttctgtctccagggctcaagcaatccacccacctcagcttcccaagtagctgggactacaggcccatgccaccatgcccagctaatttttaaatttttaaaattttgtagagacgagatctcactatattgcccgggtggtctcaaactcttggactcgagtgatccacccacctcagcctccccaagtgctagggattgctagtgtgagccaccctgcccagccaactatagttttctaaaaccaacaaattctacttattttccagcctaaggaaaggttattggggctgttgtgaatttccatcatatctgggtgttcttttgggnagtaggataggnggtaaatataggtttaaaaaatntgtag

SEQ ID NO: 548483 - DNA, 890 bp, Homo sapiens
  misc_feature (27)..(27): n is a, c, g, or t
  misc_feature (145)..(145): n is a, c, g, or t
  misc_feature (161)..(161): n is a, c, g, or t
  misc_feature (163)..(163): n is a, c, g, or t
  misc_feature (175)..(175): n is a, c, g, or t
  misc_feature (177)..(177): n is a, c, g, or t
  misc_feature (201)..(201): n is a, c, g, or t
  misc_feature (207)..(207): n is a, c, g, or t
  misc_feature (213)..(213): n is a, c, g, or t
  misc_feature (241)..(241): n is a, c, g, or t
  misc_feature (285)..(285): n is a, c, g, or t
  misc_feature (294)..(294): n is a, c, g, or t
  misc_feature (324)..(324): n is a, c, g, or t
  misc_feature (335)..(335): n is a, c, g, or t
  misc_feature (365)..(365): n is a, c, g, or t
  misc_feature (385)..(385): n is a, c, g, or t
  misc_feature (392)..(392): n is a, c, g, or t
  misc_feature (394)..(394): n is a, c, g, or t
  misc_feature (398)..(398): n is a, c, g, or t
  misc_feature (408)..(408): n is a, c, g, or t
  misc_feature (457)..(457): n is a, c, g, or t
  misc_feature (464)..(464): n is a, c, g, or t
  misc_feature (466)..(466): n is a, c, g, or t
  misc_feature (471)..(471): n is a, c, g, or t
  misc_feature (499)..(499): n is a, c, g, or t
  misc_feature (503)..(504): n is a, c, g, or t
  misc_feature (506)..(506): n is a, c, g, or t
  misc_feature (527)..(527): n is a, c, g, or t
  misc_feature (551)..(551): n is a, c, g, or t
  misc_feature (573)..(573): n is a, c, g, or t
  misc_feature (668)..(668): n is a, c, g, or t
  misc_feature (686)..(686): n is a, c, g, or t
  misc_feature (703)..(703): n is a, c, g, or t
  misc_feature (739)..(739): n is a, c, g, or t
  misc_feature (774)..(774): n is a, c, g, or t
  misc_feature (789)..(789): n is a, c, g, or t
  misc_feature (854)..(854): n is a, c, g, or t
gtgtgtcaaaaaaaaaataagggaggnctttggttaatcccctccccccaacaagatgacaaaaggaggaatgcatgtaaacaaaataacaaaaaagaccatggagggcctgaatatacagcctccctggagggacaaggaaagnggagcaagcactactntnggctaggcccancnccccccaagcaaaaacacataacncccctncccctncccccacccccacccccactgctaaggnagtaagccaggacttccccaaagaactagctctgaagcccagancctcatggntccctctagaaggggttgcattcttcagcntgcatgaagtngtaaataaagaagaggacgatcacaaagancaggaaaagcagcagctggncccagancngganctggcgatcnttgcccagcccagccccaggagcacggtttttaggccggatggtacggngggtgancnatgangaggaagatgatgaggaggacataaaanatgnngnggcggaagtaggataataggncatgtccagggagctcctggaggntgaaacagggcggtagtccgtnacgctctggtaggcactgtcccggccgtacatggggcgttccctatccttgcactcctcttcagaagaagacaaaagagcgtcatcatgcacctngtgatggaaagcgtcacnttcctgggaatgaagtnacttactggcggacagccctggacgggccggcagantcgggctccccataagtcctggtggtgaagtagcnctcttcatagtagtngtcattttagcccttgctctggtagagtaaagcgtcctctttcttgggaagatcatacatatctncatcccctctagtcgaattcaagtcagaaaagctat

SEQ ID NO: 548484 - DNA, 141 bp, Homo sapiens
ttttggggcccccttgggttttttttttgggggggggaagtttaaagtaaaaagtttttaaaaaaggaatttttaaagggaaaaaactggcccaaaaattggtccaaaaattttgagcccccttaaaaaggtttaatgaga

SEQ ID NO: 548485 - DNA, 158 bp, Homo sapiens
gtttcatagacttgttcttagatataaggttcgtgtaaatgactttacattttgtgttgtccttcgtttcgttagagggaaacaaaaagtccggtaagtggacggaggacagtcatcaccggacataatctctagtctctcaccaacacgagtccgac

SEQ ID NO: 548486 - DNA, 212 bp, Homo sapiens
accgctctcgtgaactccgtgaactacttaatgtttgtattgcataatcaattactgatactagtaatactgtccaccaagtattattatgtttgaacctgctgacagtaaaatacttatagcttctgcagctaacatttattaacatctactatgtcctatttactgtgctagaagcttaacagggattatattatataaccagtctcacg

SEQ ID NO: 548487 - DNA, 265 bp, Homo sapiens
aggggataagctgaaagggcttagcagctcatggaggcctgatttgtcctactctggagcacgcatcgggcggtgaaactgagtgactgtagtactatctgtgcctatgatggtaataaaacttacaagatgtctaatttttttttaagtaggaccaaaggaaaacaagatttagatagtctgacttagcttttgaacaacagacattgcaagtcaaaattgttgtcaaaagcaaagtcagactatctaaatcttgttttccttt

SEQ ID NO: 548488 - DNA, 1125 bp, Homo sapiens
  misc_feature (1125)..(1125): n is a, c, g, or t
aactaacagctatgtacgaggctgggatgttgctcgcactctgaacattccgccgactccgacgatcgcgtatctctgccggtcgcaatggaagaagagatcgccgcgctggtcattgacaatggctccggcatgtgcaaagctggttattgctgtgggactgactgcatcccctgatgcctgtgatttcctatccagtctgtacgtgtgctgccccatgaccaccatgtggctgtcagtgtgtgtggcatggtgccatgaatgtgactccatactgtgtgtgctgactgatgtgcccatgatgcaatgcgtggcatcctgaccctgaatgtaccccatttgagcatggcatctgtcaccaactgggactgacatggacgaagatcttggcaccacaccttctacaacgagctgcgcgtggccccggaggagcacccagtgctgctgaccgaggcccccctgaaccccaatggccaacagagagaagatgactacagataatgtatgaagacctatcaacaccaccggccatgtacgtggccatccatggccgtgctgtccctctacgcctctgaggacagcaccactggcatagatacatggactctggagacggggtcacccacacggtgcccatctacgagggctacagccctccccacacgcaatcctgcgtctggacctggctggccgggacctgaccgaactacctcatgaagatcctcactgatgcgaggtacgatgctttcacaaccacggaccgagcgggaacatctgtgcgcgacattcaggagcagctgtgctacgtcgccctgtacttcgagcagtgagatggccacggacgaatcttcctctactctgggaggagacgctaacgaagatgccctgataggcaatggacactcaagcatattgtgccaatgtagaccggtattccgggagtgatccgggaacggaagcctggttcacaaaacatatcaattccctgtgggtatatgtgtaactacgctaggcggcgacatcacagaaagaacacaccattaatgtatccattcactgtatagttgtccagttggacattcctgataacaacttgaaatcacacgacagtggtacgtagtcagn

SEQ ID NO: 548489 - DNA, 219 bp, Homo sapiens
ttttattatctttcgctaatttcactagaattgatgcagtgggaagagacgttaaatgtgtgtatggctcggccattagaaagtagagctacagagccctgtctgcgtgggtgccccctttactctattgcagccatcatggacgtaaaatgtcatcccaaagtgaatcatcagtgtacacctgtctgatcatattatataagaatatctggcctcata

SEQ ID NO: 548490 - DNA, 658 bp, Homo sapiens
taaaggcaacagactcttgattaaagggggttataaaatacatcaaaatcaagtcccgggctgtggggaatacccaagggagacaaaaaagtcctgccagggcagtcttcaaacaagtctgaggggccgggcaggggccataaggaaagcagttacggggacacgaaggcagctcctattcccccaggaggggcaagaggagcaggtgcgggctgtcccgggggtgaccacctcggtgctgtgcaaggctgggaaaggctgggggcgagcagctgaagaatcagctcagcaggcctggcgcctccccgcgtggacaccaggcaggtccaggggcctcggggtaaagccctcagggccaccgggagggggtggcggagggttaaaactaaccatgttgaccgcaaataacaggtctccgtaacagaaaggggtgccgaggagcacagacgccaggggtccagaataacccttcaggggaaacacacacgcaagaccacaatacgagcacaaaagacggctgctcggttgacccccctctaagaaaacctgggggggcacatgtgaggcctctacaggtggggaacgagggccccgtgaaacaccagttctagacatcagccagaagccgaggcccccctggagactcacccgcgagtag

SEQ ID NO: 548491 - DNA, 926 bp, Homo sapiens
ctgtaatcccagcactttgggaggctgaggcgggtggatcacctgaggtcgggagtttgagaccagcctggccaacatggtgaaaccccatcgctactaaaaatataaaaaattagctgggcatggtggcgcacgcctgtagttccagctactcaggaggctgaggcaggagaatcgcttgaacccgggaggtggaggttgcagtgagctgagatcgcaccattgcactccagcctgggcaacaagagcgaaactctgtctcaaaaaaaaaaaaaagagggggggtggataacttgaggtcagggttggaaatcagcctgaccaactgggtgaaaccctatctcttacttaaaaatattagaattagccaggcagtggtagcgcacgcctgtaatcccatcttcctggggaggctgaggcaggagaatcgctagaaccggggaggtgggaggttacagtagccgagatcgcgccacggtttccagccggggcaacaaaagcgaaactctgtctcaaaaaacgaaaaacaaagaaaaaaaagcgcgtgaccttatgaggctctccggtatggttacttagggacctataaagagtttgatttaaacattatgcagggcccctagtgtgggatttttcaaaaagcaaacggtgggtggtatccctcagtgttggttgtgcaccagcccagcctcaacagcacctatgtgtaaacccgtgctctttctgtctcgctagaacagactttggtggccccttaccggggtggtacccggggacgcgcgtggttaaacgggtgaaccacaagaagccttgatgacaagaggggtttttccacgctatgggcgaccattgccaaatgacccggggctcccggaaatattctcagggcgattccactaaaaaacacggggtcttgcgggggagac

SEQ ID NO: 548492 - DNA, 135 bp, Homo sapiens
gccgcgctacttctgctctgcgtcgaccttctgctcttctgtgaggcagtggttctcaaacttttggtcgcatcagaattaaccaagggagggtattaaaatgcgaccaaaagtttgagaaccactgcctcacag

SEQ ID NO: 548493 - DNA, 145 bp, Homo sapiens
  misc_feature (27)..(27): n is a, c, g, or t
  misc_feature (41)..(42): n is a, c, g, or t
  misc_feature (45)..(45): n is a, c, g, or t
  misc_feature (64)..(64): n is a, c, g, or t
  misc_feature (91)..(91): n is a, c, g, or t
ccacgcagcacacgaggacggataacntagagatcttcaannaangcccaagtctcttggtttnctcaaaggatgactcttcagaagcttngagggaaatgactctcatttccgtggctgaggagccatggccccgggccgaatg

SEQ ID NO: 548494 - DNA, 417 bp, Homo sapiens
  misc_feature (396)..(396): n is a, c, g, or t
aaatcgagctcgtacccctcacggattactcaatgtccctttgtcattgtcgccgtgacttgaaaattaccgaaggttcaactgtcagcgtcaactatgtttcaggttcaagtggtgaccgcattgagaaaatgttcctttcaaaacgtagtctcaaggcaggcagccgtgtcttgattgtggatgacttcttgaaaggcggaggaactgtcaacgggatgattagtctcttgcgggagttcgattcagaactggcaggtgttgcagtctttgcggacaatgcccaagaagaacgtgaaaagcagtttgactacaagtcactcttgaaggtcaccaatattgatgtcaagaatcaaaccatcgatgttgaggttggaaatatctttgacgaagatnaataagagatagaactaaagg

SEQ ID NO: 548495 - DNA, 882 bp, Homo sapiens
gcgcaacaatagtcgggctggacctattgtacaggaacctggtcaccgtggccaagggtagctaaaaggtgtacaccaggtgtattcccgactcctgtttcgggccctctccaccgcggtgcccaataacgtgcctaacaccacccaaaggggtcccctgcaacacccgagggtgcccccgcttacaaacagcgcggacgaacgctttcttaaacacccgcccccgcttggagcatattcgcccctgataatattggcccgcctctcctcctccggcaccattccaccagagacccagcttgtgtttaatccacaaaaaccacgggcgtcgttctcaagaatccgcccctagcgaactcccccagagagtgggggcgcaaattatacgcgcccgtgacatttcccacgccagttcatgtatggtgctctcccccccccagtgatgggaaagtatatccccctctggtacaaacatggcattagaaaaagatgtgttatccatctctgcgcgataacggtacaagagacccttctcctcctggtacatttgcgggatatgcagttcagattataagtcagccgtggcatgatctggtgtctaaaggagtggctttacggcagggaacccccttagcgagcccccatggaaaagtatagggtgtggcccaaccgcagaggaatgtaattaagtcgcagtcattgtccgcctctgaacagtgagtattctcaaaccatgccgctcaaccctcgagtcccgacgccgaccagtgggtgaagaaccacacgcacaacgggacccgcactttaaattttgttaaaaccctgattttttagaatccgtccacccaaaaagcgttgtaaaccccccaaaaaaaacaaaca

SEQ ID NO: 548496 - DNA, 168 bp, Homo sapiens
gatggtacgtacatatctttcaaaccctttctacaccacaaaacactttccttcctttgtcacaatgagtgcacagtgaagtagaatgttagttctcgcagctaacaatatgttttgtcagctgaaaacattctacctcatcctttttcttttttttccgttttgggg

SEQ ID NO: 548497 - DNA, 110 bp, Homo sapiens
attaaaatcccagattgcgtggacccagaagatgtggatgttgttgatcctgatgaaaggtccataatgacctatgtggacacagttttctgcaagaattccaaagatgc

SEQ ID NO: 548498 - DNA, 152 bp, Homo sapiens
  misc_feature (127)..(127): n is a, c, g, or t
  misc_feature (143)..(143): n is a, c, g, or t
tagcaaatgtggattacaagcaaatacaacaagtcgtgcccctccaacccaccacaaacttctaaacgccactcagcagatgcataggattcgttacacgcaacgattgaaataaaaataaaagctncaaatgcaatacccanactagccta

SEQ ID NO: 548499 - DNA, 206 bp, Homo sapiens
taccggtgtaatcgatgccacccgggcatggtggtcactcctgtaatcccagcattttgggagactaaggcaggcagattgcatgagctcaggagttcaagaccagcctgggcgaggtgtgcagatcctggctgtacaaaaaataaaaaattagcccggcgaggagtgcacacctgtagtcccagttactcagaaggctcaggtag

SEQ ID NO: 548500 - DNA, 233 bp, Homo sapiens
  misc_feature (3)..(3): n is a, c, g, or t
  misc_feature (26)..(26): n is a, c, g, or t
  misc_feature (44)..(44): n is a, c, g, or t
  misc_feature (80)..(80): n is a, c, g, or t
ggnggctgaggcaggcagatcatttnaagtaattcaagaccagnctggccaacatgatgaaaccccaagaccactaaaantacaaaaattagccgggcgtggtggcacatgcctgtaaccccagctcctcaggaggctaaagcaggaaaattgcttgaacccaggaaacagaggttgcagtgagccgagattgtgctactccactccagcctgggagagactccatctgaaac

SEQ ID NO: 548501 - DNA, 300 bp, Homo sapiens
  misc_feature (101)..(101): n is a, c, g, or t
  misc_feature (147)..(147): n is a, c, g, or t
  misc_feature (241)..(241): n is a, c, g, or t
  misc_feature (250)..(250): n is a, c, g, or t
gattagaggatcccctattttacgcaggcatatgggcacaaagctattgaactatggactgccactgatgtcagctatacccaggctcagaccactgcaanctatgggcaagacgctatgcaacttcttatggacagctcccactgnttatactactccaactggcccccaggcatacagccagcctgtccaggggtatggcactggtgcttaatgataccaccactgctacagtcaccancaaccaggnctcctattcagctcagtctggcttattggactcaagcctgcgaaaaagtg

SEQ ID NO: 548502 - DNA, 174 bp, Homo sapiens
  misc_feature (142)..(142): n is a, c, g, or t
tactgcgataggtgcgagagagcgaggccccaagatcagctgtccggccccgacgtcaccgccgtttgtcaattagagcgtcgcgatgggccagatcactcgactgagagtactgtagcgcccgcttccaggaggttcgagnggaggccgagtgcccagagccagaggttagtt

SEQ ID NO: 548503 - DNA, 361 bp, Homo sapiens
  misc_feature (9)..(9): n is a, c, g, or t
  misc_feature (105)..(105): n is a, c, g, or t
  misc_feature (131)..(131): n is a, c, g, or t
  misc_feature (137)..(137): n is a, c, g, or t
  misc_feature (158)..(158): n is a, c, g, or t
  misc_feature (351)..(351): n is a, c, g, or t
tcgggtaancgggtacctacctttattaaatgattttcctgttacacctgtatagtagtccctatggcaccccccacccccatgccctttcgtgcccactcccgnctcccaccgcgccccccagtgtgtantaaagnggcatttcgcccagcttgtancgtagcttgcccactcagtgaaaataataacattattatgagaaagtggacttaaccgaaatggaaccaactgacattctatcgtgttgtacatagaatgatgaagggttccactgttgttgtatgtcttaaatttatttaaaactttttttaatccagatgtagactatattctaaaaaataaaaaagcaanattgtcaact

SEQ ID NO: 548504 - DNA, 116 bp, Homo sapiens
cacgaggtcatgttcgagatgatgcagtgcatcgggcggctccaggatcccacccccagttcaggtgaccctgtagagcatgacccagcgtcgacacacatatccacacgccctgt

SEQ ID NO: 548505 - DNA, 221 bp, Homo sapiens
gtggctgacctgaggatccagcagcggacaggtcgccccaagaccagccatctcacacacaggacaggcaaagctctaggatcttcaaggcccaggagccacccttcctcctccccagaaagcctctcctctcctaggtgcacagctgtgaaggtgggacctggaaggtggaggggccggtgctctgttagttcattcttgcactgctataaagacatacc

SEQ ID NO: 548506 - DNA, 240 bp, Homo sapiens
cagctttgtacacccggcactctttaagggtacatgaaagataggccctataacttacccaagctgatgtctgaagtacccgtttggggggtgactcggaattaggaattgccgtcagataacacttggggcatcattctcactcaccctttgcacttggagtttttgttttactagtttccttaacctgtcacagctcccttaacttacgacatgtacttgcctagaaggacaggctgc

SEQ ID NO: 548507 - DNA, 697 bp, Homo sapiens
  misc_feature (16)..(16): n is a, c, g, or t
atttccaaagattccntgcaggacatcaagcagaaagtacaagataaatacagatactgtgagagcagacggagagtcctgctgcagcatgtacacgaaggctatgacaaagacctgtgggagtacatcgaggattgagattgatctccgcaccacagactctcggagagaagctccagccactagagcactgatgcaatgaccagagcagccctgaccagctgcctcctgcctggccaagccgccctgcgttgcatcacttcccctgaacagcagaaattatatttaaattagaatattacaaaataaaatattacatgctcaccagtattgtcagcagcgcaagactgagaaatccaacaaaaaggcaaaaatctcttccttttgcttgcatcgtaagatcttccccctcctcggaaacaaacgttttcctcctcctcagttacgtttgtggacgtgttctgtttgaatttattttaaatacacttttttttttggtttgttttgtgtgtgtgtgcgcgcgcgtgtgtgtgtgtggaaaatggactttggttttttttctcaaaaatggctttaataattttgaccatgtctggcaagctctgtgttgtttgggttgctgaatgttgattggttgattgttaagaaggcttctttttggcttcgtgaagaaaaaaaaagaaaaccccaaaaaaaa

SEQ ID NO: 548508 - DNA, 251 bp, Homo sapiens
gtgataatcacaagatggctgccctggaggccaaaatctgtcatcaaattgagtattattttggcgacttcaatttgccacgggacaagtttctcaaggcacagataacactggatgaaggctgggtacctttggagataatcataaaattcaacaggttgaccgtctcacaacagactttcatgtcattgtggagcatttagcaaatccaggcagaactcatggcaatcagtcagatcaactcaaatcag

SEQ ID NO: 548509 - DNA, 439 bp, Homo sapiens
gaggatccccgctgacgactcctatctttaggctgtattgggtattcacatccaatggtgagtgcaattaccccgatcattacagctcgaccgactggagtgagctagcgactcggtttccaaaaggatggcgagatcatgactactaccaatggctgcaccgttcacatatctcgaaggttttcgaaccggatgatccctacagcgactatgtcgagtacgaggacgaagaagctgggtgcctggaacagcggctttcgggattgcttgctcgcctgcagaccaaaagcgggcaaacagttgaggaattcaggcactggatgtttagtgcagtttgggtagacgtccctgcgctacgcattgttgagagctgattggcgggtgttaatgatcattatgaaaaagggcgccatgggcgcccttattcattacgctctca

SEQ ID NO: 548510 - DNA, 209 bp, Homo sapiens
attcactggttgatatgaagaatttggtgccaccttttgtcttcctaaagcagtatctattgattaacagttctaggtttacaggccagtgcataatacacactgtgggcctatacgacaggggagtgtagaatgagacatcaggtaagaataagtcgtaatggatgctcgggcctaaatactgtaggatgatgtggtatgatctagtg

SEQ ID NO: 548511 - DNA, 246 bp, Homo sapiens
atttttttccagggttcttttttccttctggggttccttttggaaaggttttaatgccaagccgtggttccaatttgtccttttatttttggcagcaccccgtttgggatttaactaattcagggaaattttcaatttccggccttttaaaaaacccttaaaactaaggtcaaattgagtctttaaaaaaacggttatgctttcctttccttttttggacaaataaaaaatagttttaatagccga

SEQ ID NO: 548512 - DNA, 532 bp, Homo sapiens
  misc_feature (61)..(61): n is a, c, g, or t
  misc_feature (111)..(111): n is a, c, g, or t
  misc_feature (462)..(462): n is a, c, g, or t
  misc_feature (528)..(528): n is a, c, g, or t
gtaaaaagtaacccccctaagtagcctttgccaaatttccccagccctgattccccccacntccattaaagttgatttaagccagaccatgtaaagtccagaagtttccancatatcccccctgtatccaaaaccattttaatagggaaacccctagtaaaatttatgaatgccctccattttgggcctttccccagacctatttgagttattccaagatagcccataatgttttaagtagcgacattcttttattaccttcctaattgcccttgtaaaatgcattgttatggcccggcacggtgggtggatcacaaggtcaggagttcaagaacagcctggccaagatggtgaaatgctgtctctactgaaaatacaaaaattagccaggtgtggtggcaggtgcctgtaatcccagctactcgggaggctgaggcagagaattgcttgaacccggccggnggaggttgcagtgagctgagatcgcaccactgcactccaccctgggcgacagagtgagactataanaaaa

SEQ ID NO: 548513 - DNA, 698 bp, Homo sapiens
gaactcccagttgccccagttccacttcaccaacagagactgcgactcgctcaaggggctctgccgcatcatgggcaacggcttcgcgggctgcatgctgttcccaccgacatctccccctgtgaggtgcagcgtgctcatgccccctgtactcgtccaagaagaagatcttcattgggcctcatcccctaagaccagagcggcttcgtcaagttgccatcccggagggtcatcaccaacccgaaagcaaggcagtgggacctggtgggtgtcaacttcatggccccaggtccagatcgtcaacaaaacaaagttttcttgggacaatggacgtggtggtcatgggagttgggaatggaggccccaaggcctttgagccccaagcaggtcagggtccaaaggcaggttgcgatgccattcccaagcgttctcactgttgaacacccaaggggggacggatccttggaggaaccgaaggccagatgggcccaatgggaaacgccttcggtcacatttgccaggattccagttccccgggaaagaaagggtttgttaggacacaaacctattagttgccctgattgtcaccgggaactccggggccttgtgtgtccgaggtttccaactttcagcaatggcgacctggtgagaacacctggaaggaggccttgttgccgggatccaatggaacaaactgg

SEQ ID NO: 548514 - DNA, 842 bp, Homo sapiens
gcggcgcgagaccctgcccttatatctttaatgtgacggaatgtattgagataacagtgggcgattgatgtgaaagtagccactggaattaatgagtaactatggagcatttcttgatactctaccgttttctttgaatgattctatttttgattgaaaatcatgacaatcaaataataacccagcaacaaaccgtaactgtgcgcccttccataaaggaactcctggtgatgccgtagatgaatccaagatgctcaataaaccgccaatcccatcgcatgcttgatgactgacctgtatgcactctgtgtgcagtaatcctcacagctggatcctgatggagtattgagtcgaaggacttgctggtgctgaatcgttcatcgtaaacatcattttggtagttgctactgcgagggacaacgacctagcacgacgtgccatacacgattgatgctggatgataactcctgcgggctggtcgtttaattatgtggccaccagtagctggggaccactggtccgaaaggtttcatcaagggacatgcacgccgatgaatacatacaacacaacccaaaaaagaatccacgctaagaaaagtcctgaatcccagtaagcccagtcccgataaacgaggcatgcgcccaggtcctggaggaatcgaccatacgccagggcaatctgcccacagccaaggctgcgaaccggtgcacacacagggagccaggcaccagcagccaggctaccagagcaagcaaccccagaccgccaggacatttcccccaacgagcactgggtccccatggaccgttacaacccatcagcgccgactacatggggcgtc

SEQ ID NO: 548515 - DNA, 339 bp, Homo sapiens
  misc_feature (204)..(204): n is a, c, g, or t
  misc_feature (209)..(209): n is a, c, g, or t
  misc_feature (223)..(225): n is a, c, g, or t
  misc_feature (228)..(228): n is a, c, g, or t
  misc_feature (231)..(233): n is a, c, g, or t
caacgatggtcctcagctgagtccagggagcagaggcctctctcgttccccggctcaacctccggccgttggcgttgggcagatacaggcatcagcttctctagctctgcaggacttatgcttctgtctagattcctcggctttttaggcacagtttgcttgctttaagaaagcgttcttgttctctagcttcctgtgctctcnagggncctcagcctttctnnnggnctnnnttttcctcctgcctctgacatcggtatcctcctcagcactcatggcactgtctaggggcttctcaaagccatgagagctgaggaccatcgttggggtaccgagctc

SEQ ID NO: 548516 - DNA, 286 bp, Homo sapiens
gtgggaggtgattggctcatgggggcagacttcccctttgctcttctcataatagtgagtgagttctcacaagatctgggtatctgataagtgtatagctcttccccactctctctctctgtctcctgttctgccatggtaagacatgctttcttccctgcgccttctgacgtgattataagttcctgaggtctcccagccatgcttcctgtaaagcgtgtggactcttgaggcaattaaactacttttcttcataaattactcagtctcaggagtcttagagcgt

SEQ ID NO: 548517 - DNA, 709 bp, Homo sapiens
tggtatccgagttaactctaaaaccaacacacagaggtgctaggaaaagacaattagaaactatttgtcttattaactggtgactaatattaacagaacttgagccaagagtaaagaattcagaaggcctgtcaggtgaagtcttcagcctccgcacagcgcagggtcccaggctatcgtccacgcgcgcccgtgggtaggtgggtccaggctcggaagaggcctcccgacggaacagccagtctctctcagaaacatccgcttccaaggtagggagcctttgtgctgcgtttctcatccttaaacttagatcaacattttgtgggttttctacgtcagtgtatcttgggcatacgcttacgacctggtcccctcatcctctatctgtcaaccccccggcgccccgaagactgtctcgtagtgaagtgttcgtgctgctcctcctggggaggtggagcggccgcgggtcccgtcccccggcgagcatctgctcggttcatgcttccttggtgtcccaggtgtggggccccgtggagggcgcccgtcagctgagtaagcacaccggcatgaacgtcaggtccattcctcgaaggtcggagccctcactctgccctgtcctgggagctggctagagggcgaacgcaccgaactcactttctagagccctgtctgttctagctcctatctgaccttgtgtgttaatacgtac

SEQ ID NO: 548518 - DNA, 486 bp, Homo sapiens
cttcgcagcttcctggagctatacaccaccatgcatgtggactggctggctggcttcctgtacctcacagagcagcagtgccgtatccagcttcttgtcttcgaacacaaaatgaacagcctagtatggaccagcggtatgtcagccctggatggtgaatttcagtcagcctcataggttgacttctacattgataaggacatgatccacatcgcgtacaccaaggtcgccaggcgttatggggatttcttcatccgtcagatcctcatatttgaggcgtttacttgcaccgctgaagaagatgggacagagaccttgatgatattcacacacattcaggaacctgttttgatgcattatcaggcaggaagtgtttttgcccgcgtgaaacctttacgtagatcagccatcagcctgtcccctcagttgacaagttaagggccggagtgtttcaagtggatctcagtaaaggatttttggagccag

SEQ ID NO: 548519 - DNA, 217 bp, Homo sapiens
gcttccttacaggccacggcttcccctggctttcctggcactgggcagtactctttgttagtcctggccctggcaggcgtggcctagaggccttctatgaagtagcagagccagacacacgagagtggtacttgtctagctcccccacatcacctacgacctcctatctctagtgcacgagcctcttggatatagcgcggattcccgagaagcactc

SEQ ID NO: 548520 - DNA, 1079 bp, Homo sapiens
  misc_feature (422)..(422): n is a, c, g, or t
  misc_feature (652)..(652): n is a, c, g, or t
agcggcgccattacactccagcctcggcaacaagagtgaaactccatctccaaaaaaaaaaaaaaaaaaaaagttttggcttcactttcacatgtggttagcttgctcaagaatgaaattgaaattagttacattattaaaatgttgttttggacacaggtgccttgaacacattagttaaagaattaaaagtgtagctatttttaacccattcattgtgtcattatctctcatccattatacgggggaacattattgaaacaagggaaaccaaactcattattcttctagccttaagaccttcttccccttaacttggcagactttgaattacgccaggtaggctctcctgttgacattttcccattttggtttggtcacaattaggacctctcaaattttgggcaattcccaggaaacanaaccctttggcggtcacccaaaaaccaagctctcctttcttggtagtcttctcccaaccttttggttaattacgcaactttcatttctctccaataagtccagggtcaaaacacttttgggagacaccctttgaattccttcccttttcccttcataaccgtatatttttaattccattgggcaaatttggagaacggcgtccccattttcaaaacactatccatttccncaaattatttcatttctcatctatttccaaaactaacttctctgaagtaaggcatggtgaactcatgcctgtaaaccctaagcactttaggaggccgtggcaggaggttccccttgatgccccggattttgagaccaaacttacctctccggtccagcaccatcatatttggcctaaagtgtgcgcgcctccaaggcgggcttccttgcctcagaaagcccctttttgtcttattttccaccccgcagggcaaagcttaccccttaagggtggaccttaaggggctttacttttgaaaccaatttccagtttaaattcccttacatgttgttaatcttcctttggacaaatattttttttccagaaagaggggttctcgttaacccggctgtggtacaggcgtgactatggccacgaaccatacccg

SEQ ID NO: 548521 - DNA, 275 bp, Homo sapiens
cactctcattcagctccctggcggctgacacgtagatgccgccgttattggcatcgagccgggagaggaggcactttgccttctgcccttttctctcctttgagccaggaagggagtagaccaggccttgacggtgtcaccgcacggctctgaaccccgtgggaaggccacatttcagacgcccctccccagccagtacccaccgtggcacctgactcccttagccctttatgctgggctggagctgtgctgtgcagtcccacgtgccgtttgtc

SEQ ID NO: 548522 - DNA, 161 bp, Homo sapiens
gtccctaaaattttaaccccaacttaaaaaatgtgtttcaaacaaaagctgggctagggttcctccagcctttttaaatttggggatgatttgaaaaaatgaaaaaatttttcccaaagggtttttttaaattattaaaaaaaaatggatataatttgtta

SEQ ID NO: 548523 - DNA, 817 bp, Homo sapiens
tggaatctgaagtctggtgtttactaatggaaaaaaaaattacagaagaggtttggttctctgggtggcccaccgcagccgggcattaaaacagcccagggctcatttctgttgggaaaaatattcttggctctttgggacatcagggctaggatgggtatcactggccagggtttccagccagctggggcacacttccccatggtttggtcagtgaactgggaagggcctgaactagtctcaaagtctcatccacagagcgggccaacaggggagggtcattcacaggtggatctggccgaaagaatacccttatcatcaatgataaaaagggcccctgaacagagatgccttcatcagcctttaagaccccataatcctgagcaagggtggcgcttggggtctggataccaagggactggtccatggggtcccagtcctcctggtttcttaggtgtatggacccatgctagatgacagacgtgagaatccacagaagcaccaatcattgggcagtggagtctctaaattcttttggcctatcactggaaagcaaggatctccggggggcaccacaagggtgacgtcaagcaggttaaaaggaagaacacaacttatgtccttggtagtcaagaaaggcgggatactcttcaactgccatgtgcataacaggtgtggttcgaatctggggacggtgccaatttaagcatttcctggaaaatttctatagctgtgccaggtttattcccgggcgggtggttatgaacctccactcggggtcaggccacgcacagggtcaatgaagttccatttcagg

SEQ ID NO: 548524 - DNA, 881 bp, Homo sapiens
agcggaaggacaaagtggagagggaggagatggagcaagtctcttatgtagatcattccgatctaagctcagcaaatgtgtcagctaacacctggttcaactgtaatgtgctcagctccgtagtaaccgtggacagcgagcatgtgccctctacgccctaaatctcagtcaaaatattatggtcctcataaatcaatgagaactttatgctcctgtctactgcatgtctagagggttcatcgtctagaccaggtgagttgataccaaacttcaccaaacggttctccggagcaagccgtttagaggaatcattaagccaagtggcgaacgaggaatcctaaggatccacatgtgattgtccctcgcggttcaactcatgctgtgctgttgctcgaagccgagggaaacctcgacgcgaacatgtagaatatatgaagctgtctggccaaaatcctggttcactcgtattgagacacgaagcagaactatcgaggagagcaggcagcgtgcttgtcgcgtgatgacgtattgatacagtcgcagccgacgttctgttgatgacatgaccgttagtgcgttctagccgatgtggctgaatcgagttgggaggaccgtgacgtccgagccagtctattgggtggccagaaaccgaggcctggtcagacgtctgatggcattgatggacagaccacgaggtactatcgaccgaaagacggaaactctgatttaccaagctcaatggggtggccagaactctcgggaattcgtgggattcgcatcgatgcctccaactggcaggaggagacaggatggggtgtgcagaatggccatgtgccctatattcttcctcatctgtgcgcaccagaatcgatacgatcgga

SEQ ID NO: 548525 - DNA, 138 bp, Homo sapiens
ctctctctctctctctctctctctctctctctctctctctctctctctctcctcattcttggcaggatggcttctcatcgtctgctcctcctcctctgccttgctggactggtatttgtgtctgaggctggccctacc

SEQ ID NO: 548526 - DNA, 1466 bp, Homo sapiens
agcgggcgatacgcgcgtggaatgaaggacaacgggaaccaggacaatagcaaatctggcctagcacagtatcagatgcctacttcatttatcatttgtaaacggaccgtaggcgtgaacgttcttggctctggaaagacagggatgggctgggccgcctggaactttctagcgacacactgtgtgaaggatcttgttacttgctagattcacgatcggacagacgggatgaatcatttcgaaagaactatcattgagagccgaccacgtgggtatctctccttgccactagtgaggaatcctcgggacccataagaagagcttggaccccataattcaaagcaaggaaagaagcctgcttacacagaacaccaggcggactcctttaagagacctcataaacgaagactcattgtacgtgtcaagttgcttgtaagaggagttacttcttgcacattgacctttctccagcaagaatagaggatacgacgttgtctttgctcacgtgagaacatccagtaagctttacaaaggaataatcatcctagttcgataagcgaacgtgttgtcctgtggcatgaattgtgcctcagtgcgagttacatgtacacggtacctggccgtatccctaattcttgcttttccgtatgcggagccttggatggcagaaatgccacgctagatttccaagtgtcatagccagaaaaacgatacgtggctcacacttatctccaaaagaagcttcgcaaagaccttgtcacttctttgaggataggacagctggggcgcttcaaattgggaggcccatgagtaggtttgacctgttgttcccccctaggtttacaccccgtattccttggtggtaactcaccgttgggggcaatgacaaaagggccagccttgaaagccgctggccgcaattgccaatggttgttccttattgcccgttggttttttggccttcctccgagccctgttcgttttaaacttttggcgtatccccaatgtgggttttccgcatatgtaacattattcccttccgggttaatggggaaaacctctttatgtacaagaccaaagagagtttttggccccaaataaagtctcattgtagacgttgcgcgcgtagtttttggtgttaatttttccccctagatgaggaaacccgtatattttaatatcctataagaacctcacactggtggaaatggtgggagtcctatcatccacacgcaaagaaacaacagtggtcacgcacttccactaggaaaacaatgatagaaagccctttctcagcgcctttacctccgcacattaaagcagccgggaacaataatcgaggaggggaggcgacgctaccccgcgttttttttaccctcttgaaggagtgagaagatctccagaggtagcataaaaagtgatcttcacagcacaccggtggaaaattataatacccccaggccaac

SEQ ID NO: 548527 - DNA, 106 bp, Homo sapiens
catagtccaaacactgcccaaagaccaaacattgcccaaattccatacagtgcccataatacaaacagggcctagcgagactttggtttattgcaaatgttttgcc

SEQ ID NO: 548528 - DNA, 893 bp, Homo sapiens
ctgcgtctatagggtcattgtaagctctggggaaaaaggagaaagtgagaggagagtgctctgtgatcctccctccttggttgtctactcgcagttgccttttaaaccacaaattctgaaccagccgtaatccgcccaggtgaggcgggacgttatggtagagtatgtctagtaacgaaagggggggaaacagaaggtcgtgatactgctctcctcgcgcttttaaagcgccgcggtcggcaaaattggtccaattcccttgggtcgtaccttggactttccgaggggcactcgttgccacgccgtttccaaaaaagggccatttcccctgtttcgcgacttgtgggggaacttcgggaaaggagaaggcgcggacttatcaactcggtatatgagacggggcgcggggccttttatttaaacacacgcgaaaagtaaatatctgtgtccgaagcaaaagatttacccattctaactgccatgaacggacaccgtctagttgcgaaacttgcgcacaattgacaattggttgtagcgtcgctattgtggatccgcttcctccccgtgtggaacgcaccattcccaccacaggtagacgttaggatccaccgcactctaacaaacacatcactagtaggaaccctttcactcgaggttagggacccccatagtgaaatagtgggtacggccccattgcatgttaggggactcaggttccaacgttgttcacgttgtggggcggccaatcaataaacagggccacattagggacgggataaaccctccctagaagaaacatggggggacactataaaaaacatacccacaattataagtattcagatcccacctttgtgacaaaacaccaaccactggccacacacaaattatta

SEQ ID NO: 548529 - DNA, 114 bp, Homo sapiens
agaccacgttctgcggaaggagcagaccctcgtccagccatggatggagttgaatactcggataaacggttcacagcgaaagcacgcaatacattccatggttggcctagagag

SEQ ID NO: 548530 - DNA, 911 bp, Homo sapiens
  misc_feature (57)..(57): n is a, c, g, or t
attacaggcgttgttatataacagcgactgggcaaccgccaatggatcttcctcgangataacaattcggggccctccccaggtgtgcggaccaactgtgcctgagccacgttagggggtgttctcccacccccggggggccccgcgcataattgttacgccacacggtgcgctgagcgtgaaaacgcgcaccgtttccaaccagcagttggccagctgggcccacatgtgttctccgggccaccatgcggatgagcctactcagtctgctccgcgtttacagtgtgtgccgacccggctcacactcccttggcaggaaagacccgtctgccgcgtttaaaaccagcgatcgtgtcgtctagccccctcgtctggcactcatttttgcggcggactccttcaaaggcgcactgtaacgaacaagaaccattcttttgagggggcccgtccctccgcccacgccgcatgtggacgcccgtcttcggcccccggctggggagtaaccactcgcgcccgcatgcgccagctactcttccatttgttcttggctgcacccaccgcgccattgttattggtgttctccgaatgaggaccggcgccctgggacggcaacaacaccaccagcgcgtgcagtgcagatacaatgccccgcggggactcgactgtcgccaagaatccccgcggggggccccttcgcggagggaggaacagacaacactgattgtaagcaataaacaggcaaaaaccccggtggcagatgaccgccccccggatgtaaagatgatctgggccacgcgccaggaatgacccccgggggggtagccagcgaagattcacgcccgtggggagatagacaccacacgtggttaaaacagggcgaaaaaacaaacaatgggggcccccccacaaac

SEQ ID NO: 548531 - DNA, 484 bp, Homo sapiens
  misc_feature (1)..(1): n is a, c, g, or t
  misc_feature (286)..(286): n is a, c, g, or t
  misc_feature (344)..(344): n is a, c, g, or t
nggatttcaccatgttggccaggatggtctcagacgatctcttgacctcatgatccaccctcctcggcctcccaaagtgctgagattataggcatgagcaccgcacccggtcccctccctacctttctttctttcctctttcctttttatttattctctgtcacccaggctggagtgcagttgtgcagtcatagcttattgtagccttgaactcctaggctcaagcagtcctcctgcctcagcctctcaagcagctaggactacaggcatgtgcctttgcacccangctaaattgctttaaaaatgttttgtagagatggggtctcactatgttgcctaggctnggagtggagctcctgtactcaagcaatatatccaccttggcctctcaaaagtgctgggattacaggcatgagccaccatgaccagccccaagaaatttagttctcacggctctggaggctggaaagtccagggtcaaggt

SEQ ID NO: 548532 - DNA, 149 bp, Homo sapiens
cccatgcacagttgtatcaagccaagaaaaaccttcattttgttttttgagacagtctcgccctgtgtccaggctggtgtacctcttttaattatttgttatgcagctacttgggaggctgaggcaggagaatggcgtgaacccgggag

SEQ ID NO: 548533 - DNA, 1976 bp, Homo sapiens
tctcccctccccgcctttacaccgatttccccttcgagaggtcgctttccccggggcagggcgcaagagccgggctctcacccccgggaactaaccagaagagcgcacagtcgcacgatagtggagaccacgcgctcagacactaacggcaggagagaataaagcagaaaaaaatccaaggcgaccgcgagcagatgcgcccgcggctgcctgcacctcccacaagcgccgcgcacaccacaccgcatctggcgcagccccacacacagcgcggagcggcaccgccgcggaggacacaccaccgccacaccacggccacgaccacccgcgactacagaaaaacggcgagcgcagcacacgcgagcgccgctgagagaacctcatagcgacgcacgacacacggcgaacaccgcagcacacagagagcccacaggccgcccaaccaaacacggggcacgcacgcccaccagcacaacaccacgacgccgcgagaacgccacggcgaccaacagaacaccccgccacaacgacgcaaccgcgcggctctgcgagacagccccccacccgcctaggacacggaacacaccgcaaccaccacaccacaacctccgccacagcagaagtccgccgcggacagacaacgaacacgccctcagcaacaccagcgccgacccgacgaggcaacacagcacgaggcacagcagagacacgacggcgacgacgccacccccacgaggcggagcagcagaggcgacaggagaacgaaacacacaaccgaacagacgactcaacaacacaaaagacacctggctagcgacataagccaacaacagccccaccaggtgaggacagcgaccgacgaacaacacacacataagagcaggagcaaagcagaggagacacagcggcgcacacgaccgatcgacgacgcggaagaacaagccatgtcagccacgcgacgcggaaagcccacagcgacagcggggcacccagccgaaaccgacgaacgcgagcgcgagcgacccacagtcacaagccagacctcagagacacgcacccaccgacaacgcatcacgacgtgagcgaagccacacagagcggtacgccccgacacaaaggccgcgagagagcgacgcacaaccaaccggagcgcggacaacacaggccgacccgaccgcaacgcaccgccagcccggacacacacaccagctcccagcgaggaggcccgcgccaacaaacagagaggccgaggacaggacccgtacaccgaagaacgcgcggagaggcgatccacgtgagcacaagagcgaagccgcgaccgcggagcacgacgagcaccggcgaagcctcactggacgacagcaagctcactgccgccctcaccacagccggcgcacacaccaaagcgctagaggaccaccccatccccagaacaagccacacagcgaaccgacaacgatcgccgaacgggaaggcaagagtagcggcagcataaacacacgcaagaggaccagacagataacacagcagcgcgagcaacgacaacaccaacatacgagttgagccagcagcatcaagatcgacgacgccccgacccgcataacgtcacgccgaacgcacgacacgcagagcttgacaagaacgcagccgcagagcaaaggaatcgcggagcccgacgctccagttcgacgagcgagctcacaacagcaactgatgaacagccagcgacagacgaccagaactagacgaagcaagacagcactcaacagagacggagcgcaagaccagacctgagaaccactctccgcgtgctaggctcatcagacaaccagcaagacgctgcggcgcacagcggtctcgctcgaccgacaagcccgactgacagagatgaattattctgaccagctctcgacggtatcatcgtcccgcagtgagagatacagcgggagtcacagcagtccgagatcgatgcacgt

SEQ ID NO: 548534 - DNA, 499 bp, Homo sapiens
ccagagattcagtgtggatagggcactggaaggtgtcgaatggctccatggttgatacagtgtggtgatctggttgtcgtacagcgatgaggaaccggacgttgcgcaggcccgtgaagctgtccttgtggatgcagctgatgcggttgttccgtagcattagggtcctcaatgccagtccaaaccccggaatcatgccgctccggatggactccagctggttggcagtcaagtgcaggtcgctcacagagcgctgagcacctcgaatagccccagtcttcaactttctgacacctatattgttgcatcatgacttgattttcttcaaattctgtaagtttattaaacatcccagtggcctccaggatggaactctcattgttattcaatcgcagttctgccgtgctcgggagaacccccccgaggatcttggtgagcttcaggctggagcactccaccacgttggcctcacagcggcacttgtggggacagaccacgt

SEQ ID NO: 548535 - DNA, 760 bp, Homo sapiens
cctggaatctgcccacccccgcatgggtgttggctgccgcctgagccgggccttgctcactgctgtcaccacgtgtcattctttgtgttggttttgggggcctatcttaatatcgtggcgaatagagagagacaagcctgtatagatgtgaaaaatttaacgtgtccagacattactggactggagcagaatggacgcttctatgttgctccgacgtgcgcacagcttgtcctccaaagcggagcgctagcgtgttgaccactgtgatcctgcctcaagaatccggatcaacggatccaccggtgcagagaggactgctgtgtgagatggctacccctcctctctgatcaacgataagccccgggcggacttgtccggtcagctgtcccagaagccatccaagcacaggaggtcaccagctgggtgtgattcaccttgcctgattcagtctctctgaccgatccaggttgctactctcaagatcgtccggaaatgtgctccttaaggaggggaaacagtgtagccaattgccgtgtctgccagacggaaacggtgattctgatacacccgactcctgcagccactgacacgtggtgtgctgtcattgccgcggagctgtactggagtggcacgcttggttccgtgcggatggcgcgttgtcttgctcagcgttgctcctccactctcggtcttgagacatcgtcgccgctcgcccctacctaccgcgagtctcactcatccgcttcttgcgcccttccca

SEQ ID NO: 548536 - DNA, 232 bp, Homo sapiens
aataaacctccctatcacagtgacctactacccgcgtgtgcttatataactaatccaggacaacccacaaaaattatagcaacacacaaacacaccgctgaccataacatgtgcgtctttcaaagatgccttatcaaccagagcgatgattactgaggatacgcaactcataaaactctacttaaagcaacagggcagacgtgcgtctgtgccagtcgtgaatgtggtgaac

SEQ ID NO: 548537 - DNA, 879 bp, Homo sapiens
  misc_feature (285)..(285): n is a, c, g, or t
agcggagctggtggctggcgctccgcaggggctcggctgttttccgcgcggcaggcgctggccatggctgcagctggtgaaagctgctcaatggagcagaatgtacgacctggcagctgagtgttgtggggtgatcatgggcaagaggctttagaatcttgctcatgtttgcctaataaatgcaacatgccacaggacactgacaattcttaaaacacttggtactaccaggtatttggttcgtcttacaattattgattggacaatcagtgtcatgctggaganagatgcttgggaacacaatcttctctccttcaaacagaacgcagttcatcggcacatgaaacctgaggcttgaatgcttgccagtgtgaactctcttacaacgaacttacaactaccgcgagtgtactcttgtgacacgctttcggttggaccactgacgtgttctaccttgtttgtacgtttgcaacctcaacgctttccttgaacacgcaccttccactaccgctataagccacgaactgtccctctgtcacactttcccaccactttccatctattacggaatctggtagggaccactactgtgacctacgcttgcgttactactgagtggatcacttcgtagaagagaaccatccatgtacatacgcaactctcatcccaggctaattgcccattcacgagtgatcttacgaacgtagtcataacagccactttcccttgacacttgcaggacgacagcacttctctcaaggtcgcctcattggatatctgcgactccactaattgcgacacaccactacggggaccccacaagctcacatacacactacgattgggactttggtgaatccactagcgcctcacactatc

SEQ ID NO: 548538 - DNA, 1028 bp, Homo sapiens
tggtatggtctgaaggacctatcaagtaacacctattactcccagaagtgccgatgcttttttgacacccagttacacctggactcctttataagacagagagtttgatcgatgtctcaatggcaactaaaagaaattttggcacaacataatgtaaagacttactgctaccaagactagtacagcaaggattcatagataaacttgccactgtccttagggtcctcgtaactgtttggccatgaagaacatgttttaaataaaaatgaagctactatctataataactttagacatggccttccacattaaaaggatagtcccattcatcttgataatgaatatgaagggtcgagagttgcgtcatgaccctagccatggtgtgccatatttcagaagagtatcctccagtcagaatactgagaaatttaacttcagcattgctatcgagtggggacagggaaacttgaattggacattccagatgatgctaaagatcttattcgacatcagcagttgggtcaaacaggactccttatgaaggaaaggtttaaacagtttgaaggactggttgatgattgtgaatataaacgaggtataaaggagactagctgtacagatctggatggattcgggatatggtatagttttcagataagaagatgtaatccaccaattcaacaatctgatcgaacttgaggaatctgggtgggcagtccataatcactttgactcttctttgaccacactgtctttgagacaaaagttgggctccggtattgccacagttaacctaaacagggtgatcctggcagcacattgcgcgcagaaaaatggctagctggccattaaaaactgcccggtgcacagaggacatttggcgggcctaattgcgcacaacgaaccatatctgcaacacacgccgagtgcgtacacacgcgttcagcacgaaatctacagtcaaacccgcgcagtctatccacgacgctagcctcttaagggccccaaaagaccctcttttgagcacg

SEQ ID NO: 548539 - DNA, 165 bp, Homo sapiens
cctttcagataccccacctgaaaagggtacacatatgaggactgtgggcacaggacacagatggaacaagtaaggaggttggaggctcctggtgtcgggtagagcagggcccccgttcaccttccataaaagctttcctggtttcattgtgctggcttttggcct

SEQ ID NO: 548540 - DNA, 907 bp, Homo sapiens
agcgggtcacgccgtcggagcggcctctggtgcaacgggaggagttcctgttgctgtcgcagactctctccctttcttacctccccaccagatcccggagatcgcccgccatggctttacttactgcgagcgccggtctcttgggaaccaagaatgcaatcttgttgcttgttacttgcctgggtcgcgggatgccacgttgcttcctcccactgtaaatttgaccgatgaacactattgcgctggaaccgtgagtacctatacgtgagctaggtccacgaacttagagaccttttttcatgcgtcagccataccatgtgctagaccggatggtggagccagaatcacgtgatggtacatagatgtactaggtcggcagtgaaacggcactgaagagggatctggctctagtgacataaccatcaagctgtctctgtaatcctgaatcgatggggcgatctccggttctccgacgcgtctattagatgatcgcctcgagattgtccatgaagatcttgctagtccgaaggtctaaccgggtgtgggaaagacatccctgctctgtaggagtcctaatctttgaggtgtcctggtaaactgtgacagttttccatcccagaggaacctggcatcttcgtgcccgtcagtacgacgtgcggcagaactgagggcaggttctggccttggccatcgtggtcaccatgctaggaggaactttaccacaagcaattctacatcctgagtgtggtgcatgctcagtgcagcttgttgacatgccctgcaacagttgaaaatgatcttggccgcggagcgatatgacacaggggtatccagccgaggtcacagtacgtggtggaagttgacttggatgaagaactctatggatctacttcggcgaaggtacctg

SEQ ID NO: 548541 - DNA, 128 bp, Homo sapiens
tataccggggttagggagaggattagggtgagggttggggtaaccccggaatacgagcatgaatccatgacagtttaccagatccccatacacagtgaacagaggaggggaaagcaccaaccatggca

SEQ ID NO: 548542 - DNA, 685 bp, Homo sapiens
ttcaaatttgctgggtacggtgtaccggcgtgggaacctaaattttacctgcaatggagattcaggtaatcagtcccgtgggcaatagagtcacagtatttgaccttaacaacaacaaatctgacacgctgcccctgtgacactcgtatacaacgtcaagtgcgtgtgggcatgtaccacctgtgatggactgcctcgctatcatcgtcgatgaatggggtggctgatgctgctgcttggtcagcctggtctagaaggtcttgttgactgcaccaacttaccacttcaatggtgctctgttgcacagatgtgtccttctcccctgatggctaggaagtttgtatgtcacaaagggtaacatttgtccagatgtatcatgcccctggtgaatgaagcgggagttcaaagcctatcgtatctggacaatgaactatatatgggacctaccgatgagaccacctggcatcgaacttggacggaatgaccaccaggtgctaagcggaagggagcaaagacatgtccacacttgtggtgttcgagagccgaagacgctgggacaacctcactctactatgcactggaggggacaataaggatgccaccgtggcctgccttcttggaaatccaacaaactgtaacctgaactccactccgccaatacggaatgctgttcaatgtgccagac

SEQ ID NO: 548543 - DNA, 744 bp, Homo sapiens
  misc_feature (15)..(15): n is a, c, g, or t
  misc_feature (18)..(18): n is a, c, g, or t
  misc_feature (42)..(42): n is a, c, g, or t
  misc_feature (44)..(44): n is a, c, g, or t
  misc_feature (53)..(53): n is a, c, g, or t
  misc_feature (58)..(58): n is a, c, g, or t
  misc_feature (60)..(60): n is a, c, g, or t
  misc_feature (68)..(68): n is a, c, g, or t
  misc_feature (70)..(70): n is a, c, g, or t
  misc_feature (72)..(72): n is a, c, g, or t
  misc_feature (76)..(76): n is a, c, g, or t
  misc_feature (94)..(94): n is a, c, g, or t
  misc_feature (96)..(96): n is a, c, g, or t
  misc_feature (113)..(114): n is a, c, g, or t
  misc_feature (127)..(127): n is a, c, g, or t
  misc_feature (136)..(136): n is a, c, g, or t
  misc_feature (138)..(138): n is a, c, g, or t
  misc_feature (141)..(141): n is a, c, g, or t
  misc_feature (148)..(148): n is a, c, g, or t
  misc_feature (160)..(160): n is a, c, g, or t
  misc_feature (166)..(166): n is a, c, g, or t
  misc_feature (170)..(170): n is a, c, g, or t
  misc_feature (174)..(174): n is a, c, g, or t
  misc_feature (176)..(176): n is a, c, g, or t
  misc_feature (184)..(184): n is a, c, g, or t
  misc_feature (198)..(198): n is a, c, g, or t
  misc_feature (202)..(202): n is a, c, g, or t
  misc_feature (213)..(213): n is a, c, g, or t
  misc_feature (225)..(225): n is a, c, g, or t
  misc_feature (234)..(234): n is a, c, g, or t
  misc_feature (238)..(238): n is a, c, g, or t
  misc_feature (240)..(240): n is a, c, g, or t
  misc_feature (245)..(245): n is a, c, g, or t
  misc_feature (249)..(249): n is a, c, g, or t
  misc_feature (256)..(256): n is a, c, g, or t
  misc_feature (298)..(299): n is a, c, g, or t
  misc_feature (328)..(329): n is a, c, g, or t
  misc_feature (333)..(333): n is a, c, g, or t
  misc_feature (349)..(349): n is a, c, g, or t
  misc_feature (352)..(352): n is a, c, g, or t
  misc_feature (355)..(355): n is a, c, g, or t
  misc_feature (358)..(359): n is a, c, g, or t
  misc_feature (367)..(367): n is a, c, g, or t
  misc_feature (376)..(376): n is a, c, g, or t
  misc_feature (386)..(387): n is a, c, g, or t
  misc_feature (394)..(394): n is a, c, g, or t
  misc_feature (396)..(397): n is a, c, g, or t
  misc_feature (402)..(402): n is a, c, g, or t
  misc_feature (408)..(409): n is a, c, g, or t
  misc_feature (431)..(431): n is a, c, g, or t
  misc_feature (445)..(445): n is a, c, g, or t
  misc_feature (467)..(467): n is a, c, g, or t
  misc_feature (471)..(471): n is a, c, g, or t
  misc_feature (478)..(478): n is a, c, g, or t
  misc_feature (480)..(480): n is a, c, g, or t
  misc_feature (482)..(483): n is a, c, g, or t
  misc_feature (486)..(486): n is a, c, g, or t
  misc_feature (490)..(490): n is a, c, g, or t
  misc_feature (498)..(498): n is a, c, g, or t
  misc_feature (500)..(500): n is a, c, g, or t
  misc_feature (510)..(510): n is a, c, g, or t
  misc_feature (555)..(555): n is a, c, g, or t
  misc_feature (558)..(558): n is a, c, g, or t
  misc_feature (590)..(590): n is a, c, g, or t
  misc_feature (620)..(620): n is a, c, g, or t
  misc_feature (625)..(625): n is a, c, g, or t
  misc_feature (627)..(627): n is a, c, g, or t
  misc_feature (629)..(629): n is a, c, g, or t
  misc_feature (632)..(632): n is a, c, g, or t
  misc_feature (639)..(639): n is a, c, g, or t
  misc_feature (657)..(657): n is a, c, g, or t
  misc_feature (677)..(677): n is a, c, g, or t
  misc_feature (682)..(682): n is a, c, g, or t
  misc_feature (684)..(684): n is a, c, g, or t
  misc_feature (737)..(737): n is a, c, g, or t
tgaaaaaaaaaaaanaantttaaaaggctttggcttaaaaananaaaaaaggnacccncncgtaaaangnanaaantcctctcttctgccccancncctgggtcctaaaaaannaatcctgagtccnaaaggggtnantgnaaggaancagggaaggganagggtnaaantttnantctgtaantataaaaaacccanggcnaaggcccaaantggcctctaaancaaaaggtnaaantntgggnaaangaggaanccgaaaaggtccctaaaaaaaaaaaatcccggtcccccggannaaaccccaacctctgcaaaactgtaaggnnaatnccccaaaacctggggnaangtnaannccctaaanctgtaaaangaaaagtaannaaaaacnannagggnaaaaannaaagggaaaaccccactctggnaaaaaaaccgcttnaagctgcaaaggtctgggaaangctnaaaaaancnannaangcanaaccgggnanagggtttgcnagggttattctttcggaatgtggccaaaacgtcggcctggaaaanatnaaagatgatttccaagcccccagacttctccnacagccgggcacctccatcaggaaggtgtnttgtntncngcncaaaaanatgctgaaggaccacggntggggagctggcctggccangactnancagcgggggtgacgggctggccccacaggtgaggggcccggcgctggctcctnttcacct

SEQ ID NO: 548544 - DNA, 278 bp, Homo sapiens
gggcacgagctggcagctcccaggtcatgagcaaatggcacccttggtagtatccctccactgctgtccaggccttcagttccacttctggtcttggaattcatgacccttgaaaaagaagaagtcatttcataaagtgctgcatagtatttccagagagctgcagggctgtgaaaacataattggagttctaaaagctggcccagtcttttataacaacaggtaaatgcagtgcccagtttatttgtggcttttggtttcccccctgcctgaaagca

SEQ ID NO: 548545 - DNA, 117 bp, Homo sapiens
  misc_feature (49)..(49): n is a, c, g, or t
tcatatagaatcgagctggtaccccacttatgcggggatgtttgttttnttgtttttttgagacagagtctcgctttgttgcccaggcatacggtgggcccacggcataagtgtggg

SEQ ID NO: 548546 - DNA, 1356 bp, Homo sapiens
ggccgtgccgctgggttctgagcctggagtggtcggtgggctgggatggaggcagaccttggagcagcacttggaagacacaactgaagaatccctccattgcttggagctcctgtgcacagcatctcacaaggcacttaactcgtgggttgccgaggagacccttgctcagcatgcagccatgctgggcagtgatatcgtgtctactagacccagccaacgccagcctaagcctagaccatctgaaccccccaccttgcatactctccatgctgcagcggtcgctctcacgcaactcaggactacctgggcgcacaccatcaattgaatcccaagacaaaccacgatctggctctcaacgcgctggacaagctgccacaaacacactgagaccatcgtctgaatggcgtccactactcgtgtttctatcaagccaagccccttgatcactagggcaccgctggactccatacccataatgctaccactataacctttcataggacaccttacctaaaacagctttaccaagctaacagctactcaggcccacgtctcaaccttcaccattgcttgccatttcagccgcgactgttctcatcgctggctccgccatcctccacaggacagcctccatattctgacacacttcctcaacagtgccctcctcgtggggcacccctgctcctaactccacccgccatccccttcaccggcttcaaacgcaacacacggcactccatctggcttcctcggccacggccaccccaaagcatcccaagaggtcccacctctggcgttacttcattccgcagcactagccggcctagtcatttcccacttcacactcccttggtccccgaccaacgcgccacaacgcaccaaccacactaccacatcatcctccccccacccaccaaccaccatcaactctccttcctgtcgcgccgcacccacattctacccttcctatgaacaacaacactttcctctacagaacccaacctactatcttatgcacacgcaacccgccctccaccgtattatattcactacgatacaactatagatacctcacggtgctgtttccacctacggcggagcaaccgacctggtcaccacccacccgactgagcgctcggctgtgccacactcacgccacttaaccacaaacccgcgcggtgcgcgtcaccgcgacagctgtttgctctggcaaaacgactccacagatgttgcagccctgcggaggccactcatgcgaggagctctcacccggcgggtgctacgacgagccagatcacaatcgacccgcctcgccacgtgggaggctcgccgctcgtccggctcgcgaccgca

SEQ ID NO: 548547 - DNA, 162 bp, Homo sapiens
  misc_feature (106)..(106): n is a, c, g, or t
  misc_feature (120)..(120): n is a, c, g, or t
ttaaggaccagcccacagatgatcagacatctcacatctgaagtataatgatgagagtggatatgaagacaggaaacagaggaacagcagaggcgcttattctcgntctacaagcaggcntgtgctagagaatggcgtatgatatggaccagaacagttcaa

SEQ ID NO: 548548 - DNA, 344 bp, Homo sapiens
gcagaaataatgatgggttgttaaactaatataggttaccaagtcaatttccctcattttttcagtgctattattatccaatatattgtggctgttatattgtgtgtctatcttctatatttctcctctacttgtcatatcttgtttgtgtgtgactatctgaaactcttgacaatattttcattttctatcttgtttctatcttccaattttcttctaagtttgtacattttgcccttagctttttgtttcctagcttgtcttttttcttctgcttcctacttttcaggtttaaatttatcttttttcttctaaaagtatgtttttatcttctaatttcccta

SEQ ID NO: 548549 - DNA, 175 bp, Homo sapiens
ccccagggggccccccccccggggggtttttccttcctttgggtttttttgggggggccggggggggggggttttggggccctttcccccggcctttggggggggccctttttttttttttttttttcggggtggggggggggggggggggtttttttttttttttgggttccca

SEQ ID NO: 548550 - DNA, 274 bp, Homo sapiens
tcaagtaccacgaagatttgcgtagcagcgattcactatagtatctatcgctaggtccgaactgatatatcctaccctgcagtattcatggatttcctcagcgtttatctagacgtgagagaatttccgtctatgcatactattacacctaaggtgttcgctttgctagtacatctgtttccaccttaagaagcgtcccgttacaccttagtagcagatgtagcacatatatacttttgtagggcacatacagtgaatccctcctcttgttgac

SEQ ID NO: 548551 - DNA, 783 bp, Homo sapiens
acccttgtcccccctctccccccatctgttggatggtcccctccccgaggtgggccgggcgcgccgcgctaacagccacgcggcggcggcttattactcgcgcgcagactttctatctcacgctgggggtttctctctcgaagtattgatctgccgcgacacacctgtcgcggggccctcctgttgggggcgtgggtgtcaccgcgagaggtgttcagccacccttgtgtgccccccgcgcgcgtggtcttcgcgcggtccatagtcccactagtgtggctgtgcgggtggtgagtttctatctcccgtcgttgttgatctggtgggagcgcgcgccgcgtgactggcgtgcatgtgctgagtaactcttctctccgccggttgttttatccgcgcgcgagaatatacaccggcgttccccccccgcgtggtggtgaccgccacacccccaggagttgtttctctcctctccccttgtcccccgagagggggcgccaccttggccgctcgggtggcccccacttcgccactgcttgtgccacgccacgtgtctcgtaggtttcactctccccttacgtcttggattctcgggcgccactcttggggcccccaagcgtctataattcccgagggaggtgtgctcccccacgttatggccctttccccgatggtccccccccttgtccccccaggggggtgctcccccccccccccccgtggtgtttttttgtaaaaaatttttttttgcgttttttttccaaaaaaagttttaaaccaccccca

SEQ ID NO: 548552 - DNA, 362 bp, Homo sapiens
gttgtattaaaaatagatatatatgagttctttcacttgatgtgtgttagacacacgtgtgtgtgttctgtagctcagatctccagacacggtttttaggtagtggaggaagtggcttcatgtggcacttgggcatttatattccacttgggaaggtcaagctgtggccttctggagcaagtggcttgtgtaaggaatgctatgcagggcatggcacgtgagcttcggaatagatgtcttcatcacttctttcactgtgtgttgacactgtgttccttacctatttcctcagatccccagatttctcctctgctatgcattttcttcacagtgccttgcgtccgctgctggttcttctttct

SEQ ID NO: 548553 - DNA, 827 bp, Homo sapiens
  misc_feature (37)..(37): n is a, c, g, or t
ccagaggacaaggtaggctaggtactgaggccctgtntgtgttattgtgcacggagggcgtctgccggaatacttttcttccgctctgagtggcgctactgagtgccgcggagccggattgcggttggggcgtggaagagccggggccgtggctgacagtggagcatgcctgctgttgagtgctgctgccctccccgtcctgaggtgggtggcccaccaggatgagcaatgctgcccagtggagctgacccgagacttgtagcgcatgctgccttgcctgttggactccctgggctcctcactgtcccacagccagagcctctcctcgcacctccttcctggcgctgagaagcgaagggccatctctgatgtccgccgctaccttctgtctcttctgtcaccttcgagctgctcttcatctccctgctctggatcatcgaactgaataccaacacaggcatccgtaagaacttggagcaggagatcatccagatacaactttaaaacttccttcttcgacatctttgtcctggccttcttccgcttctctggactgctcctagtgctatgccgtgcttgcgtgttccggcactggtgggtgattgcggtcacgacgctggtgtccagtgcattcctcattgtcacgtgtcatcctctctgagctgctcaggcaaaggggatttggttacctgctcccatcgtctctattgtgtcgcctggttgggacctgttcttgacttcaagtctacccaggaagctgaaagagcggtggatttgcagccagatgtgatgccgtgaccctgctgtctcggtgttgtcgagggcgg

SEQ ID NO: 548554 - DNA, 295 bp, Homo sapiens
gttggttaacgcctttattaagccctctcttgcttatatgtcttgtattgatatttggactctgtatatacaatactataactcgaattgtttcttctcgcctagaagcaatcaaactccaaatggtgctgtaaactgaaccacacatggacaggccattcttccgaggacccttagattgatccaggggagccctagctgctattcccattcacgcccttttcagcaggagtagccagaggagtcgccgccaaactcctacacagtaggttgcattcccagaagtatgtttagg

SEQ ID NO: 548555 - DNA, 3929 bp, Homo sapiens
gcagactcgagatgcgcccgaggaggttgggccggtgctgcgcggggagccggctcggacccggggacccagcagcactcacctgtgcaccttcgccctcagccagtcccgctccggagccctctgcgcagccgcaggcacggggcactggacagagagtaggatcccgagccacctctggaacccagttcctctcggaagcccgcaccggagctcgcccggcctcggaggctggagccaaggcaggagcccggcgcccgtccgcattctcggccatccaaggggatgtccggtctatgcccgacaattcggacgcgccgtggacccgcttcgtattccaagggccgtttggttcccgggccactggccgggggactggaaaggcagcgggcatctggaagacgccagccgcctacgttggccggcgacccggggtgtccggccctgagcgcgccgcctttattcgggagctggaggaagcactgtgtcctaacctacctccgccagtcaaaaagatcacccaggaagacgtcaaagtgatgttatatttgctggaggagcttctcccacctgtctgggagagcgttacctatgggatggtcctgcagagagagagggacctgaacactgcagctcgcatcggccagtccctggtgaaacagaacagtgttttgatggaggagaacagcaagctggaagccctgctgggctcagccaaggaggagattttatacctcagacaccaggtgaacttgcgggatgagctcctccagctctactcagattctgatgaggaggatgaggatgaagaagaggaggaggaagaaaaggaggcagaagaggaacaggaagaagaagaagcagaggaagacctgcagtgtgctcatccctgtgatgcccctaagctgatttcgcaggaggcattgctgcaccagcaccactgcccacagctggaagccttgcaggagaagctgaggctgctggaggaggagaatcatcagctgagagaagaggcctctcaactcgacactcttgaggatgaggaacagatgctcattctggagtgtgtggagcagttttcggaggccagccaacagatggctgagctgtcggaggtgctggtgctcaggctggaaaactatgaacggcagcagcaggaggtcgctcggctgcaggcccaggtgctgaagctgcagcagcgctgccggatgtatggggctgagactgaaaagttgcagaagcagctggcttcggagaaggaaatccagatgcagctccaggaagaggagactcttcctggtttccaggagacgctggctgaggagctcagaacgtctctaaggaggatgatctcagaccctgtgtattttatggagaggaattatgagatgcccagaggggacacatccagcctaaggtatgattttcgctacagtgaggatcgagagcaggtgcgggggtttgaggctgaggaagggttgatgctggcagcggatatcatgcggggggaagatttcacgcctgcggaggagttggtgccccaggaggagctgggggctgccaagaaggtgccggctgaggaaggggtgatggaagaggcagagctggtgtcagaggagaccgagggctgggaggaggtggaactggagctggatgaggcaacgcggatgaacgtggtgacatcagccctggaggccagcggcttgggcccttcacacctggacatgaattatgtcctccagcagctggccaactggcaagatgcccattacaggcggcagctgaggtggaagatgctccagaaaggtgagtgcccccacggggccctccctgccgccagccggacaagctgcagatcgtcgtgccgatgaaaagagagggtggataagctccccgagtgctcacctgccccagcctggctctacctgctgtgcttatttgcatggactttgcatatcatttgcatagacacctctgatccccttcagtgggaaccgtagtgtcagtgctcatttatgtggcatttgcttaggattccagatctccatccacttttctcctgggggctgggctgggggttagggctgggactgtgcccccacactgcgcctcagcttcccatctctgcccgcttgcttcccctacccccaacccctgcctcctctataccccaggctctccaactctgcagcagtggcagcagcagtcaaaacaaacacggggggcggtgggtgggatggtggagcagcctgggggctgacccaggctggaggacaggaccagccaccctcccacggcctgggaggaagagaggccttctgggactgcccaggctatggggacaaaggccttcaccagcaagggccacagttggaacagtcccctgggtgtcagaaggtgggctagggcctcctgcagggttgtggggtggaacagggtctcctctccccagccagaaaccccaaagtctgggagctgcacctgccgagtgcaggccatgtgagccctgcctctttaaggagccgcaggacatgaaagatgaccttgtgacactcatgcacagcagccattgcacgtgcatcagctcccatcagcctcattccgtggcaggtgatgtgtccccattggttaggtgaggagggtgaggctcagagagctaaggacacttgtttggggccacacagccggggtagatctgagcccgtcctctctactcctgtgctgtagcaccttcactggcccatccctcccctctagtgctgtcctggtacccgtcccagcctgtccccattctcatggccctttggtcactgccgggtggaatagcactggcttcagcaggcgtgtcatgtaagcttgtgcaggttataaactgaaccatgacctttatggcgcatgcagggggcaacctgcataattatcaatggcgactttccgtgtccttctgatacagttgatcagacccctgcccaccgcccaggccaggcctgtggtcatcaatgccccagttcacatccacctgcttctcttccaggctttgctgttccccagcagcctgcagaggccccacagacagcttgaggcccctcctgctgcctggccaagccccacacccgcagaccctccttcccatcctctgaaatgggaccctgtgtctgtcaccagcccaccctctgtgttcatgaacctgggctggagcttggggacccctccctgcccctggcttcctcttccatgttctgccctttcccacatgttggaggcttttccaacgtcttcagggacaggcggtaggaaccccggccctcgctctgcagctggtgcaaaagctgtggctgccaggcctgggccacatggcagcccagggggcaggagaagcccgggagaggcccgctggctaccagactcagccctgagcagggaacagggcccagcttccaccggcagggagttgtgagcgccttcccaacaatgtgcccctcaccccttgatgcccatgctaatggtagccaccctggttcttgttgacttgagggacctggctgtcttccctgttcttcatcctttcttctcagtccctacctactgtttgtaaccacaagtgtctctgtgtgtgggtgggtgagggcccctctgcccagtggtgtgtctcctctccctccctccctcttctgccagtggcctgggggtgtccaggctcccatccatggcccagcccctctcccctctgtcttgatccccccctccctgcccctggcttcctcttccatgttctgccctttcccacacctttgttcctcaatagctgggggctgggactgaggcctcctgcaggtacctgccccccttcacacagcacctctcaatctcctattgcttgtcagcctgtgtgcgtgtggtgcaggaaataaaggatctataccctcctg

SEQ ID NO: 548556 - DNA, 154 bp, Homo sapiens
tgggcttgtgtgtcctttcgtgaggtgcttgagcccagtgtacctaatgcatcatactagggaatcatggtcagtccctatcgcagaagggaatttgacacatgtaccacatggatgagccatgaagacattttgctaatgaaataagtcacaa

SEQ ID NO: 548557 - DNA, 357 bp, Homo sapiens
actctataactagctgttgagtgatttaccttgacttttgactcatgtgacttatcgactcaccttgggcccttccactgtaacctttaacctttccatcttctgcctggtccccgaggctcctggaaccacatgggtgccaactgctttcatacttgtaaatttctaagtagagtagatactgctaacacagaatcagatctagagaataccattagcttctaatatagagacatcaattcttgacttgtcaaagaataaaaatctcatgagataataaagttgtactggtcttcagatattaaaaaaaaaaagggaaataactatacaatatccctcgtaaagcatgggtaccga

SEQ ID NO: 548558 - DNA, 3878 bp, Homo sapiens
gcagactcgagatgcgcccgaggaggttgggccggtgctgcgcggggagccggctcggacccggggacccagcagcactcacctgtgcaccttcgccctcagccagtcccgctccggagccctctgcgcagccgcaggcacggggcactggacagagagtaggatcccgagccacctctggaacccagttcctctcggaagcccgcaccggagctcgcccggcctcggaggctggagccaaggcaggagcccggcgcccgtccgcattctcggccatccaaggggatgtccggtctatgcccgacaattcggacgcgccgtggacccgcttcgtattccaagggccgtttggttcccgggccactggccgggggactggaaaggcagcgggcatctggaagacgccagccgcctacgttggccggcgacccggggtgtccggccctgagcgcgccgcctttattcgggagctggaggaagcactgtgtcctaacctacctccgccagtcaaaaagatcacccaggaagacgtcaaagtgatgttatatttgctggaggaggtgtgtactgccttcctgatccagcttctcccacctgtctgggagagcgttacctatgggatggtcctgcagagagagagggacctgaacactgcagctcgcatcggccagtccctggtgaaacagaacagtgttttgatggaggagaacagcaagctggaagccctgctgggctcagccaaggaggagattttatacctcagacaccaggtgaacttgcgggatgagctcctccagctctactcagattctgatgaggaggatgaggatgaagaagaggaggaggaagaaaaggaggcagaagaggaacaggaagaagaagaagcagaggaagacctgcagtgtgctcatccctgtgatgcccctaagctgatttcgcaggaggcattgctgcaccagcaccactgcccacagctggaagccttgcaggagaagctgaggctgctggaggaggagaatcatcagctgagagaagaggcctctcaactcgacactcttgaggatgaggaacagatgctcattctggagtgtgtggagcagttttcggaggccagccaacagatggctgagctgtcggaggtgctggtgctcaggctggaaaactatgaacggcagcagcaggaggtcgctcggctgcaggcccaggtgctgaagctgcagcagcgctgccggatggagactcttcctggtttccaggagacgctggctgaggagctcagaacgtctctaaggaggatgatctcagaccctgtgtattttatggagaggaattatgagatgcccagaggggacacatccagcctaaggtatgattttcgctacagtgaggatcgagagcaggtgcgggggtttgaggctgaggaagggttgatgctggcagcggatatcatgcggggggaagatttcacgcctgcggaggagttggtgccccaggaggagctgggggctgccaagaaggtgccggctgaggaaggggtgatggaagaggcagagctggtgtcagaggagaccgagggctgggaggaggtggaactggagctggatgaggcaacgcggatgaacgtggtgacatcagccctggaggccagcggcttgggcccttcacacctggacatgaattatgtcctccagcagctggccaactggcaagatgcccattacaggcggcagctgaggtggaagatgctccagaaaggtgagtgcccccacggggccctccctgccgccagccggacaagctgcagatcgtcgtgccgatgaaaagagagggtggataagctccccgagtgctcacctgccccagcctggctctacctgctgtgcttatttgcatggactttgcatatcatttgcatagacacctctgatccccttcagtgggaaccgtagtgtcagtgctcatttatgtggcatttgcttaggattccagatctccatccacttttctcctgggggctgggctgggggttagggctgggactgtgcccccacactgcgcctcagcttcccatctctgcccgcttgcttcccctacccccaacccctgcctcctctataccccaggctctccaactctgcagcagtggcagcagcagtcaaaacaaacacggggggcggtgggtgggatggtggagcagcctgggggctgacccaggctggaggacaggaccagccaccctcccacggcctgggaggaagagaggccttctgggactgcccaggctatggggacaaaggccttcaccagcaagggccacagttggaacagtcccctgggtgtcagaaggtgggctagggcctcctgcagggttgtggggtggaacagggtctcctctccccagccagaaaccccaaagtctgggagctgcacctgccgagtgcaggccatgtgagccctgcctctttaaggagccgcaggacatgaaagatgaccttgtgacactcatgcacagcagccattgcacgtgcatcagctcccatcagcctcattccgtggcaggtgatgtgtccccattggttaggtgaggagggtgaggctcagagagctaaggacacttgtttggggccacacagccggggtagatctgagcccgtcctctctactcctgtgctgtagcaccttcactggcccatccctcccctctagtgctgtcctggtacccgtcccagcctgtccccattctcatggccctttggtcactgccgggtggaatagcactggcttcagcaggcgtgtcatgtaagcttgtgcaggttataaactgaaccatgacctttatggcgcatgcagggggcaacctgcataattatcaatggcgactttccgtgtccttctgatacagttgatcagacccctgcccaccgcccaggccaggcctgtggtcatcaatgccccagttcacatccacctgcttctcttccaggctttgctgttccccagcagcctgcagaggccccacagacagcttgaggcccctcctgctgcctggccaagccccacacccgcagaccctccttcccatcctctgaaatgggaccctgtgtctgtcaccagcccaccctctgtgttcatgaacctgggctggagcttggggacccctccctgcccctggcttcctcttccatgttctgccctttcccacatgttggaggcttttccaacgtcttcagggacaggcggtaggaaccccggccctcgctctgcagctggtgcaaaagctgtggctgccaggcctgggccacatggcagcccagggggcaggagaagcccgggagaggcccgctggctaccagactcagccctgagcagggaacagggcccagcttccaccggcagggagttgtgagcgccttcccaacaatgtgcccctcaccccttgatgcccatgctaatggtagccaccctggttcttgttgacttgagggacctggctgtcttccctgttcttcatcctttcttctcagtccctacctactgtttgtaaccacaagtgtctctgtgtgtgggtgggtgagggcccctctgcccagtggtgtgtctcctctccctccctccctcttctgccagtggcctgggggtgtccaggctcccatccatggcccagcccctctcccctctgtcttgatccccccctccctgcccctggcttcctcttccatgttctgccctttcccacacctttgttcctcaatagctgggggctgggactgaggcctcctgcaggtacctgccccccttcacacagcacctctcaatctcctattgcttgtcagcctgtgtgcgtgtggtgcaggaaataaaggatctataccctcctg

SEQ ID NO: 548559 - DNA, 194 bp, Homo sapiens
gacgagatcccgaaagacacaggtaggtggtgtgtcctgtagtcccaactactcaggagctgaggtgggaggattgtttgagtctagcatgggtaacatagcgagacatctctttttttttttttttttttttttttttttttttttttttttttttttttttttttttttttgggggaagggacccccctttt

SEQ ID NO: 548560 - DNA, 204 bp, Homo sapiens
aaagtccggtagtttttaaactgtttgtttttaaaccaactataggactcttcattgtccagccaagccaagagtccctgcatccatgaaagttccagaacctcctgtactttaaccccgattccgccacgcttctgttattttttttgtatgtttaggatgctgaaatgtttttgaagttaaataacccgtattaccttttta

SEQ ID NO: 548561 - DNA, 615 bp, Homo sapiens
  misc_feature (608)..(608): n is a, c, g, or t
tgtaagccagtaaataagataaaacaaaaggtacttgtaataatagtcatataaaatagctatatgcatgcttttagaaacccaagacacaaataaaaatataccagcagtttgtcttttgagcagctgaaacctatcagagctattcaaagattatgtctcttcactgtagctgctatattggtggtagagtttccatcctttcagtattttatatttaaaatgtaaatagtatttcatgtaataggaaaagaagcctgctaaattttctttgctaaaaaaaattttaaatctaaaataatgatatagtagtaacagcaaattagtgatgtttcataactaactaacattaatggattattttagaaacaaagacaaaagaaccttactgagccacttaaatgaaagtaaattatttaaagtacacactattaaagagtgctattcaggcctatggagatagttattttgagtcatagaattacattttaaaaatttattttccgagacttaatattgtgaggttattcttaggttataagtctgaatttttgctcttactggccaattgtttgtaggtttatgaaccccatgaaacatcacttggnactttga

SEQ ID NO: 548562 - DNA, 4445 bp, Homo sapiens
gcagactcgagatgcgcccgaggaggttgggccggtgctgcgcggggagccggctcggacccggggacccagcagcactcacctgtgcaccttcgccctcagccagtcccgctccggagccctctgcgcagccgcaggcacggggcactggacagagagtaggatcccgagccacctctggaacccagttcctctcggaagcccgcaccggagctcgcccggcctcggaggctggagccaaggcaggagcccggcgcccgtccgcattctcggccatccaaggggatgtccggtctatgcccgacaattcggacgcgccgtggacccgcttcgtattccaagggccgtttggttcccgggccactggccgggggactggaaaggcagcgggcatctggaagacgccagccgcctacgttggccggcgacccggggtgtccggccctgagcgcgccgcctttattcgggagctggaggaagcactgtgtcctaacctacctccgccagtcaaaaagatcacccaggaagacgtcaaagtgatgttatatttgctggaggagcttctcccacctgtctgggagagcgttacctatgggatggtcctgcagagagagagggacctgaacactgcagctcgcatcggccagtccctggtgaaacagaacagtgttttgatggaggagaacagcaagctggaagccctgctgggctcagccaaggaggagattttatacctcagacaccaggtgaacttgcgggatgagctcctccagctctactcagattctgatgaggaggatgaggatgaagaagaggaggaggaagaaaaggaggcagaagaggaacaggaagaagaagaagcagaggaagacctgcagtgtgctcatccctgtgatgcccctaagctgatttcgcaggaggcattgctgcaccagcaccactgcccacagctggaagccttgcaggagaagctgaggctgctggaggaggagaatcatcagctgagagaagaggcctctcaactcgacactcttgaggatgaggaacagatgctcattctggagtgtgtggagcagttttcggaggccagccaacagatggctgagctgtcggaggtgctggtgctcaggctggaaaactatgaacggcagcagcaggaggtcgctcggctgcaggcccaggtgctgaagctgcagcagcgctgccggatgtatggggctgagactgaaaagttgcagaagcagctggcttcggagaaggaaatccagatgcagctccaggaagagagcgtgtgggtgggttcccagctgcaggacctgcgggagaagtacatggattgtgggggcatgctgattgagatgcaggaggaggtgaagaccctccgccagcaacccccggtgtccactgggtctgccacccattacccatacagtgtgcctctggagactcttcctggtttccaggagacgctggctgaggagctcagaacgtctctaaggaggatgatctcagaccctgtgtattttatggagaggaattatgagatgcccagaggggacacatccagcctaaggtatgattttcgctacagtgaggatcgagagcaggtgcgggggtttgaggctgaggaagggttgatgctggcagcggatatcatgcggggggaagatttcacgcctgcggaggagttggtgccccaggaggagctgggggctgccaagaaggtgccggctgaggaaggggtgatggaagaggcagagctggtgtcagaggagaccgagggctgggaggaggtggaactggagctggatgaggcaacgcggatgaacgtggtgacatcagccctggaggccagcggcttgggcccttcacacctggacatgaattatgtcctccagcagctggccaactggcaagatgcccattacaggcggcagctgaggtggaagatgctccagaaaggtgagtgcccccacggggccctccctgccgccagccggacaagctgcagatcgtcgtgccgatgaaaagagagggtggataagctccccgagtgctcacctgccccagcctggctctacctgctgtgcttatttgcatggactttgcatatcatttgcatagacacctctgatccccttcagtgggaaccgtagtgtcagtgctcatttatgtggcatttgcttaggattccagatctccatccacttttctcctgggggctgggctgggggttagggctgggactgtgcccccacactgcgcctcagcttcccatctctgcccgcttgcttcccctacccccaacccctgcctcctctataccccaggctctccaactctgcagcagtggcagcagcagtcaaaacaaacacggggggcggtgggtgggatggtggagcagcctgggggctgacccaggctggaggacaggaccagccaccctcccacggcctgggaggaagagaggccttctgggactgcccaggctatggggacaaaggccttcaccagcaagggccacagttggaacagtcccctgggtgtcagaaggtgggctagggcctcctgcagggttgtggggtggaacagggtctcctctccccagccagaaaccccaaagtctgggagctgcacctgccgagtgcaggccatgtgagccctgcctctttaaggagccgcaggacatgaaagatgaccttgtgacactcatgcacagcagccattgcacgtgcatcagctcccatcagcctcattccgtggcaggtgatgtgtccccattggttaggtgaggagggtgaggctcagagagctaaggacacttgtttggggccacacagccggggtagatctgagcccgtcctctctactcctgtgctgtagcaccttcactggcccatccctcccctctagtgctgtcctggtacccgtcccagcctgtccccattctcatggccctttggtcactgccgggtggaatagcactggcttcagcaggcgtgtcatgtaagcttgtgcaggttataaactgaaccatgacctttatggcgcatgcagggggcaacctgcataattatcaatggcgactttccgtgtccttctgatacagttgatcagacccctgcccaccgcccaggccaggcctgtggtcatcaatgccccagttcacatccacctgcttctcttccaggctttgctgttccccagcagcctgcagaggccccacagacagcttgaggcccctcctgctgcctggccaagccccacacccgcagaccctccttcccatcctctgaaatgggaccctgtgtctgtcaccagcccaccctctgtgttcatgaacctgggctggagcttggggacccctccctgcccctggcttcctcttccatgttctgccctttcccacatgttggaggcttttccaacgtcttcagggacaggcggtaggaaccccggccctcgctctgcagctggtgcaaaagctgtggctgccaggcctgggccacatggcagcccagggggcaggagaagcccgggagaggcccgctggctaccagactcagccctgagcagggaacagggcccagcttccaccggcagggagttgtgagcgccttcccaacaatgtgcccctcaccccttgatgcccatgctaatggtagccaccctggttcttgttgacttgagggacctggctgtcttccctgttcttcatcctttcttctcagtccctacctactgtttgtaaccacaagtgtctctgtgtgtgggtgggtgagggcccctctgcccagtggtgtgtctcctctccctccctccctcttctgccagtggcctgggggtgtccaggctcccatccatggcccagcccctctcccctctgtcttgatccccccctccctgcccctggcttcctcttccatgttctgccctttcccacacctttgttcctcaatagctgggggctgggactgaggcctcctgcaggtacctgccccccttcacacagcacctctcaatctcctattgcttgtcagcctgtgtgcgtgtggtgcaggaaataaaggatctataccctcctggaaaaaaaaaaaaaaaaaaaaaaaacaaaaaaaaaaaaaaaagaaagaaaaaaaaaaaaaaaaaaaaaacaaaacacaacacgcgcaaacacaccccaaacgcgaagagaacagacgcagagagcgaaaaacgacggcagccgaagaaccaacaccggcgagaagcggcagaaaccccgacggccggcgcggagcagaggcggcagaaacacaacacaaaacgaaacaaccaacaacgcacaaaaaggaagcaaaagaaacagcgaagagagagaacaaacaaccacgaacaggaaggaggacacacagcagaaacgaaaaacaaacagacacaaaccaagcgacaacaaccacacacaa

SEQ ID NO: 548563 - DNA, 140 bp, Homo sapiens
aagcagtaatacagactcatggcttcaagtaatatatgtgtgctgacaatcacagattttattcttaatgcatacggctttccatgacaacccacctcaagttggtcccactgtaatttttctattatagcacccagggt

SEQ ID NO: 548564 - DNA, 3899 bp, Homo sapiens
gcagactcgagatgcgcccgaggaggttgggccggtgctgcgcggggagccggctcggacccggggacccagcagcactcacctgtgcaccttcgccctcagccagtcccgctccggagccctctgcgcagccgcaggcacggggcactggacagagagtaggatcccgagccacctctggaacccagttcctctcggaagcccgcaccggagctcgcccggcctcggaggctggagccaaggcaggagcccggcgcccgtccgcattctcggccatccaaggggatgtccggtctatgcccgacaattcggacgcgccgtggacccgcttcgtattccaagggccgtttggttcccgggccactggccgggggactggaaaggcagcgggcatctggaagacgccagccgcctacgttggccggcgacccggggtgtccggccctgagcgcgccgcctttattcgggagctggaggaagcactgtgtcctaacctacctccgccagtcaaaaagatcacccaggaagacgtcaaagtgatgttatatttgctggaggaggtgtgtactgccttcctgatccagcttctcccacctgtctgggagagcgttacctatgggatggtcctgcagagagagagggacctgaacactgcagctcgcatcggccagtccctggtgaaacagaacagtgttttgatggaggagaacagcaagctggaagccctgctgggctcagccaaggaggagattttatacctcagacaccaggtgaacttgcgggatgagctcctccagctctactcagattctgatgaggaggatgaggatgaagaagaggaggaggaagaaaaggaggcagaagaggaacaggaagaagaagaagcagaggaagacctgcagtgtgctcatccctgtgatgcccctaagctgatttcgcaggaggcattgctgcaccagcaccactgcccacagctggaagccttgcaggagaagctgaggctgctggaggaggagaatcatcagctgagagaagaggcctctcaactcgacactcttgaggatgaggaacagatgctcattctggagtgtgtggagcagttttcggaggccagccaacagatggctgagctgtcggaggtgctggtgctcaggctggaaaactatgaacggcagcagcaggaggtcgctcggctgcaggcccaggtgctgaagctgcagcagcgctgccggatgtatggggctgagactgaaaagttgcagaagcagctggcttcggagaaggaaatccagatgcagctccaggaagaggagactcttcctggtttccaggagacgctggctgaggagctcagaacgtctctaaggaggatgatctcagaccctgtgtattttatggagaggaattatgagatgcccagaggggacacatccagcctaaggtatgattttcgctacagtgaggatcgagagcaggtgcgggggtttgaggctgaggaagggttgatgctggcagcggatatcatgcggggggaagatttcacgcctgcggaggagttggtgccccaggaggagctgggggctgccaagaaggtgccggctgaggaaggggtgatggaagaggcagagctggtgtcagaggagaccgagggctgggaggaggtggaactggagctggatgaggcaacgcggatgaacgtggtgacatcagccctggaggccagcggcttgggcccttcacacctggacatgaattatgtcctccagcagctggccaactggcaagatgcccattacaggcggcagctgaggtggaagatgctccagaaaggtgagtgcccccacggggccctccctgccgccagccggacaagctgcagatcgtcgtgccgatgaaaagagagggtggataagctccccgagtgctcacctgccccagcctggctctacctgctgtgcttatttgcatggactttgcatatcatttgcatagacacctctgatccccttcagtgggaaccgtagtgtcagtgctcatttatgtggcatttgcttaggattccagatctccatccacttttctcctgggggctgggctgggggttagggctgggactgtgcccccacactgcgcctcagcttcccatctctgcccgcttgcttcccctacccccaacccctgcctcctctataccccaggctctccaactctgcagcagtggcagcagcagtcaaaacaaacacggggggcggtgggtgggatggtggagcagcctgggggctgacccaggctggaggacaggaccagccaccctcccacggcctgggaggaagagaggccttctgggactgcccaggctatggggacaaaggccttcaccagcaagggccacagttggaacagtcccctgggtgtcagaaggtgggctagggcctcctgcagggttgtggggtggaacagggtctcctctccccagccagaaaccccaaagtctgggagctgcacctgccgagtgcaggccatgtgagccctgcctctttaaggagccgcaggacatgaaagatgaccttgtgacactcatgcacagcagccattgcacgtgcatcagctcccatcagcctcattccgtggcaggtgatgtgtccccattggttaggtgaggagggtgaggctcagagagctaaggacacttgtttggggccacacagccggggtagatctgagcccgtcctctctactcctgtgctgtagcaccttcactggcccatccctcccctctagtgctgtcctggtacccgtcccagcctgtccccattctcatggccctttggtcactgccgggtggaatagcactggcttcagcaggcgtgtcatgtaagcttgtgcaggttataaactgaaccatgacctttatggcgcatgcagggggcaacctgcataattatcaatggcgactttccgtgtccttctgatacagttgatcagacccctgcccaccgcccaggccaggcctgtggtcatcaatgccccagttcacatccacctgcttctcttccaggctttgctgttccccagcagcctgcagaggccccacagacagcttgaggcccctcctgctgcctggccaagccccacacccgcagaccctccttcccatcctctgaaatgggaccctgtgtctgtcaccagcccaccctctgtgttcatgaacctgggctggagcttggggacccctccctgcccctggcttcctcttccatgttctgccctttcccacatgttggaggcttttccaacgtcttcagggacaggcggtaggaaccccggccctcgctctgcagctggtgccccgggagaggcccgctggctaccagactcagccctgagcagggaacagggcccagcttccaccggcagggagttgtgagcgccttcccaacaatgtgcccctcaccccttgatgcccatgctaatggtagccaccctggttcttgttgacttgagggacctggctgtcttccctgttcttcatcctttcttctcagtccctacctactgtttgtaaccacaagtgtctctgtgtgtgggtgggtgagggcccctctgcccagtggtgtgtctcctctccctccctccctcttctgccagtggcctgggggtgtccaggctcccatccatggcccagcccctctcccctctgtcttgatccccccctccctgcccctggcttcctcttccatgttctgccctttcccacacctttgttcctcaatagctgggggctgggactgaggcctcctgcaggtacctgccccccttcacacagcacctctcaatctcctattgcttgtcagcctgtgtgcgtgtggtgcaggaaataaaggatctataccctcctg

SEQ ID NO: 548565 - DNA, 332 bp, Homo sapiens
tttccatggatatcgatcgcgcttcctatcaaaatcacagcaagattttattctagatacagaaaagtgtattccataatttatctaaaaagacaaaggaactagaataaccagaaacaattttgaaaaagaaaataaaggggcaatcatcagtgtacctgatttcaaagcttattatatagctatagtaatcaagacaatatattatcagctgggggacatacacagatcaatgaaatagagtagaaaatgcgaaaacagatgaacagatatatccaagtaattattgagagaggtgcaaaacacattcaatggagaaaaaataggctttt

SEQ ID NO: 548566 - DNA, 2123 bp, Homo sapiens
gcagactcgagatgcgcccgaggaggttgggccggtgctgcgcggggagccggctcggacccggggacccagcagcactcacctgtgcaccttcgccctcagccagtcccgctccggagccctctgcgcagccgcaggcacggggcactggacagagagtaggatcccgagccacctctggaacccagttcctctcggaagcccgcaccggagctcgcccggcctcggaggctggagccaaggcaggagcccggcgcccgtccgcattctcggccatccaaggggatgtccggtctatgcccgacaattcggacgcgccgtggacccgcttcgtattccaagggccgtttggttcccgggccactggccgggggactggaaaggcagcgggcatctggaagacgccagccgcctacgttggccggcgacccggggtgtccggccctgagcgcgccgcctttattcgggagctggaggaagcactgtgtcctaacctacctccgccagtcaaaaagatcacccaggaagacgtcaaagtgatgttatatttgctggaggaggtgtgtactgccttcctgatccagcttctcccacctgtctgggagagcgttacctatgggatggtcctgcagagagagagggacctgaacactgcagctcgcatcggccagtccctggtgaaacagaacagtgttttgatggaggagaacagcaagctggaagccctgctgggctcagccaaggaggagattttatacctcagacaccaggtgaacttgcgggatgagctcctccagctctactcagattctgatgaggaggatgaggatgaagaagaggaggaggaagaaaaggaggcagaagaggaacaggaagaagaagaagcagaggaagacctgcagtgtgctcatccctgtgatgcccctaagctgatttcgcaggaggcattgctgcaccagcaccactgcccacagctggaagccttgcaggagaagctgaggctgctggaggaggagaatcatcagctgagagaagaggcctctcaactcgacactcttgaggatgaggaacagatgctcattctggagtgtgtggagcagttttcggaggccagccaacagatggctgagctgtcggaggtgctggtgctcaggctggaaaactatgaacggcagcagcaggaggtcgctcggctgcaggcccaggtgctgaagctgcagcagcgctgccggatgtatggggctgagactgaaaagttgcagaagcagctggcttcggagaaggaaatccagatgcagctccaggaagaggagactcttcctggtttccaggagacgctggctgaggagctcagaacgtctctaaggaggatgatctcagaccctgtgtattttatggagaggaattatgagatgcccagaggggacacatccagcctaaggtatgattttcgctacagtgaggatcgagagcaggtgcgggggtttgaggctgaggaagggttgatgctggcagcggatatcatgcggggggaagatttcacgcctgcggaggagttggtgccccaggaggagctgggggctgccaagaaggtgccggctgaggaaggggtgatggaagaggcagagctggtgtcagaggagaccgagggctgggaggaggtggaactggagctggatgaggcaacgcggatgaacgtggtgacatcagccctggaggccagcggcttgggcccttcacacctggacatgaattatgtcctccagcagctggccaactggcaagatgcccattacaggcggcagctgaggtggaagatgctccagaaagagccccagccgtggacctaagatgggtagagaaaacactttccctcctctacagccctcaggtggcgggtagctcaaggtaatggtgtcaacaggcacaagaacaatgatggaatggagtgagacaccagcaatgcctgcatcagccactcatgagcaattatttacaaatatttattgggttcctcctattcttgccaccggtgatacagaagggaggagggacttgtcacgctcccagtttcctgttttgcccgagaggcagacaataaactggcaaacaaaaaaaaaaaa

SEQ ID NO: 548567 - DNA, 228 bp, Homo sapiens
cttatagatgcgagaaggagaggatgacagagatagcgcaatggcgaggatgactcttaagcacataggggggttagaaatcttatgccatattggttgagctaggcgcttgtctaagatcaaatttttcaccagatcctctcccctagtatcttcagcacatgctcactgttctccccatccttgtccttcccatgttcattaattcatatggcccccgggacgggg

SEQ ID NO: 548568 - DNA, 1386 bp, Homo sapiens
gcagactcgagatgcgcccgaggaggttgggccggtgctgcgcggggagccggctcggacccggggacccagcagcactcacctgtgcaccttcgccctcagccagtcccgctccggagccctctgcgcagccgcaggcacggggcactggacagagagtaggatcccgagccacctctggaacccagttcctctcggaagcccgcaccggagctcgcccggcctcggaggctggagccaaggcaggagcccggcgcccgtccgcattctcggccatccaaggggatgtccggtctatgcccgacaattcggacgcgccgtggacccgcttcgtattccaagggccgtttggttcccgggccactggccgggggactggaaaggcagcgggcatctggaagacgccagccgcctacgttggccggcgacccggggtgtccggccctgagcgcgccgcctttattcgggagctggaggaagcactgtgtcctaacctacctccgccagtcaaaaagatcacccaggaagacgtcaaagtgatgttatatttgctggaggaggtgtgtactgccttcctgatccagcttctcccacctgtctgggagagcgttacctatgggatggtcctgcagagagagagggacctgaacactgcagctcgcatcggccagtccctggtgaaacagaacagtgttttgatggaggagaacagcaagctggaagccctgctgggctcagccaaggaggagattttatacctcagacaccaggtgaacttgcgggatgagctcctccagctctactcagattctgatgaggaggatgaggatgaagaagaggaggaggaagaaaaggaggcagaagaggaacaggaagaagaagaagcagaggaagacctgcagtgtgctcatccctgtgatgcccctaagctgatttcgcaggaggcattgctgcaccagcaccactgcccacagctggaagccttgcaggagaagctgaggctgctggaggaggagaatcatcagctgagagaagaggcctctcaactcgacactcttgaggatgaggaacagatgctcattctggagtgtgtggagcagttttcggaggccagccaacagatggctgagctgtcggaggtgctggtgctcaggctggaaaactatgaacggcagcagcaggaggtcgctcggctgcaggcccaggtgctgaagctgcagcagcgctgccggatcttatggggcccagacggagaaactgcagcagcagctggcctcagagaagggagtccacccagagagcctgcgagctggctcccacatgcaggattatggaagcaggcctcgtgaacgccaggaggatgggaagagccatcgtcagcgttcc

SEQ ID NO: 548569 - DNA, 1949 bp, Homo sapiens
gcagactcgagatgcgcccgaggaggttgggccggtgctgcgcggggagccggctcggacccggggacccagcagcactcacctgtgcaccttcgccctcagccagtcccgctccggagccctctgcgcagccgcaggcacggggcactggacagagagtaggatcccgagccacctctggaacccagttcctctcggaagcccgcaccggagctcgcccggcctcggaggctggagccaaggcaggagcccggcgcccgtccgcattctcggccatccaaggggatgtccggtctatgcccgacaattcggacgcgccgtggacccgcttcgtattccaagggccgtttggttcccgggccactggccgggggactggaaaggcagcgggcatctggaagacgccagccgcctacgttggccggcgacccggggtgtccggccctgagcgcgccgcctttattcgggagctggaggaagcactgtgtcctaacctacctccgccagtcaaaaagatcacccaggaagacgtcaaagtgatgttatatttgctggaggaggtgtgtactgccttcctgatccagcttctcccacctgtctgggagagcgttacctatgggatggtcctgcagagagagagggacctgaacactgcagctcgcatcggccagtccctggtgaaacagaacagtgttttgatggaggagaacagcaagctggaagccctgctgggctcagccaaggaggagattttatacctcagacaccaggtgaacttgcgggatgagctcctccagctctactcagattctgatgaggaggatgaggatgaagaagaggaggaggaagaaaaggaggcagaagaggaacaggaagaagaagaagcagaggaagacctgcagtgtgctcatccctgtgatgcccctaagctgatttcgcaggaggcattgctgcaccagcaccactgcccacagctggaagccttgcaggagaagctgaggctgctggaggaggagaatcatcagctgagagaagaggcctctcaactcgacactcttgaggatgaggaacagatgctcattctggagtgtgtggagcagttttcggaggccagccaacagatggctgagctgtcggaggtgctggtgctcaggctggaaaactatgaacggcagcagcaggaggtcgctcggctgcaggcccaggtgctgaagctgcagcagcgctgccggatgtatggggctgagactgaaaagttgcagaagcagctggcttcggagaaggaaatccagatgcagctccaggaagaggagactcttcctggtttccaggagacgctggctgaggagctcagaacgtctctaaggaggatgatctcagaccctgtgtattttatggagaggaattatgagatgcccagaggggacacatccagcctaaggtatgattttcgctacagtgaggatcgagagcaggtgcgggggtttgaggctgaggaagggttgatgctggcagcggatatcatgcggggggaagatttcacgcctgcggaggagttggtgccccaggaggagctgggggctgccaagaagcagctggccaactggcaagatgcccattacaggcggcagctgaggtggaagatgctccagaaagagccccagccgtggacctaagatgggtagagaaaacactttccctcctctacagccctcaggtggcgggtagctcaaggtaatggtgtcaacaggcacaagaacaatgatggaatggagtgagacaccagcaatgcctgcatcagccactcatgagcaattatttacaaatatttattgggttcctcctattcttgccaccggtgatacagaagggaggagggacttgtcacgctcccagtttcctgttttgcccgagaggcagacaataaactggcaaacaaaaaaaaaaaa

SEQ ID NO: 548570 - DNA, 327 bp, Homo sapiens
acggagactgcaggtggtataaggtgctcttgtgagcacggggcaggagttggaattagttgctccctactgtggccgatgaggttgtgaacccctccccccaacttttcatgtttcttaaaggcattatggtttcttaaaatctgtacagcaagagcaactttttctgtcaaataaaaatgagaaatgcaggaactgggtctgtagactgtttattaaaggtgagttaaggtggcagccacttccctccgtgattacagcccccagcgtgggaggacctgtgtgggtccagcttgtggttccctcattgtacatgctgtcaaacca

SEQ ID NO: 548571 - DNA, 446 bp, Homo sapiens
ctcgtccgagcagatacgggaggactatgtacatggccagttctaggcagtggcttaagagctctgcccctgcagtgccttcaactttgtctctgtttccttatcaacagaacagatagtagtaccacacttcagggtcgaataaagtaaataaagaacaaaacaacggctgggtgcggtggctcacgcctgtaatcccagtacttggggagattgaggtgggcggatcatgaggtcaggagtttgagaccagccttatcaacatggtgaaaccccatctctactaaaaataacaaaaattagccaggagtggtggtgcatgcccgtaatcccagctactcaggaggctgaggcaggagaatcacttgaacccgggaggcagaggttgcagtgagccaagatcgcgccactgcactccaacctgggtaacagcgagattccgtctc

SEQ ID NO: 548572 - DNA, 153 bp, Homo sapiens
  misc_feature (16)..(16): n is a, c, g, or t
  misc_feature (22)..(22): n is a, c, g, or t
  misc_feature (24)..(24): n is a, c, g, or t
  misc_feature (39)..(40): n is a, c, g, or t
cttactctgtacacangtacantnaatcccgagtatgtnntcgaatgcttgtgatacatcatgtgttaagatacggacaatttatatgcctgaggaccagtcctgggtcggtggtgtggcctggctgctgcctctgcttggggactgactggg

SEQ ID NO: 548573 - DNA, 389 bp, Homo sapiens
tctcccctccccccttttaaccatttcccctgcggaggcgcttccccgggcagggcagagccggtctcacccccggttttccgggccggcggctatggaaggaagcttcaccgggtggggggctggcggggggttaatcgtggcacctaatttcggttgaaggcgcagcctcatggagtgtgccgctgcttgttgacgtttcccgccttggagccaggcattgccgtcttgtgcactctggtgcccccccggtatcggtttgtcccccctgtgtttcgtcgcactctctcattgggtgcagtttttagtacacggcgctcccccgatctctcgggcgcgccttttttaccaagtggacgtgctatcggcgcctgggaataacccggtct

SEQ ID NO: 548574 - DNA, 272 bp, Homo sapiens
tgagatggagtctcgctgtgtcactcaggctggagtacagtggcgcgatctctgcttactgcaaccttcgcctcctgggttcaagcgatttttctgtctcggcttcctgagtagctgggattataggtgtgcgccaccacgcccagctaatttttgtatttgtagtagagatggggtttcaccatgttcgtcaggctagtcttgaactctattctattttaaggacaggttgtgaacctgacctcgtgatccacccgcctcagcttcccaaa

SEQ ID NO: 548575 - DNA, 205 bp, Homo sapiens
  misc_feature (93)..(93): n is a, c, g, or t
  misc_feature (144)..(144): n is a, c, g, or t
  misc_feature (157)..(157): n is a, c, g, or t
cacctggctaatttttgtatttttaatagagacagtgtttcaccatgttgcccaggctggtctcaaactcctggcttcaagtgatccgccctntttgtcctcccaaagtgctggtattacagacttgagccactgcgcccagcntacattgtttagnttgatcattcactttacttattggcatttgactctttgcaagtatctt

SEQ ID NO: 548576 - DNA, 820 bp, Homo sapiens
gattgtaagtagagtattccacagaaagtggtaatcatctcgtgctctctgacctcgattatgaaaatgtaggtaaattgaagtaggattgcctatagatgggagcatcgagactacttattaaatacacacatgagaagtgatcgaattagaagaagagtttgtctaaggatcgtgcattgttattctgacagatttattgattaacagtgaaggaatttttaaagaaattcgttaatgaattgttcggtcaggtcagttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttctggatcttatgatgctgagcatgttctgcactggtgctaatgtctaatataattttatatttacacacatacgtgctacccagagattaatttagtccatgtgaactaattgacccatgtgttcattgagacagcaacatacgcactcctaaatcaggggtgtctagacttttcaagtatctaacctcatttccaaacatgtaccatgtcttcataaacctctggatttccagcaacatactatagaaaacactgctactcaaaaacaaattctcagtgtcatccattggctgtcggtgagaagacaactagcaatatctgggtcgg

SEQ ID NO: 548577 - DNA, 300 bp, Homo sapiens
actgactatgattagaaatgaatgtccactacgtaatactatcacatacaataaaaataccaatgcagttcatcctataagtggataaactctgcttcccaacctcactctgagcggggaaagccctcctcagctcactgtggatctaatttacatcgtcctcacatacctcgaaggcacatgtgtcacctacatggtgctctccatgcattaaacacccaatttcatccattgcagcaattaggtgggctcacttagcaagagatagatcacccggggaagcactaagcgagggtgggc

SEQ ID NO: 548578 - DNA, 149 bp, Homo sapiens
gaccctatgagagcaaggacccttaggtatcactgttcaatgattcagagctcagctgggcccccaattccagacaccagcatttccggtcactccctccctaatatgagcatcactcaagctttgtattaaactcaatttggcccaga

SEQ ID NO: 548579 - DNA, 528 bp, Homo sapiens
tcgcatgtaccctgaagcacaccaggtggtggacgtgccgtgtcctaatgagctacgcgtggcttagagagtagaggttggggtctatgaagcccaactctggcttaaagatcttggtgggggtcggtcatgttctgaggccttggaattagcctcttcctcattatggagctgattttctagtctgtggatcagctatgcttttgcacacttctcttttccattgtgcctatggaatgttgtcttctcactcgggcatcagcagttcgatctaaatgcagactagggagttgggaggaggaactaaagtgaaccatccttcatttattcagtcattcgttcatctgtcaaacacgtatttggaggtcaaggttggcgagatgaaccaatgctgggttccatctttggggagttcaaaacctaggggagagacacattgtacactcgtcacacatgtagggcccagttagtgctgcagtaaaggtactaataacatgttccttggagaggaagaaaaaccacgaaacc

SEQ ID NO: 548580 - DNA, 164 bp, Homo sapiens
atgggttttgctgtgagctgggtgaagcccgtgactgccatctttcccccacctgtctgacaacctgcatgactcagcagaggcagcgataatcctcctaggtacactatctccagtgacctgagaatctcacccccatccccaacagcagccacagcaagaca

SEQ ID NO: 548581 - DNA, 503 bp, Homo sapiens
caggcccagctttcacccatccccagcttcctgaagctctacccaccattgcctgtggccaagctgggtggcttcctggacctcacagagcaggagttccggatccagcttcttgtcttcaaacacaagatgaagaacctcgtgtggaccagcggtatttcagccctggatggtgaatttcagtcagcctcagaggttgacttttacattgataaggacatgatccccatcgcggacaccaaggtcgccaggggttatggggattttttcatccgtcagatccccaaatttgaggagctttatcgaaccctgaagaaaatggggcagagcccttgatgatattcccccccattcaggaacctgtttttatgtattataggcaggaagggtttttgctcccgtgaaacctttacctagatcagccatcagcctgtcaactcagttaacaagttaagggccgaagtgtttcaagtgggtttcagtaaaggatttttggagccaga

SEQ ID NO: 548582 - DNA, 205 bp, Homo sapiens
aatatggacaactgcagagacaaagatatgtgccccgtcagccactatccacagccttttgtgttccgagttgcatatgttggtcaattataggagctcaccaaagatagaggccctttatgaaaaatgaccctctattttttttcgttcccaaaaagggttcccaaaacctccccaacataaaaaaaaaaacaacacataaaaa

SEQ ID NO: 548583 - DNA, 125 bp, Homo sapiens
aatccacacggatcccctcttctccgaaagcacttctctgtggtgccggccaccgtctccagtggctatggcggtgccagctggtgtcggcagtggccttaggcctggcgtggtaggaacgcacg

SEQ ID NO: 548584 - DNA, 1268 bp, Homo sapiens
gcggtgttggtggcagcaggcgcagcccagcctcgaaatgcagaacgacgtcctggcgagattcgtggacctgttacgtgccgcggaaatgctccgctagcaatcgcatcatcgtgtgccataggaccacgcatccatccagaataacgatgagccgcagtgttgacaagtgtctacggtgccaggatttaaatggccagttttaacaacttatgctatctgcgaggagtccattgcgttaggcatgggtgagtcagatgattccatttctccgaattggccaaggctctgattggcgatctgtctcgacaatgaaccttgttggacgtcggtacgcagaatctacacgatgtcgtgcacatcattatgtcccatgaacataaattaagtgacagacctcatgaaacaaagcattataggactatagagagcccaataaagagatggtagcagtacaccagcgcgaagggcaaaactctatatgtcgtggtcgtgacggcgatagacagaagatgtgtgccagggaccgatgagtgccccggttggcgcgctttacgcgaggttactccccaagtaattgccaagaggaactttgtctattgggaaccaaggcaagcgcgcgttagacataataaccggaaggtccatccactctttcctgtagggacggcgggccgttattctgatatgaaacctataacggaatccacgccgcaaacccgttgtggtacacccatgggaggctattgccataggagaccccagcgcggaacgacaaagagccccaaccagcgggtccaaattggcggcgcacctttaaagggcggtaccgtccatacatcataataagggaggtatcctattacattaacggggggcggccccttccaaaaacggggattcccttcttagccactcggttttggccaatttaaggcgcacttatgccttcgcaacgtttaagaagcccccccatcgattgggctggccaacagttacacacgcttaagttggcagctatccaggaccgcagcgtgggcgcccactattcagtccgttggcgtcgtcgtcggggtgcgaacccaagacgaaaaagagctgtgttttcatagatcactttaaaaccttagggcgtttactcgtacagacaccaactctgaccccctttgttgtggcacacagcagggtttagcggtatggaatcggatcccgattcaaaccgtggtgaccccttaagattcccccacccaccttacacgattaacccc

SEQ ID NO: 548585 - DNA, 342 bp, Homo sapiens
ctctaccacccactagatgccagtagcattgacccctgatctatctacccaagttgtgacaactgaaaccatctctggctaatggaggaaccttaaatgcatattgctaaggaaaagccaatctgaaaggattacatattgtatgagtccaactatatggtaatctggaaaaggcaaaaccatggagacagtgaaaaggtagtggttaccagtggtccatgggaagggttggatgaataggtggagcacagaggatttttaaggcagtgaaactattctgaatgatactgtaatggtggatacatgtcatacctttgtcaaaaccaataaaatataacaacc

SEQ ID NO: 548586 - DNA, 1180 bp, Homo sapiens
  misc_feature (273)..(273): n is a, c, g, or t
agcggcgtgagcagagtactgatggtgtgcgtgtttgtgtgtgtgtatatgtgtgtgtataagatgacgaaagagaaactcgaaaacgacgagagaaattccaaacttgtcttcgttttaccaggattaatccaaggacgcatggttacaggaaccctgatagttggacgctctaatcgtagaatagctgcgactagatctcactaggtagacttcagtgatgctataagtcgtgtatcatgtgaacactccacgaactgtaatatactagancaatataagggagagataggagataacgtgagatctcttccttgaatactatggagactaggacgcaagaactaaatcaacctcgacttttagtttatccccaattttgcactgtggtttagcaatatagtataaatactatcgtcgagaatccaaatggaggttaccacggggccttccggttttggctacgctaatatttggttccccctgccatgtgaaagtgttgctatagccatggcccatgtttggcagaaaattatttccacgtaagtaacgcggtcaccggacttgtttatagcggccatggcttggatatgggtacgaacgccatggatttgttgcctcctcttctccaatcgggcacacctaatacaccgaaagacgaggcccacacggaaagacggagagacaccatgaacgcccaagcgcgaactccagaatatatggcttacctttgcaaacggtctggcatgccaaaagcagagccgagcccttggactaaggtctatacagatacgaaaaggcctcctttcccagattgaacttgaccccccgaaccattatgtatgcagaaaaacacaaagatcagaagaagtgggccttcacaagaattatagcggcatgtagagaatacctaacggggaccaacattaatataaacgggcaccccctttgaacctccgctttacatacagaagatcagtcgagtgaaggaccacccgggtgatgaaaacccaaagacgactttgtcatgagaactaccccgtctatatttgctcgtgaatagaggcggttaaacaatctctctccacaaccgcttgtcggagcgtgacatacattacactgtgacgagctctacaacgaacgcgtgtgttacttccccatgtgagttttaaacacaagt

SEQ ID NO: 548587 - DNA, 1431 bp, Homo sapiens
agcggaggtacgccgggaagtggcatatctgcgcaggactcggaattgcgcgcgacgcagcagaagccggcgcccctcgggagccgccgggaccctctgcgttgtcgccggcgacggcgccccatagtccccgctgccaatgccgattccggacgtagagaccattaccgcctcgcgcgacccgtcaccattcgaagcacatagcagtaggatcctacctgtcctgatcgtgtatttcggacgatgcaggtcagtccagaccgaaaaatccacagggtcgattaagtacgatactgactatcaaggggtttgaggaatacgccaggtctatgccccttgatatacctagagaacttgatataccagaactgtctctcgtctgctaaccattgaacctcattgttccgatcagtcgagctagacgtcttcatctgagagtaatagtaaagaatagggcgctccaccagcgtcaattggcctacattcagagccctttgtttcatggttttcgggtcggaactgtttacgagcccaagcgagttgtgctccacgcaagctcaatccaacatcgcgaaacttcatcacatgcacgtgtcgattattagacagaagcatcgacggcaatagggatttgtaatccaatttggggtaattatccccattgataacgcctttggtggggccgtaatcggcacttccctagtaaggggaacgtaccctgatattcccgtggtggaagtaggcaactcagtttccgcctacctgggaattcggctttaaaagaaaaaacgcacctattgttacacaacattcgcaattgggctatttccttgccattattaccttgagggaagcagtttgggtgtgcggtgaagataggcgcccgccttgtttaaacccccaggattgtgggcccacacacatcgcgccacaaaccgggggcggttcgggctcttaatccccaaaatccagtgggaacggacaattccggggcagcttccctaggctggttacccacttaccccccatttttcgaagccaaggcaaccttggcccatttggcatctactaccccaggcctcacagtgtttgtgttctccccccctatatccctttaggtggaaaagcctgggctatttctgcggaccactggcgtctttagccccgggcttttaagggagtgacactacgttcggacagcgaacccttgttcatgggacaaacaactctttgtgagaaacggcgtccctcccaaattgtttggaatggcccctacccaatattcttcacatagccccgcttggtatgtgtgtgcaccacacacggttaaacctatttttaatggtcgcttaacactggggttttaggggagccactgaagatcgcccccaggcgtttgtgggacccaatacaacagtttttttgtcccca

SEQ ID NO: 548588 - DNA, 117 bp, Homo sapiens
actggagaacgcggttgtatgaccgcagaaagggcagagctgagcgtatgacctgtgtcgttcccctccagaaatacccgcagccaaaggcagaagaagaagatcgtcaagtacggc

SEQ ID NO: 548589 - DNA, 184 bp, Homo sapiens
tgtctgttactgaggaccggataagcgacacctcgtgtatatgctccgaggtgtacaggcactagtaaagtctggtatactcaggacatccttctgtgccaactcacgagggacaatgccagcatcaggcccattcagtaccagactgcgcattgatgaacaccatctgtgaaacagcaccatg

SEQ ID NO: 548590 - DNA, 193 bp, Homo sapiens
tgtcatctctgatacggcacaaatccacttcctctcagtgtagtgccaggcactacaggaacctttgtcattcaaataggcacactctcctgctcccaggctaggaacactgcaagagcaggcgcagcacaccagtaggccactgcaacatttcttccaacagcagcacgcagtgacgatgagcaacaatgca

SEQ ID NO: 548591 - DNA, 404 bp, Homo sapiens
taaactaattattggattcggtttaacttaagaacaggtctaaatatgggggctattggagggcaaatggaaagactggggattactctctggtgatctggtggacagttgggcacagggtaacatttgggacatgtgtctcactcttatatctctttgaggagaggagaaaatatcacttgtgcgcaaaaatattacattactttcattagaccacgtgagttcatagtttttattcacactacaacattctctttaacgatgtggcaggtattctcaatttccttttaagaaaaatgaaatggtgaggagaattcgggtggtaatagatgacagtacatatgatctggcaggttggggcatatgctttcatcattaaattatctgataaagttacaagtcac

SEQ ID NO: 548592 - DNA, 737 bp, Homo sapiens
aacatcgacggacgcatcactatttatcctgatgctctccctcactctgccccctttacaggatccaggtgtatgttctcctccctgtgtacatgcgttctcattgttcagctcccacctataagtgagaacatgcagcgtttggttttctgatcctgtgttagtttgtggaggatgatggctttccagctccatgtatgtccctgtataaaacatgatctcattcctttttatggctggataatattccatggtgtatatgtagcatattttcttaatccaatctatcattgataagcatttaggttgattccatgtctttgctattgcgaatagtgctgcaatgaacatacacgtgcatgtatctttatagtagaataatttatattcctcttagtatatacctagtaatgggattgctttgtcaaatggtctttctggttctaggtttttgaggaattgcacactgtcttccacaatggttgaattaatttacattaccaccaacagtgtaaaagtattcccatttctccacagcctcaccagtgttcgttgtttcttgactttttaataatcaccattctgataggtgtgagatggtatctcatggtggctttcatttgcagttttctaatgatcagagaggtggagtttttttcatatgtttatgtggcacataaatatcttatctcgaagaagggtctgtcatgttctttggccactttataatggtttgg

SEQ ID NO: 548593 - DNA, 211 bp, Homo sapiens
cctggtttttagagccatgaacacagacgaggccatggtgatgctcacggtggtggcagtagcaaggacaggtatgctcctgggcattgaggttgataaccaatggtgctgcactgtgtggtcgacttgccgtcctgggcattggatccagtgacaagaccatacttcctcgcttccaccagcaagagaggtgaggtccatgccttggtct

SEQ ID NO: 548594 - DNA, 377 bp, Homo sapiens
tatcttatcagtttttaataagatcagaataggtattagactacctaatcagttttgattaaggagaaaatgaaattgtgttgttcacactttatccaagattggtgtcatatttgctaaatcaaatcaatacttgaacaaatgcaaaattagggcttatcatgaaacactatgtcattcttgaagaagatgccttttttatttttattttttaaaggtggtgtcttgcttttgtcgcccaggctggtgcaatggcgtgattttggctcactgcaacctctgccttctgggttcaagcaattctcctgcctcagctacttgggaggctgaggtaggagaatcgcttgaacctgcgggacggaggttgcaatgagctg

SEQ ID NO: 548595 - DNA, 435 bp, Homo sapiens
tagaggatccctgcttctaatccagtgtggacctgggacacacatgtctgagcctctactactacaacatgcaggtttatgcgttagagagtccaccttccagtgtagagacgtaactgacttttgtcaatgctgcgtgaggaacatatgaaggtcatccgggagagatatgatagtaagtctctggagccagcttctagagggtaggaaagacaagatgttcttattcagaatgactgtcaagacaagcaattcgtcagtttcactgggtatctgcaagtgataatcgattattctaatctaataagacaagtttgtggaaatgcaagatgaatacaagccttgggtccatgtttactctcttctatttggagaataagatggatgcttattgaagcccagacattcttgcagcttggactgcattttaagccc

SEQ ID NO: 548596 - DNA, 913 bp, Homo sapiens
tccagaggcgccagtggaagctgcggcggcggtgttcgctgttcggcgggatttctcttcgctccggcggcggggagctggcgctggagccccggtggccgccaccgccccggcccccaccgtgcacaaagcgaagaagtgcagccccgtggctgcggcctggctccctggctgcgctggacaagaagccctgccagggtgccagaagcctggagcagctgctctgcacaatgaatggtgctgctgtgcgccaatgaatgtgacaaatgtgctgtgcaatggccaagaaagactggccgtgcctgcctggtgggcaaatgaaggtgtgaagaatgggctggccaagcccagctgtccccaaatgtgccctaaggtgcctgcaaaggtgaggcgtgtctggcctggtcagatgctggcctggcgtgggcttttcggtgttttttggtttttctaccccaatgtgaccgtagattttgtacgggctcacgcctggccggggcctgcgatggcctggtcttgagcctcaggggatgggggccccgggtcctctcagtctttcccctcccccaacgatgtaagcgtttcgttgttatgctttagggtttttgaaacagcccccggctgacgcctctattggctctcggcttggcaaacggccgtcggtcatgtttacttggccccctaggctgccgatgcccgagtcctgtgcctgccccaccggggcgggggttcgcttggttggccggtgcccaggctgcgcggggactccggaagtgccggcgcattcttttcccaggttccccaccctcctttgccttttgggtttcgctacaaacaatcgttccgggctcaggctgcgcggtcttccttcattccattgggcttttttgggccaataagcgttaaccttttc

SEQ ID NO: 548597 - DNA, 383 bp, Homo sapiens
cagaatggattgaactaatagaaaacaagtataatttttaacctttttgcttaaaactttggtgatccttgctttgtttttctgagtcaagaatacttattttgaactatttaaagcctttaataattgagtaaactatacacctgtgaacaaaatttgaaggatgtttgtttctctctgcctggctttgccagaatttggaaactatttgtgagaatatttaatttatggcaattcagttattttcatcagtgcaataagaatacattttcttttgcaacaggacacaattgaagaaactggtggttttaccaaggcttttactggaagggtatatgttcctttaagtcattaagctggacttgccaataaaagttccttgg

SEQ ID NO: 548598 - DNA, 170 bp, Homo sapiens
tgaccaagtccctgtaaatgggattgctatggctccttatatgatatcagttgctctttttgttgctgctatatctaccaatatgatttttgctaagttgccttctggacgtcatccagagagtcgttgggcttggttgaagtctcgctctgaaataaatgggattatag

SEQ ID NO: 548599 - DNA, 216 bp, Homo sapiens
  misc_feature (38)..(38): n is a, c, g, or t
  misc_feature (40)..(40): n is a, c, g, or t
  misc_feature (49)..(49): n is a, c, g, or t
  misc_feature (55)..(55): n is a, c, g, or t
  misc_feature (204)..(204): n is a, c, g, or t
gagaaggctggagaaaaaccatccacacataaacaatngnatttactcnaaaatnaagtacaggtttcaggtatttaaaataaataaagaaaaatctcgtttcctttggcatctttagaaaataaactaagcaataaaagaggtgattgtataaagacatgcgtaagcaaacatatggggaaaaccagcaacttggttttatgngataatatcagc

SEQ ID NO: 548600 - DNA, 938 bp, Homo sapiens
  misc_feature (36)..(36): n is a, c, g, or t
  misc_feature (67)..(67): n is a, c, g, or t
  misc_feature (87)..(87): n is a, c, g, or t
  misc_feature (89)..(89): n is a, c, g, or t
  misc_feature (95)..(95): n is a, c, g, or t
  misc_feature (112)..(112): n is a, c, g, or t
  misc_feature (125)..(125): n is a, c, g, or t
  misc_feature (130)..(130): n is a, c, g, or t
  misc_feature (135)..(135): n is a, c, g, or t
  misc_feature (141)..(141): n is a, c, g, or t
  misc_feature (144)..(144): n is a, c, g, or t
  misc_feature (152)..(152): n is a, c, g, or t
  misc_feature (154)..(154): n is a, c, g, or t
  misc_feature (157)..(158): n is a, c, g, or t
  misc_feature (176)..(176): n is a, c, g, or t
  misc_feature (188)..(188): n is a, c, g, or t
  misc_feature (190)..(190): n is a, c, g, or t
  misc_feature (242)..(242): n is a, c, g, or t
  misc_feature (284)..(284): n is a, c, g, or t
  misc_feature (334)..(334): n is a, c, g, or t
  misc_feature (338)..(338): n is a, c, g, or t
  misc_feature (371)..(371): n is a, c, g, or t
  misc_feature (373)..(374): n is a, c, g, or t
  misc_feature (392)..(393): n is a, c, g, or t
  misc_feature (419)..(419): n is a, c, g, or t
  misc_feature (424)..(424): n is a, c, g, or t
  misc_feature (429)..(429): n is a, c, g, or t
  misc_feature (437)..(437): n is a, c, g, or t
  misc_feature (444)..(444): n is a, c, g, or t
  misc_feature (481)..(481): n is a, c, g, or t
  misc_feature (486)..(486): n is a, c, g, or t
  misc_feature (490)..(490): n is a, c, g, or t
  misc_feature (499)..(499): n is a, c, g, or t
  misc_feature (513)..(513): n is a, c, g, or t
  misc_feature (532)..(532): n is a, c, g, or t
  misc_feature (712)..(712): n is a, c, g, or t
  misc_feature (839)..(839): n is a, c, g, or t
  misc_feature (876)..(876): n is a, c, g, or t
  misc_feature (929)..(929): n is a, c, g, or t
  misc_feature (931)..(931): n is a, c, g, or t
acccccgccgcgtcgccgccatgacgggctagcacnctctactccggggtctcgtgccttctgggcngcgcgctgccgtggtatctncncccccnttttgtattgggctccncttgctgtggtcnggttnctganggagantcnccctttcngnggnnccaactggggcattggcntagctatctccntntctgtggttggggcagcctggggcatctatattaccggctcctccatcattnggtggaggagtgaaggccccccaggattcaagacccaagaancctggtcatgcatcattctttctgtgagggctgtggccattctacggcantcantcattggcaatttgtcattaggcaacattggcntnngcctttcatgtgccacanncccccaagggccattcgggccattcnggacnaccantgcaggcnactccantgtttggggctggcctcacccgtaaggcctgtctaancctcnttcntgtgaaggntctgcggtgggcantcggtgggcatgtggggcntgcccctggccgatgctcagaaccccagcctctttgtaaagattctcatcgtggagatctttggcagcgccattggcctctttggggtcatcgtcgcaatctcagacctccagagtgaagtgggtgactagatgatatgtgtgggtgggccgtgcctcacttttatttattgctggtttncctgggaagctggagctgtgcccttagcctttcagaggcttggtgttcaggccctccctgcactcccctcttgctgcgtgttgatttggagcactgcagtccaggccgagtcctcagtgcggggagnaggctgctgctgctgactctgtgcaggcgcacctgtncccccacctccaccctcaacccatcttcctagtgtttgtgaaataaacttggntntgtctga

SEQ ID NO: 548601 - DNA, 143 bp, Homo sapiens
agtatctagagatcccacgcgacggtatcaagtagaacgggagatgggtggcaggtggctctggaagagctcaccagcacagttgccctgagctcggtgcttggtttctgtccctggggatattatattaataactttttata

SEQ ID NO: 548602 - DNA, 310 bp, Homo sapiens
aacatcaacacaggatgtatctatcacatcctgaggaccacataacccaccagcaagtctccccactgacacacattcacgtaggtccatacccattcagagtcctaaagggttaatgagaagccacctcagcttggtgcatggagccccagccccaaatacactccccttgacaatatgggacaagtaaggagcgtctgatggaggcaccaggacaactacacacaaccacttacccctcaagacatatagacaccaagatcaggacagaggatgcatatgccgaggggtcggcggtggggctcctcta

SEQ ID NO: 548603 - DNA, 158 bp, Homo sapiens
attctccagacctccattctcccgagttagctcggatttataggttgcccgccaccacgcctggctaatttttttgatattttttggttagacgacggttaggggatcccttcttagagttcgaccttgcagtgcattgctaagcctttggcacttgg

SEQ ID NO: 548604 - DNA, 271 bp, Homo sapiens
cgcgatcggcgccaagaagatcacctacgccgactttgacgtctacaccgatgccataggacaacccaggaccgcgcagtacccgatggatctggagtaccggaacctgcctgatgacctggcggcaggggtgagctgggaagccgcgcagaactactgcggttgggttggaggactgatcggacgaaagatggaactgccgacggaagcgcagtgggagtacgcggcgcgtaatcgcgggcagttcatcatctggcccaccgatgatggc

SEQ ID NO: 548605 - DNA, 684 bp, Homo sapiens
ttgatgagctctgactatctaatattgaccggcctgccactgaaggggggggctaagcctaattagtctcaaatctccaaacacatatggctagatacgtacataactaaactatccaatgctaaaataatcgtcccaaaatatatactaccactgacatgactttccaaaaacaccataatttgaatcagcacaaacacccaccagctaattattagcatcatccctctactatttttttaaccaaatcaacaacaaacctatttagctgtaccccaaacttttttccctacagaccccctaaaaccccctccttaatactaatacctgatctaccctcacaattcatggcaagcaagccacttatacaggtggagcactatcacggaaaaaaaatctatcctgcttaatgctatcttccctacaaatctgctttattataccttttacagccaggaactatcaaaattatatctctgcgaagaacattttcccgcttgttattataacccgtggggaacagacaaaagctgaggcggatatacttttaaacctgtgtccctcctctcattgagtatcaacctagtgcaacttaacctccgcggaataaccgcactatggactcaacttgagacttggacatgctacgtgccggttatggaacatgtttatcccaactgcaac

SEQ ID NO: 548606 - DNA, 440 bp, Homo sapiens
tctagtcctactagcatctccaagcggggatttccccttgacgccttctcccacacgacccagcccctctcccctgccccaagtccccgagggaggtactctggagtagagcagtagcccctgtgggggagcctgtaaatgccggctcagtggatcactggtgactgggctcatgcctccaagtcagacgtttccctggtgccccacagacaggagcacaagtgggatctgacctggtgagattatctctgatgacctcatcaaaaaataaacaattcccaatgttccaggtgagggctttgcaaggccttccaaacagctccgtcgcccctagcaactccaccattgggcactgccatgcagagacgtggctggcccagaatggcctgttgccatagcaactggaggcgatggggcagtgaacagaataacaccagcac

SEQ ID NO: 548607 - DNA, 119 bp, Homo sapiens
ttgacctacacgaaactatacagacatccttgctatgtaaaagcaagaaaataaagttcatttacacaaatatttcataatgatcccatagagctcatagagcattctactgcagcaac

SEQ ID NO: 548608 - DNA, 317 bp, Homo sapiens
cattgtctgtacttctagtagcgacaggtgttgtctgccactgtcgggcaggctggtttcaaactcctgagctcaggtgatccgtccacctcagcctcccaaaatggtgggcttacaggtgtgtgggccaccgtgcctggctgattcagcattttttctcaggcaggaccaggtggcacttccagcgtccagcctctggtcctaccaatggattcatggagtcgccgggactgtaatcatcgtttgctaaatgtacaaattcttaataggctagacttagattcattaaactcaggatgcttctggacgggtaccga

SEQ ID NO: 548609 - DNA, 161 bp, Homo sapiens
agtctgtgccaggatggagagctcagatcttctgacgctttttatttgagatggagtctcgctctgtcactcaggctggaaaacagtgagggtgatctcggctctattgcaaaccaaccaccccccagtttgagcgatgctcagccaggtaccgagctcaa

SEQ ID NO: 548610 - DNA, 1355 bp, Homo sapiens
  misc_feature (397)..(397): n is a, c, g, or t
attgacgcgcacggtcggggcacagcaggcctggggtgcgtgcacactggctcgcgacctcctctccgcgccgccgtctccctccggtccccggcgaaagccattgatgacaccagctggagcgtcacgcgccgagagcatgtctggagaaatcagagcgaggtggctccatcccacgcatagatccgcggacgccccgagatgggacgggacttgcggcccgggtcccgcgtgctcctgctcgtgcttctgctcctgctggtgtacctgactacagccaaggcaaatgtcaaccgacgggcagctgatcgagcttgcgaatgttgtttactttgttggtaacaagaagttatctttccggacatccccgggcaatcagagtgcgaggctatcagtngaactcagtcatccgaggcaaaggaccgtagagaaagccttaccactcaggttgtcgtatacatagcagcgaaggttccgacgcacctgttcccgtggaagctgttgttgtagcgagtgggcacacagaagggacgccgatggcgtttcctgagacattatgataaaagacgttgtctttccatcgtcaacaatgaactcgtcgcgacattgctttacctccgtgcggcattaggtgagcccccacccaatgaataagccaagttataccatgttccaccttattccgaaggaacctccgcccaaagtttggtgcgtttcaagggtggcccctccaaggaacgtggggcgacactacgtgatccgagggagataattcccgagtcaggcgcccagcgttgggcgccccgatgaattagccaatcgcttaggtccgcaacccttttggccatgttcccaactccagtgttggcccgtccgtaggcgccgttcacccaaggattaaggggaaattccgatcgttgggtgcccaatcgggggaagccagacaggaacaggcggtctcacatatcgtggttgctcgaggatcaattgaattaacgcggagcgcgagtatacgaaaccacacatagggcgcggggccctcgagacaacggccttttgggggctagggcatttggggcgccccctaatggaggcgggctttagacgagcggaaaggaacaccccgaaggaaaaaggccagcgcctctgggcggacggataaacaaactataggaccgtggtgtacaccccaaacaatggccctatgcggggacacagtttcgacagcagcaacgatgcagaggttgtggccccaacatgttacaccgtagaggagggagcactagcacgtgggtgtgccacacattaccgagcaccgtaccagtgcccgcttcaaaacccgggggaagagcccc

SEQ ID NO: 548611 - DNA, 244 bp, Homo sapiens
cgggtatgtggttatgctaggtgtggtgagtaggggatgtagggttatgccagagtttcatgggtaggggactgtatggttacgctaggggtcatgaatagggaactgtaggcgtcgtgaggtaggagactgtacggattactcctgggggtcgtgacgtacggggactgtagacgtaccactaagatgtggatgagtacggggacctgtacgggttacagctggagggtcggtcggaaggggg

SEQ ID NO: 548612 - DNA, 518 bp, Homo sapiens
  misc_feature (73)..(73): n is a, c, g, or t
  misc_feature (82)..(82): n is a, c, g, or t
  misc_feature (122)..(122): n is a, c, g, or t
  misc_feature (180)..(180): n is a, c, g, or t
  misc_feature (186)..(186): n is a, c, g, or t
  misc_feature (328)..(328): n is a, c, g, or t
  misc_feature (414)..(414): n is a, c, g, or t
  misc_feature (458)..(458): n is a, c, g, or t
atttatgggcatggaggaaaaaatgtgagataaaattgctgtgcagaaaaaagtgttaatgaagcgacctgantacttaacnttagagacttgctttacaaggttggcccttgattggcatntgggaacttggagttcagggggcttccaccattcccagaactgatcaaagtagcttantatatntaaactgtaaaacaatatagtttctcctgaacacctgctttccttctgggagtctggaattttggtatgtgccaggcagagactacctttgtgaccagctcccagtaaaaaccccaggcactcagtctctaacaagcttttntggttgacagtgtttcacaagtgctgttacaactggttgctgggagaattaagctcatcctctgtgattccactggcggaggattnttggaagcttgcacttagtttcccctgacttcaccccatgtgtnttttttcctttgctgattttgttttgtatcctttcactgtaataaatcatggccgtgagc

SEQ ID NO: 548613 - DNA, 238 bp, Homo sapiens
ggccggcaccggcttactggacttctgagggggcacgggagggacagcatcaggaagaatagctaatggatgctggacctaatacctatggttgatctgtgcagcaaatcaccatggcacatgtttacctatgtaacaaacctacacatcctgcacatgtatcccagaacttaaaagtggatgggaaaaaaataaataaaaagtatatgtaagaagatagctagaaggtccaggtatg

SEQ ID NO: 548614 - DNA, 335 bp, Homo sapiens
tgcttagaggatccctgaatcgacggttttagctgagccacatggcccgccgaggtagagagaggggtctttacatgccccaaaagcataccactaactgtggctcgattacatcatggtcctcttcccaggagagagagggagtggggcagagcaaagcagaccccagtacttggctgttgttccaggactaataccaaattgtgtaggcaggaaagagcgagtggcaagggcgggagcaatggcaggccaagtgggcaagtgaagtaaaatgcttaaaacacctgcagtcctgggctggtctggcttggccttctgctagctatggggacaaa

SEQ ID NO: 548615 - DNA, 317 bp, Homo sapiens
gattgcgagcggggcactcacactctattctctaaaggaagagaatgctctttccttttcagtacagccaaagttcattttcaaagcatctgaattcctaagtatccttttttgaccatcgagagcagcatacctcttgcccggggtccttggtcttggaagggcctcgtccatctgatggggtggtagatatagaagagtgcacttttgaaaagtgcactcttctatatctacttgatacccaactcatctctcatttatttccggcttcttttattccaggcattatgtagtgttacattttccctttctttttc

SEQ ID NO: 548616 - DNA, 362 bp, Homo sapiens
tggaataaagcctttgagcttgatttcctgggggaagcattttcccccgaaccttggcttgtccgggtttacaaggtaaagggcctgggtaatcggggcttttcaaggacctaaatttcacgtcccgctttgattttctttgcactgggcccctcccattttgggccttgaagattttttttttttttttttttaatatgccgtttgtaagaacaaaactggatggcctcagaattgtttggaagttttgtcttgggccgtttgggctgggccaaatgaaatgatttttataattctaaacaggttcccaaatgaaatgtcctggctttactttggtcaattaaaggggggaatttttttta

SEQ ID NO: 548617 - DNA, 372 bp, Homo sapiens
gcagtcaacactgatgtgtggagtgcgcaccaaccaggaactgtgtgcggccctacggatatggcgctgatctacctgagctagtcatgtacttctgttgaatgaacagatcagtaagttgtgacttttgccctctttgcttaccgtctgctactgctgtcagggctgtctattctgtttccggatgcctctgattattacaatgtttctccataagtgatccaaaatctgccctcaattcagggacaacacacaagtttcaccttttcccatatggaatccccgaggactgttaacaacaatcagccagagcccccttttagtgatccgccatccggcgctcctttacccacttcctggtaggagctgttc

SEQ ID NO: 548618 - DNA, 206 bp, Homo sapiens
  misc_feature (96)..(96): n is a, c, g, or t
  misc_feature (105)..(105): n is a, c, g, or t
  misc_feature (136)..(136): n is a, c, g, or t
  misc_feature (138)..(138): n is a, c, g, or t
  misc_feature (170)..(170): n is a, c, g, or t
  misc_feature (190)..(190): n is a, c, g, or t
  misc_feature (197)..(197): n is a, c, g, or t
ttcaaggaatttgttttttacaactggaaaatgctcctgtgtgtgttaacagatcatggatgttttatgttttccctgatcatttaaagagtttgncctcagagntccaggatcatcagtaaatttgtcatgttananatttatttttttataaatcaagacttctgtgngcttttaaatatattaaaancaatttnctttcagga

SEQ ID NO: 548619 - DNA, 326 bp, Homo sapiens
aacctttttatgttttttcttgtgcagtcaaaaccaattgcaggctggatgcagtagctcacacttgtaatcccagcactttgggaggctgagatgggcagatcacttgagctcaggagtttgagaccatcctgggcaacatagtgaaactctctcactgccaaagtacaaaaggaattagctgggcatgatggtacacacttgtggtcccagctacttgggggactgagatgggaaaattgcttgagcccgggagtcaaaggttgcagtaagccaagattgcaccactacactccagcctgggtgacaaagtgagaccctgtctc

SEQ ID NO: 548620 - DNA, 619 bp, Homo sapiens
atgtggttgagtttggtggtgagtgggaggaggaggggagggcgtgggcaagggcgatccagtacagacttttgcaagtggatacgtgatgtaggtcatccattgagctgggggctaaaaggaggagcggttagggaggaagatgatgggtctggtttgaatatgtgggacttttggaacctgagatcaccatggcaaccaggacacaccggacaacaggaaagagaagcaacctgaggttcacacgggacaacaggaaagggaagccagcagcttggtagggaagatgtgtgggactgagaaatccatctggagtgggcacagagcctggaaggcggtgatgggagggagtggagagggggcgctgggttgagtcggggcaggactcttccgaaggaacccaggaaagcctcctgcctctcccaagatccccaggtctgggaccggagcggcatccccagggaaactggaagagagatctgagggccactggttagacaggggcctggagcagccctggaggacttctggccaagtcctccgtccccagccttatgatctgggtgaggggagatggggttgctgacataggagggtcacgccaggcaggatgagggta

SEQ ID NO: 548621 - DNA, 203 bp, Homo sapiens
ctagaggatcctgcgagaagagttgtgctctgtcccaggtgagtgagtgtgtgatctcggttactgcagcctttgctcccaggttcaaatgattctcctgctcagctcccctgtggctgggactacaggtgcccgcaccatgcccatctaatttttgtgtttttagtggagacggggtttcaccatattggccaggctggtct

SEQ ID NO: 548622 - DNA, 385 bp, Homo sapiens
attccaaaactggaaatttacgtggatgagctcctggccaaggaaaattcacaagcccgggcccccagggtcaaaaaaattctggtttattgtttcaaacccccaaaggcctttttttttggcctgttggacaaaatccgggggatgcaaaaatttagcccccccccaaaaaaatgaggggccccccccccggaaaacggggggtcccccaggacaatttttgccccccacccttgtaaaaaaaacaaaaccggggggcccttcggccaggcctggggccattaacagggctccttgggcccctggcccaggggttttttcccccccccccccagttttccccttttgggggttttttttgtttttaaaatgatggggcttttta

SEQ ID NO: 548623 - DNA, 349 bp, Homo sapiens
aactaccttacctgcatgtgaatgaggagagctagaatgcaaagaatccctaggacacccatagaggattgataattcatattgtctatgcatagaaattattatccagacgggaattacgtatgttagaactatcccttcatttgccctatgctaatcccactttactcagaatataagagctatattttgaagacttgagttatttcagaaaaaactacagccctttttgtcttacctgccttttactttcgtgtggatatattaagcattgggtctggaactagctgtataacacaactaagaactcatgtcttttgtcacagaatactgtgccagttttttgtag

SEQ ID NO: 548624 - DNA, 838 bp, Homo sapiens
gctcatgaactcgcctgagctcttgggttgaaggtggcttgccttcgttatgtggagccaggctacatcccagcaaccatgtccaagggacctgcagtggtatgatcttgtgaccacctactcttgtgtgggtgtttccagcgagggaaaagtcgagataatggccaatgatcagggaaaccgaaccactccaagctatgttgcctttacggacactgaacggttgatcggtgatgccgcaaaagaatcgaagttgcaaatgaaccccaccaacacagtttttagaatgccaaacgtctgatgtggacgcagattggatgatgctgtggtccagtctgatatgaaacatgtggccctttatggtggtgaatgatgctggcaggcccaaggtccaacgtaagaatacaaggggagagaccaaaagcttctatccagaggaggtgtctcctatggttctgaccaacagatgaaggagattgcgaagctacctttgggaaagactgttccaatgctgtggtcacaggtgccagcttactttaatgactctcagcgtcaggctaccaaagatgcggaacttaatggctggtctcaatgtacttacagatattaagtgcggccaatggtggtgctattcgtaccggttaaacaacaaggttggcgcagaagaaacgtgtcatctttgactggagggtggcctagtggtggtcacccacattgggaaggacttgggggccagattcacgtgggaccccctgtgtggcaacattgcgacccggggccctaatcggggtaaggcgacaagagttgggaaacatgtacaccttgtgtgagctaaccc

SEQ ID NO: 548625 - DNA, 105 bp, Homo sapiens
gactacaggatccattccttatggcaaggccatgcacatccataggtagctttttctatgtcacgtggttcatcttacgtctgctgccttacacaactccttggt

SEQ ID NO: 548626 - DNA, 307 bp, Homo sapiens
  misc_feature (58)..(59): n is a, c, g, or t
aatcaggagacatttgatatgagtgttggtagtttatccaagggtcatgaatcgatcnngcatgttataagtactttttaattatttccatcccatgaatcctccatgagactaaggtaagatatagctactccctcagtctcaatgctttcagaaaagtcaaatatactctcctaatcatatcttagcaccaggcacccgcattcgtttaaagtaaatggccccccagacaaacctaattttatgtttatgtgtgtcccctccagaagggaaaaataattcctggcttctttgttaggaagtctct

SEQ ID NO: 548627 - DNA, 377 bp, Homo sapiens
  misc_feature (349)..(349): n is a, c, g, or t
ctgactcacatttttaaaaattgtggcctcccttcttacccccacaagtagcaaaagatgtttttagatcctgaacatctcaaaagtaaaatctagagctgactatccaaaaaggcagccactagtcacatgtggctattgagcacctgaatgtggctagtgagaaatgacatgtgctataaatgcaaaatatactctggattttcagggaagtaatatgaaaaaaagaataggaaatatttctttagtgatttttatattaagctgaaataacattctacatatattgggttaaataagatatattagtaaagttaatttcacctgtctctatttatgtttataaatntggttactaggaaccttaaaaggcccat

SEQ ID NO: 548628 - DNA, 171 bp, Homo sapiens
ggagaagacgtttggagttggtgtcgagctggggagaccaccagccaagcagcagtgcccacggtgccagaggcagccagaccctccttggccttatggggtggatggggctgggtgagaaacaggcaagcgctgcgatcctgagccaagaagcattggggctgaggtttg

SEQ ID NO: 548629 - DNA, 443 bp, Homo sapiens
  misc_feature (434)..(435): n is a, c, g, or t
agggtttagtcagacactggctgggagtcctgggaatgagcagagaaaacatcagcatagagcacttggacctcccttgtacctgttcagaggaagaaaatcaactaactatataccaacaacctaagtgaggtcttacagccttgctgcagggctagtttcctgcctttctttctatcaattttccagtatactcaagaaaatcgggaaattgtaatggggcagttatatctcctgagactttttgcctgttgaaatgtgcaggacccttttcctgtgatgagagatagctggttacttgatctaggtttaaaagttatgtaaaagaaaaaaattataataaaagggatactttgcttttaaaatcttgtttccttttaatctaggtaatcatttcaaaataagtatgtaaagaagaaaaataaaagttgtcnncctggaaa

SEQ ID NO: 548630 - DNA, 537 bp, Homo sapiens
ccagcgtcgccacgcgatcgatgattacttctcatgaggaggcactccttgttattgtgctactgagtgtccagatgggcctgctggtgctgagcgggctttggatgtgaaccatattcaggaaggggaaccccatcgtcctgttggttctgtgataggcaaatggaggcgtgcaaaagactccagaataggaggcatgatgaagactctgctgctgttgtggggctgctgctgacctgggagagtgggcacggtcctggtgggaccagacggctctcagacaatgagctccaggaacactgtcccatcagggaagtatagtacgtcaataaggaaattcaaaatgctgtcaacggggctgaaacagataaagactctcatagaacactacaacacgaagagcgcaagacaactgctcagcaagcctaggaagaaggccagacgaagatcgaggatgcctctaaatgatcatcacgggactcagagacaaaagctgaacggagctcccaggagatgtgcatgcgaccatgatggccc

SEQ ID NO: 548631 - DNA, 313 bp, Homo sapiens
tcccttggcttttccagactctagaagccacccccattccttggatcatggcccctgactccatcttcaaagccagaagtgaagcatcttcaaatctccctctcttacctctgctttcatcaccacatctcccgctacaattctgaatctcctactctctttcttttataaagacccttgtgattgctgggcatggtggctcccacccagaatcccaacactttgggaggtcaaggcaggaggaatacttgaggcccaaagtttgaaactagcatgaacaacacagtgagacccccaccttcagaaaaaaata

SEQ ID NO: 548632 - DNA, 283 bp, Homo sapiens
  misc_feature (55)..(55): n is a, c, g, or t
  misc_feature (66)..(67): n is a, c, g, or t
  misc_feature (71)..(71): n is a, c, g, or t
  misc_feature (81)..(81): n is a, c, g, or t
  misc_feature (86)..(87): n is a, c, g, or t
  misc_feature (130)..(130): n is a, c, g, or t
  misc_feature (132)..(132): n is a, c, g, or t
  misc_feature (134)..(135): n is a, c, g, or t
  misc_feature (137)..(137): n is a, c, g, or t
  misc_feature (139)..(140): n is a, c, g, or t
  misc_feature (154)..(154): n is a, c, g, or t
  misc_feature (204)..(204): n is a, c, g, or t
  misc_feature (249)..(249): n is a, c, g, or t
  misc_feature (283)..(283): n is a, c, g, or t
ctcgtgcgattcattaaacatttttgtcaggattatttcccgtaaaaacgtagtntgtcacttttnnatantactaatttnagttnntacattttaactttgttataatacagaaatctaaatatatttntngnntncnngcaatatatcactngaccaagaaattggaatttcaaaatgttcgtgcgggtatataccagatgngtacagtgagtagttttatgtatcaccagactgggttattgccangttatattatcaccaaaagctgttatgaactggn

SEQ ID NO: 548633 - DNA, 182 bp, Homo sapiens
cttctgtctcgtatcatgtaacaaccggagtgaccacatccaagtaggagtcagatcacgcctctcctctaccctgaaggccagtagcttctccagcacactccagagcacaatccaaactcctcggcagggcttgagagggccatctcgtaccctctctgacctccctccactgcacaatc

SEQ ID NO: 548634 - DNA, 323 bp, Homo sapiens
cctaatgtattaatgtattaaatctttataaatgattcaggcttgggcgcagtggctcacgcctgtaatcccagcactttggggaggccaaggtgggttgatcacttgaggtcaagagttcaagaccagcctggccaacgtggtaaaaccccatctgtactgaaaatacaaaaattagccagtcatggtggcacacacctgtagtaccagctgctagggaggctgaggcaggaaaatcacttgaacccaggaggcgaaggttgcagtaagccgagatcgtgctactgcactccagcctgggcgaccgagtgagactccatctc

SEQ ID NO: 548635 - DNA, 945 bp, Homo sapiens
gctatgacctatacattgtccgaatatgccaaagacaataaagagctcttcatgtcgaatcatcgatcccatcattgttcgcgcaactatcgataaacaatatcactctcaattgaaagctcctatgatcggccgcatcaagtaacgaaaaaggagcttggagatcccctttcatgacacgcctcagaacggcgtatcgcgggccagtacgagacagatcgcaaagtgagtatttcctcgaggctgccagctgggtgtgatgtcgtgatacgcattgttggcaaaacgtggctctaagagattcatgagtatgcgactttgctaaatttgtcacgaaggaagagagctcttcttttcctggagtagagacacgtggagcttcgagactctttgattacctattgtatctggtacttgagcgcgagttatcataatacacacaaatttgatggtatgtttttttaccttacacatggcttgctaaggtagtaaacgttctctcgaaaggagatccggggtgtttcctaaattatttttctcaacattgccgttgtttagaaagcgtgaaaactgttgactgttcaggtattctttatgaagccccttgagtttttatttaagtggatccggcatgggggaagttgaaactccgggagttagttaacatgaatcttatgccagctggatgtgctattcacttaaaggcgtatgaaggcctttaaactattataccgtgaagccgagtcactcagtgaaccgttgcctgtgtcactcccattatgggtttgccctagtctctcgctgctggcgcaattacgacggaagacttcgacaagtcactggcgctcgactcttactgaacacgggtttgactgaaaaaacggtcttaaaaaacaattacacctgggccccgcaaagatacgggggggcgaaaaaaccccctag

SEQ ID NO: 548636 - DNA, 765 bp, Homo sapiens
  misc_feature (177)..(177): n is a, c, g, or t
  misc_feature (401)..(401): n is a, c, g, or t
gagttatcggtaagtactattcgtgtgagagtatggctgataatgcctgtgttcttttcgccgtctctgttctgaggtttataatcagttcagtgctggtttatggagcaatttcttatcaagtgggttggctgattccattcttctgttaccgactttttgacttcgtcctcagtngcctggttgctattagttctctcacctatttgccaagaatcaaagaatatctggatcaactacctgattttccctacaaagatgacctcctggccttggactccagctgcctcctgttcattgttcttgtgttcttggccttattcatcatttttaaggcttatctaattaactgtgttgggaactgctataaatacatcaacaaccgaaacgtgccggagatngctgtgtaccctgcctttgaagcacctcctcagtacgttttgccaacctatgaaatggccgtgaaaatgcctgaaaaagaaccaccacctccttacttacctgcctgaagaaattctgccttgtgacaataaatcctataccagcttcggtcgtttatgttacagaatgctgcaattcagggctcttcaaactggttgatatacaatatgtgtctttgtgttaagcatttattttcaaacactaaggagcttttggacatctgttaacgtcttttgttttctgttagtctttacatttaatagttttgagacatctaggtagcagacaagtgcatgttgcttattggggtggaggaagaggtct

SEQ ID NO: 548637 - DNA, 239 bp, Homo sapiens
ccaaaaattttttttaaaaaaaaaaaggcccggtgttttgggccggcccaatggttttggggggtttttaaccttggcccatttaggggacccgtttttttggtaaggggaattttttcttttgggggccccggtgttccttttgttaatgccggcccgggtcccaaaaaaccttaaaaaggggggtggggttgggcttttgggccctgaaaataaatgtttttttttttgtgggccca

SEQ ID NO: 548638 - DNA, 425 bp, Homo sapiens
tctgtgatgtcccagccatgcttggagcatgcttccaggggatcgggaaaaatcatctcctcctgaacaatacacacatacacatagggctgtgtcaggtcagagaccacagacttgggggctgagtctgagacccaggcctgcccagccagacaggtctgagaaagggctgacttccccttttttcccctgacttcgggctgggacacccatcgtggaggctggctaaaacagaccagtcgggatctcgtcaggagggacacctagtggggatgagcggcagcattattagctcaaaaagacctccctcggccgtgtacacatgtgctaggacccagagagggcaccctcccccaaagccttggttttgacgctcggggatgtgcctctcgggttggtaagcccccactgtgaagtaagacctt

SEQ ID NO: 548639 - DNA, 108 bp, Homo sapiens
actactgccggtcatccgtccttatattgcgtccgggttattgtctccgatgtattgccacccagctcgcgcgtgtgtgtctccagcgtccgggttattgtttaccac

SEQ ID NO: 548640 - DNA, 1243 bp, Homo sapiens
  misc_feature (153)..(153): n is a, c, g, or t
tcttggtacaaaattttattaaagggtcttaagaagagcaacattccagaactctccagaaattacagctgtgccaagtgagaccctgtgtttagtgctgtggtggggacgtggcgtggggcatgtggcaggccggcctcgtggctttcccanccctttcgtcgttcgtgagaagtgcgggggtgggtggcgcagatactctcattcttgtggggttctccacaatggcctcagcgtgtggctcaggcaggggctttctatagggccaatctcttataccagtgtggggtctcccgagggcagaaagtgactcttcacctttgagtgcccagaacaacccgtgttcgtggagcaacagcgtgtgggcgcacgagcagtgtgtctcaagcgatagttagttaaacgggggtctctcgcgcgtggggcatcattcggaggccatccaacaaacttctcagggatttaagccccttcggttccctcggaagttttcccacaggaaacacacaaaaaacctctcggacaagcctctgtgggggcccccacgtttcttcccatgtgatgtggaaacccggcaggcagcaacccatatatgccaggtgccccctctcgcaggacaaccacggaaagggcccctcccataagaggaggtttgggtgtacacgcgcaaaggagagactttcttgcctcggggtggcataattgggggcgaccacacgagagaaccccttcttatgtggcgggcccacccctttttcttcacagggcaattaaaaaagggcttctctaaacaagcgttgggcccctcttcgtgggggaaaagcgccaaaaaacccctctttttgtttgggacacttcacgacgggacaatgctcaaggttccccgcggaaaattccggcgcggggcgccccttttcttcacaccaaacagaaaacaccattttctggggttgcttcaggggggggggcgcaaacagcaaatcagtgggagtactgctgtggcccgatgggctgtagaggtgtgataatccctcgcgacgccccctaaaaatctccaaagaaagtatagccacatatcttgtagcaccacaagcttccgccgagcaggtagagaaacacctcacattcgacaggagtaacagcgttttggaagagatatgcccactagcggggacaaacaacgtctcccctctcatcgggcggatatttgcgccagtggccaccattgcgcccgcgggcaaaa

SEQ ID NO: 548641 - DNA, 346 bp, Homo sapiens
acatgtttttttctcatcaatctacacacaataccccataatgataatttttgcaaatgtattaaaaataagaaacaaataccttatttacataggtattcagacactttgcaatgaaactcgaaattgagctaaggtgcatcctgtttccgttgatcatccttgagatgtttctacaacttgattggagtccacctgatataaattaaattgattggacatgatataggctcccgagaggcgcagcggtctaaggcactgtatctcagtgctagaggtgtcactgcagaccctggttcagtggtctaaggcactgtatctcagtgctagaggtgtcgtcgacgcg

SEQ ID NO: 548642 - DNA, 457 bp, Homo sapiens
  misc_feature (12)..(12): n is a, c, g, or t
  misc_feature (346)..(346): n is a, c, g, or t
gtcaatattatnggtatcagagagatgcagatcgaaaccacaatgagataccacttcacattcacaggatggctagaataaaaaagacaaataagaacaagtgtggtgaggatatggagaaatgcaaccctcatataccgctgatggtaatgtaggatggtgcagtcatttgggaaagcagtctggcacattctcaaaggtttaaacatagaattatcatttgacccagaaattccactcctagatatataattgagagaattaaaacatatatctacacacagacttacacaaatgttaatagcagcgttattcctaacagccaaaacgtgaaaacagcccagtngtcctgaatgtctgtttctttcttccttttttttttttttttttttggggttttgggggggctcggtcccccggggggggttggccccagggcctccaagcgggggggaca

SEQ ID NO: 548643 - DNA, 564 bp, Homo sapiens
caaatccaatccctggttcccaaatcgcccgcacatccagacagtattcggatctgttaaagtcttccttaaggtcttcgataagtcttttacggtaaatactactgctaagataatagcgactttgatagcgggattcgccgggttgcaaagattccgattattaagagcgaacctattcttcttagtatcctaagatgccttcctcttaactaggacgtaaaacttcgcgaatatgattacgatgttattttataacgtcgcgcggacgcgttgtgcatgtggtggtttatccgcaagatctcgacgtgaggctgggcgattatttagacttctcggtttcttaacgagaggtttcgtcttctcctgcgtaaaactagcgctattcgccttccgaggccgtatctttggcccggcgtttatgatgaagacgtttattactgttttcttaaaggagactaccggtgtttgccccttaatccctcttgcttggtttaaatgaggaggatggagttaagtcgggttttcggcgcgtagtagtatttactaaccttcataatacgg

SEQ ID NO: 548644 - DNA, 227 bp, Homo sapiens
agagttgctcttgaggatcccttttgtgatggaatttgacacactaaatttattttgcctcttctagcatgtgacacattgaattttcatgtagaataaggaccaatatatcaagtgcatacctagaggggagaaataaagtcgaattatcttgtgtaccacatttatgcagtcaggattatcttgtagtacttatatttggaaccttgctttttatcatttttttt

SEQ ID NO: 548645 - DNA, 139 bp, Homo sapiens
cctatgaatgtgaaatacagatcccagtgagtgccaaccgcaatgacccagcctccctggatgtcctctatgggccagatgggcccaccatttcccactcataggccaattactcgtccaggggataatctgaacctat

SEQ ID NO: 548646 - DNA, 1288 bp, Homo sapiens
cctttatgtactcgatccttctgtgtgactactatgctgttctacctccgccgtcattattctgggctggctgcgatcccctgttcttgactattctcccttgtgccggcttacttccacggggatccctgtggtgaactatgtagctaacttgcgccctctgtttctgttgttacctccttgtgttgaatagtgtgccgtccggtcccccttatttgcgtcgcgcgctcctatctccataacccggcggttttcccctaacccctgctgtccctggctctcaactggtccccgtctcagcctggttctatgaccttcactacgggtatttcggcggtccctggtgcttcacctatggggatatctcttgtgtgctataaactgtgttccccttcctgctcatttacgactcccggagccagtgaatagtcctccggatccttcgttcttcgcaggaccgcaagtgtgtatctgatcctggaggccaccgctttcaagctcaaagttagtacccggtggcacccgatgctccgtgcactttggtcttgcatgatctctcctgacgcccacggacacgtcaaagatgctgggttccagtacctcctgggtacagaatgagatgctccaggcctagtagacaagcggctgcattcagcgatcgcagcaacgacagcggcgtgcgccagggtcgcccggggggcaccgggtgcccagcagcagcaacagggatctacagcaagtcgccgcagacgcgtggcggtcccggtcctggtgaaaagacggcaaaccgtggccaggcgggtgcccccgcgccggggcgccgccagcctacaaggccaacgcgcagtcagcaggcgcagcaccaggcgcaggccgcgcaggcggccggcaagcggccaatctccgtggggcaccggtggcagccggccctggcagcacaacccgggccaccagccaggcagcgcaggccagtctccggacctggcgcaccacgccgccagccccgcggcgctgcagggaccaggtaatccagcctgtcccacctgaactcctcgggctcggaatacggcaccatgtccatgactccaccttgctatacggtcggaactctaggtgagaaggacacacgggccggccctagacccaagcgctctgcctcaccgcttcacctctctgcccgcaaatacagaccaccatccacgcgatgctacacgcgactttgacttttcttaacaacctggaccagcgtttagaccaaggaaaaacaaaaccgcaaaaggccaaactt

SEQ ID NO: 548647 - DNA, 548 bp, Homo sapiens
  misc_feature (1)..(1): n is a, c, g, or t
  misc_feature (112)..(112): n is a, c, g, or t
  misc_feature (175)..(175): n is a, c, g, or t
  misc_feature (217)..(217): n is a, c, g, or t
  misc_feature (226)..(226): n is a, c, g, or t
  misc_feature (239)..(239): n is a, c, g, or t
  misc_feature (289)..(289): n is a, c, g, or t
  misc_feature (291)..(291): n is a, c, g, or t
  misc_feature (293)..(294): n is a, c, g, or t
  misc_feature (296)..(298): n is a, c, g, or t
  misc_feature (300)..(300): n is a, c, g, or t
  misc_feature (302)..(302): n is a, c, g, or t
  misc_feature (308)..(308): n is a, c, g, or t
  misc_feature (317)..(317): n is a, c, g, or t
  misc_feature (319)..(319): n is a, c, g, or t
  misc_feature (326)..(326): n is a, c, g, or t
  misc_feature (329)..(329): n is a, c, g, or t
  misc_feature (332)..(332): n is a, c, g, or t
  misc_feature (334)..(335): n is a, c, g, or t
  misc_feature (339)..(339): n is a, c, g, or t
  misc_feature (351)..(351): n is a, c, g, or t
  misc_feature (372)..(372): n is a, c, g, or t
  misc_feature (382)..(382): n is a, c, g, or t
  misc_feature (392)..(392): n is a, c, g, or t
  misc_feature (397)..(397): n is a, c, g, or t
  misc_feature (405)..(405): n is a, c, g, or t
  misc_feature (429)..(429): n is a, c, g, or t
  misc_feature (434)..(434): n is a, c, g, or t
  misc_feature (438)..(438): n is a, c, g, or t
  misc_feature (444)..(444): n is a, c, g, or t
  misc_feature (446)..(446): n is a, c, g, or t
  misc_feature (488)..(488): n is a, c, g, or t
  misc_feature (527)..(527): n is a, c, g, or t
nagtagaaaaaaacctgtcaagaaagaccaggtggaaaatgggttccaataaaatggaatttatagggaaaaaaaaaaaaaaaggccacaaaagagaaatagcaccactgtnatttgaacaatggctagttacttgcattttttggcattgttaatcactgaatctgggtttttntttgaattccttatatagcatgtactacacaatttttttatnataaaatanttgctttctaaanacattttaggacaagctaccaccagaaaaaaatcaatacaaatacatcangngnngnnnantnttagtngtgggtggnanatatttnggngantnntgcnaaaaaaaggaantgaatagggtgtgggtaaagnaaatgagggngagttatggnatgangtattttnaatattaattttttatttagatanggtantgtntttttngnaaaagaaaattaacatttagtaacacactaatgaattttatntccaaagagattagtgcactggcaaagtattcggattanagtggagagctgtgaacagca

SEQ ID NO: 548648 - DNA, 676 bp, Homo sapiens
gaatgaggagtgatcatggctacctcagagctgagctgcgaggtgtcggaggagaactgtgagcgccgggaggccttctgggcagaatggaaggatctgacactgtccacacggcccgaggtagggctgctccctgcttgaggaggacacccagagactatgcagacctacctaccagcaggggctagtgccatggtgctggtgcttgctgctcgcccctggctgttgatgcggatgggcgtcctcgggcgtgggctgcaggagtaccagctgccctaccagcgggtactgtgcgctgcccatcttcagccctgccaagatggggctgccaccaaggaggtagcgtgaggtacaccaacatccatgcttcaggagctgctggcgctggatgactatgccctggtgtggccagtgtgtggacgcggcaggaggtggctggagatcactaagagcagatgacccctgttggtggctgtcagcaatgcccggttgctcgcttcgtacgctccctgtctccgctccatgtcccaggaagcacaggagaggctgagagggactgtgacgttgggctccgttgtgcccggcctgggctgggccttcctggctattgactgtggcatggggagcttgtggcattggctgcttgtagtttgccagagttggggctaaggggagg

SEQ ID NO: 548649 - DNA, 224 bp, Homo sapiens
ctgactacaggggaaggcggcgagagggaggctgtaaggaggcatcccaggccacactggacagatcacctctgtgcccctaggtgacaccacctcttcctcgaggccaccaggaggccccatcatcaccgcccacccaaaggaaatctggagcgcctttattcactttcaacagcagagagccctgagcagatgcgcccgtcacaggacttccgccgtagtca

SEQ ID NO: 548650 - DNA, 166 bp, Homo sapiens
tgtctgtgggacagatgggggcatgcatcagccaataggctagctgcttatatcacaggcaggttgcgacccgtcagtccatggacctctcaaccctcagtacgtcatctccaaggtagcatccaaggccaaggtggctgcatccaggaaaccacgtagccggtgg

SEQ ID NO: 548651 - DNA, 135 bp, Homo sapiens
gtgccagctgtctgccaggtgtctgccagtgtctgtccagtgtgctgccagtgtctgccaggtgtctgctcacagacctgtcaggtgtctgctcacagacctctcacagaccttcatctcagggtacgagtgaat

SEQ ID NO: 548652 - DNA, 204 bp, Homo sapiens
ttttttttgggggggggggcccccgggggcgggggaaaacccccccaaccccccccccaaaggggggggggcctttttttttttccccccccctgggggaataaccccctttcccccgggtggggtttttttttttcccccccccccccaaaggggggcctttttttttttggggggttcccccttccccccccccccccctta

SEQ ID NO: 548653 - DNA, 910 bp, Homo sapiens
tgggcgaggctaaatcggctgcgtcctctcggaacgcgcgggcaaaaggggtcctggtgacgagtcccgcggttctctccttgaatccagtcgccggcccgccgcctctgccgccgaccctgcacacccgcccctctcctgtgccagaaacttgttataccagcaccatgccctaccaatatccagcattgaccccggagcagaagaaggagctgtctgacatcgctcaccgcatcgtggcacctgggcaggggcatcctggctgcagatgattccacttgggagccattgccaagcggttgcagtccatgtggcaccgagaacaccggaggagaaccgggcgcttctaccggccagttgcttgctgacagttgacgaccgggtgaacccctgcaatgggggtgtcatcctcttccatgagacactctaccagaaggcggatgatgggcgtccctttcccccaggttatcaaatccaagggcggtgttgtgggcattcaacggtagacaagggcgtgttcccccttggcaggacaaatgccgagattaccacccaagggtggatggcctgtctgagcgctggtgcccagtacaagagggacggagctggattttcgccaagtggcggtgtgtgctgaacgattgggggaaacacacccctgtcagccctcgcaatcatggaaaattgcccattgtttctggcccgtaatgccagtatctgccaagcagaatggcgttgtgcccatcggggaagctgagaatcctccctgattgcgacagacttgaagcggcgccagaattttgacgaaaagggcggtggggcacaggctgagggcccacattctggagggctgttgagccaagggcccgcctgtgccaattctaaagataggcgcgcaaagcaaagcccg

SEQ ID NO: 548654 - DNA, 1345 bp, Homo sapiens
  misc_feature (413)..(413): n is a, c, g, or t
  misc_feature (641)..(641): n is a, c, g, or t
ggtggatcccgggttattgtgcgagatgtactactgtcagcaagcggaggcgctcgggagggtccgtgtttgggcattgccatggctgatggctgtgtgaggtctgacgcttgatgatgctggcgtgtggcggcctccagagcgtctctcggctacgcatatcgattcgcacggcgagggcgagtaacagcatagcacttcgagattgacgtcgtgcagagacgtggcgaggaatctaggggtgattaggaagatctatatcacttggtccacaggttgtgatctgcagagtcatagacatgtctcaagataccacatcgagagtggacgagcttcatcgtcggatcagcagcatggcccacaggtcagccagtgcaattactgggacggacagccaatcggaatttgcgagnacacttgggagtgtgacacaggccacgtcacatacacttgcggagattgtagtgccctctttagcgacatgtgacctatcattgcgccccatgctgacaagtaagagcctagttgaacctctgtatggcccgagttagcaagaagacttacgcctggaggtgttcccaaacggcgaaccacgtatcgccatgaggtcttaactccggagggggcaacttgtgcctggnacctggaagaacgccactcacttacagagaggtacatggcaagttaagattttggactttgggtggccgttttcccacaagaggttgggagtggggctcgaggctttcaagttccgaggctattcaacttttggcaggttggacgggaagagcggcaaggtgcggattctcgccattggggaaccgctagtccgacatgtgctttttggtcacaaataacgcgaagtacaacgctcggcgttgggtgtggaacacggaacctttcgcgacaacgccgagcactttaatcgctgtgccgcacgcgccagagattaaagccgggaaaaggacacaacttcccggttgtgtacccattggggtggggccattcgccgtggaccacaccggcgttgtggctcactccttacttgcctacttagtgtggaaggcgacaacaaggcgggcgtctggacacatcgtgacaggtgaccctgcgcggcgcgagtatggacacagtgaaaggttgacattttcccgcttggcgctcgcgggcggatgggcggtttattgtacaaatcggggaacacgcgcagtttggcgagaagatatcatggcccggccggtgtgatttaacaaacaaccaccaccacacaggtgtgagtatacccgacgatataccgattgctgacaggcagaacactatccgggcgtttccccaattctgc

SEQ ID NO: 548655 - DNA, 186 bp, Homo sapiens
gatcagtaggatcccacttatatcagaggatacacatatttgtgaaaatacatgaaagaagacactaaaatatgaccatcttgggtagtgaggttatgacggtgatttctactggtcctttatataaaatgaaaatattttgtatatgtatgttctggaattttctcacagtaatgcactacaaaa

SEQ ID NO: 548656 - DNA, 504 bp, Homo sapiens
gcacgagagaatcttgaacaacaacattgaatagcctacctccggcacaagtttgcaaagcagtagcatagcgaatattatcattatctatctggaaaagttgacccaccaccccatggacaaagctggcttcaaaattaggataaggtttcgtatagttaaattccagatttgctacgcgtctttttaaatattcagagttcttacatgtttgataataatggctcttcaatttatcctctctttgcttcaggtctttaattcgtgatggatcaaacccatattcgactagtcgggctcgtagtttatcgcacgtttcttggcattgtttaacatgcttcacatttaactcgttatcttttgtggcctcctttaatttaggttcaattgtcaatagcttttcttcaacaactccattttcatgcttgatttttttatcgccaaggagacttcattcagctcaagtctttgccttggccaactgtgcgttataaccaccgtctg

SEQ ID NO: 548657 - DNA, 436 bp, Homo sapiens
ggaaaaagttcacactgatggaaataaaattgcgaaatgccgagcgagcaaatgatgttgccgagaaaagaaatgacatggtacagaaagaaatggagcagtttttttccacgtttggagaactggcagtggtacccaggagaaccgagggaggaaacacaatctggattcagtgagcctgcttttgcctgctttatttgatggctttggcaaggactccagggattttgatgggatatgatgtagacccaggtggttggtcacctggatgtacagaagtctaactggtgaaggaatatcatttacagacgttaaacatccatttttgcaatgtgtaccaaagttatatcatgccccataatgctactgtcatgtgttacaactggatatgtgtatatagagtgatttttcaaaagtaactaagaagtgcgaagca

SEQ ID NO: 548658 - DNA, 886 bp, Homo sapiens
  misc_feature (8)..(8): n is a, c, g, or t
  misc_feature (28)..(28): n is a, c, g, or t
  misc_feature (63)..(63): n is a, c, g, or t
  misc_feature (103)..(103): n is a, c, g, or t
  misc_feature (107)..(107): n is a, c, g, or t
  misc_feature (118)..(118): n is a, c, g, or t
  misc_feature (149)..(149): n is a, c, g, or t
  misc_feature (154)..(154): n is a, c, g, or t
  misc_feature (161)..(161): n is a, c, g, or t
  misc_feature (189)..(189): n is a, c, g, or t
  misc_feature (193)..(193): n is a, c, g, or t
  misc_feature (234)..(234): n is a, c, g, or t
  misc_feature (276)..(276): n is a, c, g, or t
ccgccagntgggttgggaaattggtccntcttgggggcgtgggactaggcttcctttaggtgngcctggccctttggctgtatcctctgggtgtagaaaaagncggnagagtcatggnatgggaccgcaggggggaaaagggccctganaaaangcctggnaaatgagggagtgaggcaggggcagggnaacntagagtcacctttgaaaaaacaccctggggcctcccgttcngggtacaccaagccctttccgacttcggcccagcaggcgcgnaggatggcggggaggaagccaccagcccctgtgtttactgtcgtcagaaaggtcttgtgttttggttttggggtctttgttttgtttgtgttttgtttggcttgtttgttttttaaggggaaaaaagtttgtaattatttcatccaaatctcccgttatatatctgtgaataataagagattttataaagcaagaaaatgatgtatattttagtttgttgccaaataagtcctcatgttcccgaaggcccctgagaaaaaataatttaaaaccctggtttttgtgaatttttttgttttgtgtttctttgttttaaaaattgtgtttggtttggtttttgcaccccactaagccaagagggttgaagggctgggtgcagcctgggagtccaatggttttcaccaggaaacggggtgtcccctgcagggggttaaactgcaggggcctgaaattaactgtgaacatgtgggagccccatgcatttgggtcagggatttgggggcccccccagctggcgggaaccccaaatggacccaaactgtacatttgccaatgggtttttttcagaccatggtttttacttgcaaataaacctgagtttttttctcca

SEQ ID NO: 548659 - DNA, 136 bp, Homo sapiens
atttgattaaaaaatgattcccagaatttaggaacagaatccaactaacccctgtatgaggggaatcgaaatgaggatattaaccccaaaaaaaaagggggatttttaaaggattaaaaaaattttgaaatgttta

SEQ ID NO: 548660 - DNA, 435 bp, Homo sapiens
ggatcccccgggctgcaggatcatgtatcgatggagacatataggacatacatatcatactcttaggtctggcaaatatttgaggatcatacatattttatattcactcatcagcagttgtaaacacattcttaaaggaggattttcagatatgaacaagctgggatgaaagaagaactacggtacgggaaatggttgtggcaatgctcctgcgtggccatctacacctcacgagggctctaagagcacgcgttactggatcccaccaacatacgcagcagacaatcactgtcccccaggaccaggatggccaaggatgaaaaggaccgcgactgaccagccagctgtccctcttacctaaagacttataaccaatgcccccttatttaggcaaaggggggggggcctccgccttgcccttttcccccccccccc

SEQ ID NO: 548661 - DNA, 88 bp, Homo sapiens
cacacacagagggcaaactaagttctaaggtttttcattaagacagtttattttaaggctaacacaaacatcgtcgtcttcttgttta

SEQ ID NO: 548662 - DNA, 835 bp, Homo sapiens
  misc_feature (271)..(271): n is a, c, g, or t
  misc_feature (324)..(324): n is a, c, g, or t
  misc_feature (368)..(368): n is a, c, g, or t
  misc_feature (626)..(626): n is a, c, g, or t
ttatgaagatccccctgcgggaactccctgggggcctatctgttggaggccacgcctattttcctgccacttggggtcctcaccgaatgtgccctgggaaattgtgacaaaaagagacccacatggcttctataccctgcccagacgggcacacaatttgtggagacgtgtgtcccccgggggacacgctcttgttctcccaagagaggttaaaggggagagatgttgtttgccctgtgagcgcacaagggcttttggggacgagtctccnctcccgggctcacggatttttctgagacccctttggaggagtcacgacaatancccggagtatctctacgcccctctctctacactcgtatgctatncgggaccaacgagtttcctggtcgaaattttgtgccacccagtgcacgcccacttggcctccgtttctgggggaggatttttttgccgggagagcacgccaaaggagaggggcgacacatgggctcggccttttcaagctctttgaaggaccacgatgactactccttcaaggggcactggcacgtaacccactcgttgagtttgacatcctctttatgcccactcccttggcttaccacgtatgagagagagtgggngctgtaatgcttgataattcttgagaccacttggaacttacatagatgacttgaccaggtagagatctgatattttgagattttggagaccctttcctgtgcccgaatcactggtctattccctaccgggccctgggggctgttttagaaatggttggataacctggtttaattcaatattaagcgttataaaaaaaagaaaaaatata

SEQ ID NO: 548663 - DNA, 643 bp, Homo sapiens
gacgcgtgggtcgacccacgcgtcggacccacgcgtcgagagcaccaagatgctgcagcatattgattacatggatgaggtgcatcctgcaggacgggcggatcttcattgtatccttcaaggcttgagacaagcaatatgaatttgatcctctgtgactgtgatgagttcagaaagatcaagccaaagaactccgaacaagcagaaagggcaatgcagaagcgagtcctcggtctggtgcatgacttgtgacggggagaatctggtctcgatgaccagtcagcagggacctccgtcccataagactactgtgctattgcttcgaggttccgactttgcgtggagactgcctgtgggtgcccgatgtgggcatcggccagggctgtcctggcagtaggaattcccagtctgggaatgtcccatgtccccagggcgtccttgcaggactctgctgggctcaggtcgcgtgagtgcgctttgagatggtgtcattcccaaccagagtgaatgacaccctacaagcggaagaacggtacgtgggtgctcaagaccgcttggacccttgctttcaacagtgcaagttaatatgccgggactccaaagcgcagtacgccgaactgggcccgtggggagtcatccccca

SEQ ID NO: 548664 - DNA, 733 bp, Homo sapiens
gactgcagtactgagctttgcatcgccctttgccttgaatccgttctccgggctgagatcactgttctgtgggtttcaatgcgtgtcaaagccatatcccaagtactcgtgtagagcagacggggtcccttttgtgtaccacttcgggtctcgcgcatgaacgaacgaatgacgagctagtcgacttggcacagggacatccagattacgcttacgtttgttcctggttcgtcctcggtcatcctatcatccacattaattgtctatggtgagacacgtttgctagcttggcgtaattgtcaccgacagacagttctcaggagaaaaggctactgtcaacagaaaacgacaaacacttacgcacttgtctttatctccgccactgggcgtttgcgagggctacttgatcagagctgtctcggagacggattgctatggagaaaatagacagatccccctcggtgatatatgtgagaccgcggtgataccgatccagtgctcagtcgtaaatacgaacaccgcgtcctacgcgcgacggatagaaactgtgagagatttcgtgcccatgagcgagaagcgtttgccacaaatgctggcgcatgacatcatctggtaccgccgtctcgccagtcgtgttcacctgacgtggatccgagctgataacgggacacacttcgtgaagttccgccgagaacaaactgacacgactgacaacctgccctggcaaatctgg

SEQ ID NO: 548665 - DNA, 973 bp, Homo sapiens
  misc_feature (428)..(429): n is a, c, g, or t
  misc_feature (452)..(454): n is a, c, g, or t
  misc_feature (456)..(456): n is a, c, g, or t
  misc_feature (466)..(466): n is a, c, g, or t
  misc_feature (470)..(470): n is a, c, g, or t
  misc_feature (472)..(472): n is a, c, g, or t
  misc_feature (481)..(481): n is a, c, g, or t
  misc_feature (485)..(487): n is a, c, g, or t
  misc_feature (489)..(489): n is a, c, g, or t
  misc_feature (491)..(491): n is a, c, g, or t
  misc_feature (495)..(495): n is a, c, g, or t
  misc_feature (568)..(568): n is a, c, g, or t
atggagtcttgctctgtcgcccaggatggagtacaatggtgcagtctaggctcactgcactctagcctgagtgacagaacaactcattggcttaaaaaaaaaggagaagatttttggtggagggacattaagaaagaccaatactcaaagacgcgtcacaagttatgctacctaagccactacaccagatttactgggttggcacctatgccatgagctcaccggttgcactccattggtaaggcaaaatgctatgcctgaagagttgtaccattggaaagcgaggctggaggtgggaagtgtatgccgaaagcatgtacgtaagcttaccaccttacatttttctttctcaagtcaccaggacatagctcctacaattaatctctcgggtttgattcagtagatcccattttagctgaaagtcatgnngtttatgctgctctaagactctnnnanactaaattgnaggntnatgttagtnaagnnnantntctnatttctaatatcctaaatatatttacgatatctttggaacacccatttgaatcaaccattaaaccaatactgnttgaacaggtttgtgaaatcatggcattcatgggtcatgagaagacggtcaaagcacaaaagtgtgacacttctgcagatactggaacacagtgatgacttccatcatccagttctgccacttactaacccagtgatcttgagcagggtacctaactcctttgcacctcagtttcagctataaagcgaacatcataataatgtatattcacagggtttctgtaaaggctgaaagtcgaagcacatgcaaaacactttgtgcatggactggtaaaataagagttaatatgtattagatatggttataattattatcattactattattaataaattactggcttcagacatgctaacgtgtactatgatggaaagagtacttataactttgagaagcaggaccttc

SEQ ID NO: 548666 - DNA, 302 bp, Homo sapiens
  misc_feature (23)..(23): n is a, c, g, or t
  misc_feature (101)..(101): n is a, c, g, or t
  misc_feature (191)..(191): n is a, c, g, or t
  misc_feature (284)..(284): n is a, c, g, or t
  misc_feature (288)..(288): n is a, c, g, or t
  misc_feature (300)..(300): n is a, c, g, or t
aagaagatcctttgggttctgtncctttcatttctcattcaggctggagtgcagtggcatgatcacgggttcactgcaaccttgaactcctgagctcaagnagtcctcccaccttagcctcctaagaagcccggactacaagcagaagctacctcgcccagctaattttttaattttagtagagacaaggntctcgctgtgttgaataggctgatcttgaatttctgggttcaagcaatcctgccttggcctcccacaatgctgggattacaggcgtgaaaacnatcntgaccaagtcanta

SEQ ID NO: 548667 - DNA, 120 bp, Homo sapiens
  misc_feature (32)..(32): n is a, c, g, or t
  misc_feature (42)..(42): n is a, c, g, or t
aggatccgtctgtagttgattctagcatgcanacttagcaantggagtctcttggagatcaggaacatcagcatgcatttcatcacatattctaggctcattcatttgctcacttgcagc

SEQ ID NO: 548668 - DNA, 998 bp, Homo sapiens
gctcttggcggaggagcttcgagacctcagcaactggagatgagagatgatctggaggattgtcttgtcgcagtgcgagttggcctcgtacagagaactgcaattgctgttggctctgcagtagactcgccagtgttccagacctttgctcattgattcaatcgaggtaatggtcctcacagggaaaactggagccttgatcgcacaagcacatgggtgtgttgagagatgcgggcacgcgaagtcatcgtgggtccccagatgcacgacgcgattgcgtaggcgaccaaaggaatggttttctcctcactaatggcagtatcgtcatagaggctccatcgagcgtgtccgcgctcctggggcttggactaccgggcgttgttccatgtttgaaatccatcagctctgcagattgggagatatttatccgtaggactgctcgcgctcctcagtctgcatggtcgctgcgggcccttgggcgtgcttcgtcatctggccttattgttcaatggggggcgtgccgttggagtatacgctggcaatggctgggtcattacgggtgcttcgcaggtttgggcctcttggatggaggcttaggcatgatttccagccctatctaacgcatgtggcccttatggaagatggtggtgccgctcgctgtggtaagttcgtagacgctctttagatttacgtacgttggaagaactggtagtatgagctcttaagattcggggtgttgatggccacctaaggggtcccgcatgacggaaaaagataaccggattggtccaagagcggccggcctccgcatcttatgcacaggctgttctcatgcttaattttgggacacacgtgcgaagcaacgatacagctgggcacatggcgccaaaaccgcggctcagggggggcccccccattttataacagccgcaacaaaggtttaacacatggccgccgttaacatacaaaaacacacttcgcggcgccggaaaacacac

SEQ ID NO: 548669 - DNA, 418 bp, Homo sapiens
ttttgttgggatggagtctcgctctgttgcccaggctggagtacagtggcatgatcttggctcgccgcaacctccacctcccgggttcggacggttctcctgcctcagcctcccaagtgattgggattgcaggcatgcaccaccaggcccggcaaattttttgtattttttagtagagatggggtttagccaggttggctagactggtcttgaactcctgacctcaggtgatccacccgcctcggcctcccagggtgctgggattgcgggtgtgagccatcgttccctgctcttctttctttctgaggatacaagaagacggcaggctgtgacccggaagagggtcctcatcagcatccgaccatgcttacatcctaatcttggaactatgagaaataaatttctgtaatttctaagc

SEQ ID NO: 548670 - DNA, 148 bp, Homo sapiens
ctagagcagggctaggtgtctccggggaggcatgacagggggcaaggtccgtcctcggtgggcccaaacctattggtaaccaaagagctgggagcagcacaaggacccagccttggttctgcacttaataaatggtttggctacggct

SEQ ID NO: 548671 - DNA, 578 bp, Homo sapiens
ttcgggccgagatgtctcgctccgtggccttagcgtgtgctcgcgctactctctctttctggcctggaggctgatccagcgctactcctaaaggattcaggtttactcacgtcatccagcacgagaatggtaaagtcagatttcttggattggtttggggtcggggttccactcacatccgactattgatgttgacttagtgaagaatggcagagagagattgaaaaaagtggagcattcagacttgtcgtgtcaagcaaggactaggtctttcgtaatcatcttgtgactgacactgacattcacccccacgtgcaaaaagatgagtggtgcctagccagtggtgaaccgatgtgactttgtcaacgagcccaagatagttaagtggggatcgagaccatgtaagcagcgatcatgggaggtttgaagatgccgcatttggagtggatgaattccaaatgctgcttggttgcttttgaatattgatatgcttatagacttacactttatgcacaagaatgtcagggtgtataagtaactgttaacatggacatgatcttctttataattctactttg

SEQ ID NO: 548672 - DNA, 423 bp, Homo sapiens
tgtgagctgatgagtgggaccaaacggctctggccaccttggaccccattcctcccaggctttgtctctccctgagccctgcgcttgagaacattaaaagccatgccttggacccccttgttctgagtcctgccatgggccgtgaggacagccggccactcttcctggtatacactgcaaaagaacagaaagaagagactgaaatagagactggcacaacaatgttcttagcaggattatccacaatagccaaaggtggaaacagcctgaatgtccatcaacagatgagtgaattaataaaatgtgatatatgcatacaatggaattttcaaccataaaaaggaatgaatttttcatacatgctgcaacatggataagccttgaaaacataatgcaaagtgaaataaatcagccccaaaagga

SEQ ID NO: 548673 - DNA, 291 bp, Homo sapiens
  misc_feature (25)..(25): n is a, c, g, or t
  misc_feature (111)..(111): n is a, c, g, or t
  misc_feature (182)..(182): n is a, c, g, or t
  misc_feature (200)..(201): n is a, c, g, or t
  misc_feature (229)..(229): n is a, c, g, or t
  misc_feature (257)..(257): n is a, c, g, or t
  misc_feature (264)..(264): n is a, c, g, or t
tcgggtgatgatgtgacaaatacanaggcatacatgcaacacgcacacacgcacatgcacatctgcacacgcacatctgcacacacacatgcacatctgcacacacatgcncatctgcacacatacgcatgtgcatactgtgttggtctgttctcacgctgctaacaaagacatacccgagnactgggtaatttataaanngaggtttaatggactcagcagttccacnctggctgagggcaggcctcacaatcacnggcaganacggtgaatgcggagacaaatgtcaca

SEQ ID NO: 548674 - DNA, 111 bp, Homo sapiens
gacacatctgggatatggcttggctatttctgacatgttgtagggaagccgacatgctgaagtcaatttctgcgtctcactgtctcttgggcaacaaaagcatcagcctgt

SEQ ID NO: 548675 - DNA, 579 bp, Homo sapiens
  misc_feature (400)..(400): n is a, c, g, or t
  misc_feature (419)..(419): n is a, c, g, or t
  misc_feature (450)..(450): n is a, c, g, or t
  misc_feature (463)..(463): n is a, c, g, or t
  misc_feature (469)..(469): n is a, c, g, or t
  misc_feature (472)..(472): n is a, c, g, or t
  misc_feature (474)..(474): n is a, c, g, or t
  misc_feature (485)..(485): n is a, c, g, or t
  misc_feature (492)..(492): n is a, c, g, or t
  misc_feature (494)..(494): n is a, c, g, or t
  misc_feature (499)..(499): n is a, c, g, or t
  misc_feature (507)..(507): n is a, c, g, or t
  misc_feature (515)..(516): n is a, c, g, or t
  misc_feature (518)..(518): n is a, c, g, or t
  misc_feature (520)..(521): n is a, c, g, or t
  misc_feature (530)..(530): n is a, c, g, or t
ggtccaaattccatataagcaatgtataaactaataaagccaatcgtgataaattagtacgattgactttctggagtttctgaccataaaagtaaggaaaatgcagaacacaaagacagagagtaaaaagagaaattaggaaagcattctacatgttgaataggaagacactggccatgttcgtgcagcggcagtatgtcgtgacatgacataccttggagagaagttaacagatgaggaagttgataaaaatcatcagagaagcaaaatactggtagcgacactcaagtaaaccatgaaatttccataacttatgtcagcaaagtgggaatattgtacagtgtgtgttgaagttcctatacaacattgtttatctgccttttgtttgtaaggaatgtanatactaaaagttcttcttnctgtcaaaagaatatgtgtgaataagtcatntaacttattcttntgtttntcntntatcttcctgncatcatncnacagncttacttnagaaattnntntnntagaaaatngaacaaagtgcttcctgtggtggcacatacctcgaggatgggagtagag

SEQ ID NO: 548676 - DNA, 848 bp, Homo sapiens
gtgttcgttctcgagtatgtatgatcagataccgacacgagttaacatggtctcacggcccctatgtgggccctatttaccacaaagtcgtcggtgcggattcggatccctcgccgttttagaaaacaatggttgattacgcgattttcgcttaccgggacacactcaacgtggggccgaagcacggttgtggaacacggcgcccccacgtgccacaccgggatccctcttctttaaggacccaattttggccgcgtgtgccgaaatctgtaaccccgctaattttggggtcaggcccgagaactaaccattacccgcctggtgggtcctcacgcggggggtccaccgccccgcccccccccccggggggccaaaaagactctggcgaacacaatcaacagagcgaggtcggaatagctatgcccctctgacggtcgggtagcggtacacgaaccgtccaataaactggcatctccaacgcatcgcataaggtagaggcaagtgtcggccactaacaaacagagtcaccccggacttgtgtggtgaaaattaaaggagagtctcaatccttctcgcttcaagtggagcgggccaacggtttcgtctttaattcatcggggcacgacgccctggtgccacccaagagctctggaccatacaggcggcaacaggagaaaacacaaattgaggtgtacagaagtaagatatagagagagcaatcattccagtgtaagagcacgcacacgtttgagagcaaaaacttgggggagacatcgtttctcccccttgcccacaacacacgaaggggttataattattgtattgttagtgcgttgtttatttctcta

SEQ ID NO: 548677 - DNA, 676 bp, Homo sapiens
  misc_feature (247)..(247): n is a, c, g, or t
  misc_feature (252)..(252): n is a, c, g, or t
  misc_feature (254)..(254): n is a, c, g, or t
ccgtcgtccaccagcccggtgctgctccggtgagtggcgccatccacccgccccgcgctgctccggcgggcatctgcccatccaccaccgcagccatgtggcaacccagcttgcggcgcggagtggggtgcttcaaccagcggcgagcgggagtggcagccgttggcgaccgaggatgaccgcaggctgcaccgggtgctgcaaccgacaagcaattttgctggaaccacggcaacaagtgtggcanatccnangaacaagggaaggccatggagttgatttgctgggacggtggacggcggtggcggcggagctgcaacggcggttggtggtagggatgcgattgtgtgcccccgtgctgcaaccacggggcggttgggagttccaatgacaacctcgaacacggcggtgacctcgcgcgcgcgacgacgacgacttgtttgcggcgcgctggcacgagccaccgacggcaagcgcaggtcacggggcggccgacgagcgcattgttgtgcgaccgtgcgggaggccgggagtgcggatgaagacgaccagatgcgctgggtcgcgcttgggctctatcctctttttttttctgcgagatgaacgcaagatcgtacggtctgaaagcgatgtatcgtgtggtagggcagtgaccaaccccaatgtaggccgtgcg

SEQ ID NO: 548678 - DNA, 250 bp, Homo sapiens
  misc_feature (24)..(24): n is a, c, g, or t
  misc_feature (52)..(52): n is a, c, g, or t
  misc_feature (57)..(58): n is a, c, g, or t
  misc_feature (237)..(237): n is a, c, g, or t
agatggatttgtaatatatgctgnctattgctaatgttcacattcatatttnggggnnctatcttattttaatagagaacagacttctcaaaaaatcttcagaagcagcttattattgaaatatcgatatattgaaataaacccggtggggttagattactcatctgccaccaagtgggacattttgatggtctgggggtttaaaggtcttaggagagacctgttaagtaaattccngaaaatgagccaa

SEQ ID NO: 548679 - DNA, 171 bp, Homo sapiens
cactacgtataaaggtccaaccattactgcccagcacatgcttatctttcaagaggatgagatatgccgtaataagagcgctgaactacaagcttttggtttgggaatgaatccattcatattcccgtatcggatttctgctcatcaggtcacctaagtaaaccactacgt

SEQ ID NO: 548680 - DNA, 163 bp, Homo sapiens
aatcttagtgtgatactggaagattctgctgaagatctgaggtggcaatgactgaacatgtgactggtgtgctcacttctgcccacctgcctggaacaccatgtgccagtgaaaatggccaaaatgaatgtcttgtttctacacaatctccacaatatatgcc

SEQ ID NO: 548681 - DNA, 487 bp, Homo sapiens
tatcggacctttgatagccctctcctatcgaatcaaatttcctttacagaactgaaatttccatcaggctcatgctccaagtcagagtacaaaggacatgccaagggggcagccaggactcacctgcggggtgacctcactttgcacagacctggtgtccagggcccaggctcgcctcgtcacttgagtctgggtgtcattgaggcagtaagcagggttagctcctgggacaggtgagggtgcctccccctgcccccgccagtccagccccacagcggaggaagaactgcagattttcatctgtgcagatgaactcaggcccagtggtggaattggtgagggggaaggtggagaaggacaaagcctaactcagcaaagcgcctactgtgtgcctggcatggtactccgcgcttagtacactctgggctactccaggagctgctggcaccagagatgagttgcgggactgtaggattctgggaacttt

SEQ ID NO: 548682 - DNA, 561 bp, Homo sapiens
  misc_feature (108)..(108): n is a, c, g, or t
  misc_feature (316)..(316): n is a, c, g, or t
  misc_feature (561)..(561): n is a, c, g, or t
gtccaccccttccttttgcgcggaccccattacaattaaattttaaattaaaaatcccgaaaaaaaaaaaaaaaaaaaaaaaaaaacacctttggtcggcggccggcnctctgggccctctggaaaaacgccttctcttaacaccattctcggttgggcgcgcgcgcgcgggcgccccagttggggtgtaggtggcacaccatgtggcgctcatatagacgcggtgtggtttccccctatagggagagagatctcccgtgggggctcatatgagacacaataaggtgcgcgtgggggagtttctcctcttcaccanatattatataaaaaaagagcgccgcgcgggcgggcaaaaacccggcgagaagcgcgtgtctctgagcaaacacaatttctcccaagaaaatgtgagagtctctcgagagaggggcctcaataatcagaggggggggacatctctatttcttcaaacagcgggggagagctcctcccaagaaggcgaagagttcctcgcggaatatatctccaatattttaacgccccgctacctctggggggtan

SEQ ID NO: 548683 - DNA, 187 bp, Homo sapiens
  misc_feature (78)..(78): n is a, c, g, or t
  misc_feature (122)..(122): n is a, c, g, or t
  misc_feature (175)..(175): n is a, c, g, or t
ctgccttgacctcacgtgcagcaattaggaccaccaaggagtgttcttcaaaccaccttctaccaccccgcggacacnccagggctgattctggtgctcgcacccgcttcctcctctgcgtnccctgtggcaaagataaggagtcaggccagggcgggatgacactcattgattntaaagcatcttt

SEQ ID NO: 548684 - DNA, 197 bp, Homo sapiens
tgcgcgatctctagcaggatccccacttcgttgttgcactttatatttttccttactcaatgacgtgttgctggcggcctaactgttctcacataacagtagaaaaccaataatttgttgtcatctctttcaatagaatcgatgaattgcgtacaaaaaaatccttacataaattaagaatgaatacatttacaggt

SEQ ID NO: 548685 - DNA, 716 bp, Homo sapiens
gtttcccacgacacgatgttccctttctacagctgctggtagtgactggtactgctactactactcctggtctgtggcagtgagagaatcctggcacgtacagaagaaaataacttgcgacttggtaggaggaaaagggtaaacgagtcagaggagagagagttggctctagtgaagaggctgaagaccagctgatttaataaaagctttgagagcactgtgggccagtggttcagacagcattacactcttatcatcttcagggctgtgccgggtaagtctggtcaatccatcaccttctgtggcgcagcgtcctggctgcaaatcgaatcaataaagtacatgggaacggagacgacgtgcgtagcggcagtactcaacgagtactcacatcttcaacggacagtaattggcaatcatgctgatctatcaaagggcggtgatgaatatgacaaccactgtggcgaaggcagcagcgtcgtgccgctggtgatgatctcctgcattcgacacaccctagcggacaattttaaccctgtgtctgaggcagcgtggcgaaagtccaggatcgtttctgacctctttgagactgggtatgcagcctggcctgtgcacctacgcagatctcccacctcagtgtgggttcctcttacttgtcacgtttgcatcccggggttgctgttgactcgtgtggggggttcctataccagcgactg

SEQ ID NO: 548686 - DNA, 1654 bp, Homo sapiens
agcgggctgagcttgcatcacatccgccgcctgggcgcccaattccggaaggtgctgcacagctgtggcggcgggtactgcgttagtgattagagtttcttccctgccggaggtgggatacacggtagcatcatggtcgaggaggtacagaaacattctgtacacacccttgtgttcaggtcgttgaagaggacccatgacatgtttgtagctgataatggaaaacctgtgcctttagatgaagagagtcacaaacgaaaaatggcaatcaagcttcgtaatgagtatggtcctgtgttgcatatgcctacttcaaaagaaaatcttaaagagaagggtcctcagaatgcaacggattcatatgttcataaacagtaccctgccaatcaaggacaagaagttgaatactttgtggcaggtacacatccatacccaccaggacctggggttgctttgacagcagatactaagatccagagaatgccaagtgaatcagctgcacagtccttagcggtggcattacctttgcagaccaaggctgatgcaaatcgtactgcccctagtggaagtgaataccgacatcctggggcttctgaccgtccacagcctacagcgatgaattcaattgtcatggagactggcaaattaaaactgtcattgactgggcatattagtactgtgcggggcgtgatagtaagcacaaggagcccatatctgttctcttgtggagaagacaaacaagtgaaatgctgggatctcgaatacaataaggttatacggcattatcatggacatttaagtgcagtgtatggtttggatttgcacccgacaatcgatgtgttggtaacctgtagtcgagattcaactgcacggatttgggatgtgagaactaaagccagtgtacacacattatctggacatacaaatgcagttgctacagtgagatgtcaggctgcagaaccacaaattattacaggaagccatgatactacaattcgattatgggatctggtggctggaaaaacaagagtgacattaacaaatcacaaaaaatcagttagggctgtggttttacatccaagacattacacatttgcatctggttctccagataacataaagcagtggaaattccctgatggaagtttcattcaaaatctttccggtcataatgctattattaacacattgacggtaaattctgatggagtgcttgtatctggagctgacaatggcaccatgcatctttgggactggagaactggctacaattttcagagagttcacgcagctgtgcaacctgggtctttggacagtgaatcaggaatatttgcttgtgcttttgatcagtctgaaagtcgattactaacagctgaagctgataaaaccattaaagtatacagagaggatgacacagccacagaagaaactcatccagtcagctggaaaccagaaattatcaagagaaagagattttaatgaatgtggaattttttctctctctttttttttctttttaattaaaaaaaaaaaagcttggcgttcatgaggatatccagtcattttgtgctctggctgggaatataaaggagaaattcacttgcttcaatcattgctgcttcatattttacaataaactgtcccctgtccccta

SEQ ID NO: 548687 - DNA, 1394 bp, Homo sapiens
  misc_feature (1255)..(1255): n is a, c, g, or t
  misc_feature (1394)..(1394): n is a, c, g, or t
ggagagaccacactgcattgcctccctctgggccccgaggaaccctccttctgttgcctgctgctgctgctgctcctgcttccgcgcctgtgctggctgtccccctggagctgatgtgggctgcccaacacggatggatgaccccctgctgactgagagtccctgacacagggcctgtactaccacctgtgtacctccaggaggtcatctgatgtatctggagactggatggtgcatttccgacgagacagcttgctattgcttgccatctgctgtgctcggaccatctccgtcgccgtggacactgctttgattgccctgatgatgctttgtgactttctgtccggctcatccaccttggtcctgctatccatatctgtccttggtctcgatcgcttcaatctctgaccactgtgctcgttgttcatcttgtcttgctgggacttccttgcttcttctggccctctcgacttggatcgcctgattcccaaggggactccccaccagaattgttaaccacttggttgtgattcgatttcttgcatgttctccccgttggtcgtgccagccgttctcgagagccacccgtgggcacaccgccccagcgaagtctcacgggcgttcacacttttcccgcaaggtgcccctgacggacccccttgggcagagctctcgtcttcgacattccccaaagaacacggtggttccaagcccccggtgggaaccgcctattggcgcccccatgtgtatccggcaccggcttttgctcccgcattttcttcttggaaccgcacgactttccaattgcccggcctttacccgctttgcagttggccctataccctagtggcaacttctccgagcgcaacgacaccagcggtcgtctccgacttcgctggcgtatcgttttcacacccttggtgtgcaatgctcgcgtggacgcctatcaccgcgaaccgactctcgggcccgctgacacgcgcaccctacgcgcaccgtgccctatgctctcctaccgccggctcctacgctccccgcccgtccccgcgcccgacacccgctccgtgtcaccaaccggccctgcccgattagcccgtcttaccaccccgttcctgtaccctgctcgacttcgccctactcctccctgcccgtgccgaacattttggactccgggacccactgttgtttacccaccctccctcacttgtctccttacgcgtcaacccgtgcacaccccgttctacctacacactancatgacccacacccgctccgactctctccctctcctatcacgcccgtccactgctacactcgttacacaccaactgctttctcttacctactctacccttcctcgtaccacccctccttgcttgctctcgctcttcttn

SEQ ID NO: 548688 - DNA, 471 bp, Homo sapiens
  misc_feature (200)..(200): n is a, c, g, or t
tgagacgtttgagacggagtctcactctgtcgcccaggctggagtgcagtggcgcgatctcggctcactgcaacctccgcctcctgggatcacgccattctcctgtctccggagtagcagggactacaggcgcccgcgcaagcccggctaatttttttttttctatttttagtagagatgaggtttcgccgcgttaccanggatggtttcgatctcctgacatcgtgatctgcccgtctcagcctcaaagtgctgggattacaggcgtgacgaccgcgcctggcccaaataacacctttttgttattttctttagggtgccaaggctaagaagagttatttattttccttcaagtcagtaatgatgttgctattgttaaaaatgtttacctcccaaaaaatgttctgaagcaaaaatatatatatgtattagaatttgtctatgtattttttcttattttttatgattgtt

SEQ ID NO: 548689 - DNA, 733 bp, Homo sapiens
  misc_feature (24)..(24): n is a, c, g, or t
  misc_feature (230)..(230): n is a, c, g, or t
ttgttttggaactagcgcccttgnggggacacggattcggccttatggccgggatggaaagtttttggatcggggaacagcatctgttttaaatttgatcacttaaggaaggaggcaactgatccaagaccctgtgaagtagaaaatgcagttgaatcatggagaacttcagtagaaactgctctgagagcttacgtaaaagaacattacccgaatggtttttgcactgngtatggcaaaaaaaatagatggacagcaaaccattattgcatgcatagaaagccatcagttccaagcaaaaaattttttggaatgggtcgttggaggtcagaatggaagtttacaatcactccttcaaccactcaagtggttggcatcttgaaaattcaggttcattattatgaagatggtattgttcagctagtgaggcataaagatatacaagattccctaacagggtctaatgaagtgcaacagcaaaagattttataaagattggaaaggcctgcaaaaatgaataccggactgccatcagggagaattatcagaccatgtcggacactattttcaaggccttacgtgacagttgccagttaccgcactaagaatggatggacaagatccttagctacaagatgggaaagagatgcaaatggctaagaagaccagggctgacccggacatttaaggggctttgcgttaaaaatcattgcgttttctgaccggcgccgcc

SEQ ID NO: 548690 - DNA, 1058 bp, Homo sapiens
  misc_feature (850)..(850): n is a, c, g, or t
agcgggctgagcttgcatcacatccgccgcctgggcgcccaattccggaaggtgctgcacagctgtggcggcgggtactgcgttagtgattagagtttcttccctgccggaggtgggatacacggtagcatcatggtcgaggaggtacagaaacattctgtacacacccttgtgttcaggtcgttgaagaggacccatgacatgtttgtagctgataatggaaaacctgtgcctttagatgaagagagtcacaaacgaaaaatggcaatcaagcttcgtaatgagtatggtcctgtgttgcatatgcctacttcaaaagaaaatcttaaagagaagggtcctcagaatgcaacggattcatatgttcataaacagtaccctgccaatcaaggacaagaagttgaatactttgtggcaggtacacatccatacccaccaggacctggggttgctttgacagcagatactaagatccagagaatgccaagtgaatcagctgcacagtccttagcggtggcattacctttgcagaccaaggctgatgcaaatcgtactgcccctagtggaagtgaataccgacatcctggggcttctgaccgtccacagcctacagcgatgaattcaattgtcatggagactggcaataccaagaactctgcactgatggctaaaaaagcccctacaatgccaaaaccccagtggcacccaccgtggaaactctacagggttatcagtgggcatcttggctgggttcgatgtattgctgtggaacctggaaatcagtggtttgttactggatctgctgacagaactataaagatctgggacttggctagggaataaatggttngatggcatatagaatggcggggtgatatagcaaaggacccattgtctctgggggaacacaaggaagtggattggataaaagtacggattcaggattatggttgtagtgccaaatgggagtagataaggatggtagaactgaattgaaaggagagttacagaacgagaatgtgggaagaaaaaggcatcagaagattgagatgggatga

SEQ ID NO: 548691 - DNA, 1564 bp, Homo sapiens
  misc_feature (1030)..(1030): n is a, c, g, or t
  misc_feature (1249)..(1249): n is a, c, g, or t
tgcaccaagaataacagcaaataaatagattgctatgtaaattaattcgagaatcataagctttggtgttagtagaatatccaagtagaaatgttattttagatggaaaactacaaactaaacataatgaatccatccatctgttattagacttggataatgccagaagtttatcaactcttcctaaaactgtcaaagaactaagtgtataaagccaatgaataatgttagataccttatttttgttagaaaggaagcctattagacatgaagcaaactaataatactttattttaactcacttttctatttttagacagaagaaactcatccagtcagctggaaaccagaaattatcaagagaaagagattttaatgaatgtggaattttttctctctctttttttttctttttaattaaaaaaaaaaaagcttggcgttcatgaggatatccagtcattttgtgctctggctgggaatataaaggagaaattcacttgcttcaatcattgctgcttcatattttacaataaactgtcccctgtcccctacccctgtgtttttatttctaaaacaatttgtgatactaggaagatgcagatatcaagtaaatgcaggtttattgaacataactattctagatgtaatattttgacagtcttattagaaaacccccttttttaaaaaaaatgtatgaaaccgataattaggacatttgaaggagcagtagtttttttttagtcctttaaaaaataacatctgtgactaataatttgagattaaaagatttgaagtcttaatttatgtatgtttattccaaaaacagtttttgagtgtatgttctacaaagttctgcactagatactgttcaggaaatagacaagtaagatgtgtctatcctctaagacttccagtttggtagcttagtatagaaattctgtaacagaggtgcaggtgaaatgctgggggaacagaagggataagaccttttatttttctcaggaaggattgtggaagacttcatagagtnagtggcattggagattaccttgaagtgaaggaagacaaagaaggaaaagagatgaggcataaagtgatgaaaccaggcacaagaaagtgtgcggtgtgttctgggacaaggaatgttctgctactgtcgaataatggggactaaagctggcttgttctggggaaagctcatataacgtatggattttattcctcaatagtaggataccaaatactggtnttgaattggggacacatactgggatacaagggccagtaattaaagttggagaagggctggaaacttggggagatttgaaggagaaatttaagttctaatatggttggctttttgggaatacagtttttaaattgacggggattattccattatagatggtggattactttttattgaaaccggttaaaagagtgtaatttaataatgtgcgatgtaaatcatgatacattgcaaggagaaggagacaagtaggtgaaaatggatagggatgggaggggttaaagcacgggggttgtgttagatgtatatgtcctt

SEQ ID NO: 548692 - DNA, 176 bp, Homo sapiens
cacccagactaccctgggcacatgtcatcagtatctcctgagattatgtcatgggcaggtccttagccttgttaaaataaactttccaaattgccttagacccagtctcatattttgggttcatatctgtatgagaaaatgttattaatataaatactccaaaaactggatggaag

SEQ ID NO: 548693 - DNA, 697 bp, Homo sapiens
agcgggctgagcttgcatcacatccgccgcctgggcgcccaattccggaaggtgctgcacagctgtggcggcgggtactgcgttagtgattagagtttcttccctgccggaggtgggatacacggtagcatcatggtcgaggtaaagtgacactggggctctcaagagtcgtttgtctctggactgttttttttggcagtgcgcgtgggggattgagagtacttggagtccagagagaaaagaggctacgaggggagctatttggccaaggccgagtggtctcttcttcgggttttcggggaaggggtagaagccggatgagaacccgagtcggaggttcagcctgggcgcgaagcctgagataattcgtccagtcctcgtttgactcttgggagctggaaagtgtcctcggaggcggggcctctgttcgtgatcgaccactggtacttgccgccctcggggcagtgtcagtgagtctgtgccctaaaagattggtagtcttctctatcttgcgttcaggtcgtcttcttatttcacctctacccccagaaaaacttgtcgttctttacatctttccctggcatgaacagccaacgctgttagctggtcttgtccatcttaccccacatgtttattgattccattcactcttctccatatccgctgcagtccaccttaattgagaccaacatcatct

SEQ ID NO: 548694 - DNA, 2249 bp, Homo sapiens
aatagatgggggtctcactttgttctccaggctgatctcaaactcttgacttcaagagatcctcctgcctccgcctcccaaagtgctggagattacaggcatgagctgctaggtccaatcgctttgagatttttttggtttggtttggtttgttgttttttgtttgtttgaggcagtcttcctctgttgcccaggccggagtgcaatggcactatctcggttcattgcaacctctgtctcccaggttcaagtgattctcatgcctcagccccctcagtagctgggattacaggcgcccgccaccacacccagttaatttttgtatttttagtagagaccgggtttcaccatgttggccaggctggtatcgaactcctaacctcaagtgatctgctagcctcgccctcccaaagtgctgggattacaggcgtgagtcactgtgcgccgggctgggtaagcttacataacaaagcagttaaaacctttaacgtagtgttattacagttttctctccttcactagactgagatctgagggtcgtgccttgctcactggagctctgccgaatgcagtgcgtgtctgatcgtgaacatagtatatttatgggccctttcaggtctaaggttatgaggacgtaaccaagggccaagtgtgcgatcacctccaaccaacacaaaccgaggtgccgggaaccccttttaggtttacatccccatttggttccttgacaactcacttggcacctgagcctggagaaccccaactttcttcctctcccacccacctcactcacaggcacgggtggggtgaggatataatactttattcactaacacgggccgagggaatgtagtgatgtggggtgggcactgtttccagggaccccggcaggggattctccctgtctcccagttccagggcagccgggcctgccgtcccctcaatttcccagacccggaggccggggcgaggaggagcctgggttagtgcagccaggtcgaagccccagcgcgcccctccgcagccctgcgggactcagctgccctcacactccgggcaacgctcggtggcagtggcggccgtggcgccagggggcagcttgaagtccctgccgcagccggcgcaaatatacaggcggcgccgcatgtgcgcgcgtcggtggcgaatgaagtgcgagcttaggcggaagcggcggccgcactcggcgcaggggtagggccgctcgcctgtgtgcgtgcgcgcgtgctccgccaggttggagcggtggccgaagcgacggccacacacagcgcagcggtgcggcttctcgcccgtgtgcacgcgccggtgcttggccagcgccgagctctgagcgaagcgcgtgccgcagtcggcgcaagcgtagggccgctcgcccgtgtgcgtgcgtcggtggcgcgccaggcacgagctgccgccaaaggcgcgtccgcagtccgggcacgcgtacggcttctcgcccgtgtgcacgcgcaggtgctgtgcgtagttggagctctgcgcgaagcggcggccgcagtgcgcgcatgcgtacggcttctcgcccgtgtgccgccgccggtgctgccgcaggttcgaggcggccgagaagcgtttgtcgcactcggggcactcgtagggccgctcgcccgtgtgcgtgcggccgtgtttggtcagcgccgacttctgtgagaagcgccgcccgcactcggtgcacccgaagggccgttcgcccgtgtgcgtgcgcgcgtgcttcgccagcgtggagcggcgcgcgaaggcgcggccgcagtcggggcacgcgtggggacgcgccgggtcggcggacggcgcgggcgcctcgcccgggacctccttgttgtccatggggatcttgagtttcaccacctcatacttctcctcaccctcatcctcctcacccttcaccagcagcaccatctcctcctgcatctcttcctcctcctcttcctctgcctgctgttcgccaggcatcttggtgtccagccgaaggttcggcactcgcggtgccccaggcctgggcgccgggcggctgggcactcagcgaggccgcggctccgggggcggggagggggcgggaccgcagggacggccggtcattggtccgaacatatagccccaccccctggggcggagcccgaaggacccaggcgtccggcccaaacggctcggagagggcggcgagctcagacttggcgtcctccgcagtcccccgactcccaagcacctggagc

SEQ ID NO: 548695 - DNA, 278 bp, Homo sapiens
gaaaaaatgtaaaaaattagttgggtgtactggcatggtggtatacaccagtagtcccagctactcaggagctgacacaagaagatcacttgagaccaggagtttgaggctatagtgagctatgattgtgcctctacactgtagcctgggcaacagagtaagaccgtctccaaaataaataaataaacaaataaatatagtttcgcctgtatctttgggtctgcatctgaggtctccatgtcatataacagtatgattaataatatgttatgctgtca

SEQ ID NO: 548696 - DNA, 1205 bp, Homo sapiens
ctggtttaaatagtatctatactgataacaatagcaacaatcaataacaaagtattaagctttgacaacactatgtatgttattgtattaaatcctcctgtcacccgccttgagctgggtgttctctcttttgatagctgagaaagctgaggctgagggcgatgaaattcacatggccagtgggagccaggatggactcagggtgcccatgagaccatgccgtcattcaggctacactgttctgaactcacgtgaccaagatgtgacagaggctggattccacgtccctggcacactccaagagggattcaaggttaaaatacaacttgatactttaaatggagaaactccccacagtatgtttggtaccatctgaattcaaggtcacattttccagtcttgccctggttttgaaatctattggtttatttcaatacatcagccactgtggagagaacttgtctcatcagatctacatttttctggcccgtttttccttggcaccctctttcaggtgactttggacagcctgagggcttcctcatgctgagttcactgacttctgaaaaagaaattctccatacaagcactgttgatgtctccagcccaggagaaggggccttggatgcccgaggaaaaatcttggtaagaggagctgaatccagctcattaagatcctcctctgccccagtgtcccgagaaaggccaggtaggctaagtgagatcaaattcccagtatgaggccaggtgcagtgactcacacctgtaatcttagcacttcgggaggccaaggaaggaggattacttgaggccaggagttggacaccagcctgggcaacacagttagacctcgtctctacaaaaagtgaaaaattagccaggtgtggtggggtgcacttgtagtcccaacaacttggtaggccgaggaaggaggatcacttgagcccaagagttcaaggctgcagtgagctacaatcacgtgccactgcactccagcctgggtgacaaagcgagatcgtgtctctccttgttgtccatggggatcttgagtttcaccacctcatacttctcctcaccctcatcctcctcacccttcaccagcagcaccatctcctcctgcatctcttcctcctcctcttcctctgcctgctgttcgccaggcatcttggtgtcctgaggcggggagcagccgaaggttcggcact

SEQ ID NO: 548697 - DNA, 237 bp, Homo sapiens
gcgtcactctgacttgattcaagaagtgtagacgtcggcgtgtgcagcaacaacttcgtccagtcagacctgatttgtggaagtgtctggacagtcggcgtgtgcagcaacaacttcgtccattgcgaccttgagtgtggaccctcggcgtgtgtgcacacgcggaatgaccaaacattcttaaggtcaagtcggagtggacgaagttgtagcaaatcctaagggacgaagttgtcg

SEQ ID NO: 548698 - DNA, 101 bp, Homo sapiens
tctagaggactaccccttacacagcttggggtagtaacatggtccgaaacagcgcttctcataccactgtagtactttaagactcgtccaaccagggctac

SEQ ID NO: 548699 - DNA, 813 bp, Homo sapiens
ggtgccgcgcccagagcagcagcgggagcgaagatgcgaggccattacctgtttgatccctgtcggaaacctggcacgggccaacttttcccgattatcacgccaagaagttgcaaggactagtcgaagactcggaggggccaggcgagggcgcgctcccccgcgcgctgcctcctccctcctccctccggccgcccgagctcccggcctctctcccgcccgcgctcactccctccggccgcctccctcctctggccccctccgcgcggcacagggcgcgggggtgccgcgaaactccgacccgagccacttggacttgccacagtgtccgcgggccgcaggggccgaccgacgcagtcgcgcagctctgctccgcctgccagtctcgcccgcgatcccgggccggggctgtggcgtcgactccgacccaggcagcagcagccccgcgcgggagccggaccgcgccggaggagctcggacggcatgctgagccccctccttggctgaagcccgagctgcggaggaagcccgggcaaacgcaaggctaaggagacaaagcggcgaagctcgcgagaaagccggacaagcagccggaggacaacgacgaggaggggacccccggagacggggcagcaaacaagacagcgcggatcgagacgctccgggacaccgaccgccgttacagaccaccacacacacgacaaaaagaagccaccaagcgacaaccccaacacccgaccacgaatcacaaccaaaaaccgcccaaccaagcacacaacctcacgccccccggcacaacctcggcaacaagcc

SEQ ID NO: 548700 - DNA, 253 bp, Homo sapiens
attatgcaaatgcagttttccgcatagacttccgtctctgcgaagtcgtcgaaacaggtatctgcgagaggtgccaagcaaggtctgacagggcctgttgaatcaagccgtttctatggatacgtaaacagtgtctcagtgacgccctgaacaatctcaacgagagaccttctgttcccagatcgagagctgcgggaagtggccatgagcgtaggcctcagcttcctgggtggtcccttaagccaacgtcctc

SEQ ID NO: 548701 - DNA, 1497 bp, Homo sapiens
  misc_feature (206)..(206): n is a, c, g, or t
  misc_feature (574)..(574): n is a, c, g, or t
  misc_feature (910)..(910): n is a, c, g, or t
gctctaagccgtgaccgcctcgtgagcgcgtgcatcttgctacataggacggaagtcctgaactattcgtccttcccagtcgcactggtgtcgtgccagacgactcattgagagtgtatcgatagatgcggctgaatcgttcgagtactatgctatagagaatgcgtactggtcgacggagtggtccgcttggctcgacagcttcntggagtgaaggaagtgcgaaggcggcttagtagcttggtgccgaaatcatctcggttggtgcaactgagagagacgagaggtatacgcgctcatggacacgccatgggattgatcttctgtacaccatggcgcgctgttccgaacctcgactagcgtgatcattcgtggggcatacccgttttccaccattgactgaggacggtagtaatgcgtgggaaaaatccccgacagaaggacgaataccagttcaccgtgttcgaatgcgatatagcctttatggctgtgcatcgtgtccgaggcaccttcttttgcaggacggcgtatctcgagaacgatatggggtgacacttgtagctatataaattanggcgcgtaagaaccttccagggacatacgatgtgcgctatgtgtaaacttgacgcttgactatactttaagcgaggctagcctccgtcccggtccagtcccttagtgggaccaacaacagaagaaaggaaaggcttgagtgccttcggaatagtacccctgtgtctaaacactttttgtttgctaacactccaatttcctgctgttttaaacggtaccagcaattcgctacctaggtgaccaggccccaaggataattgctcgggattttcctgtaagaacacgtcgcacgctttggaaccttgaagaagtcaaaagcggttcggctgaacgagcncctgtagcgcatgcacatataaggagcaaacgctcaaaagagaatcttcgagggcctggtggcttggggcttcaaacctttccgcaacgtgtattggttttccctaggcgcatgtcgcagctcgaacacttcgggagcagcgagtcagggtagattagcgtctctcccatagatttcgcgaacagtggcacgagctgggtgagcatctccaaggcatggaataaatttacccgcgcatgaggaaaggaggctgagcttcagtagacattccttagggcgtcaacctaacccagctatgatgggggtaccccatgggcgtaagcaaaccttgtaacagggaagcgagctctagaggttgaagtgagaaggtggcccaggcgtctagaacaaaatttgcgcctgcgacgaaccgtccaggatactcttagtcacctcctcaccagagcagtagatcacattaccacctctgcgctagtataggtcgtagagcaaatccctcagggccactagctaacattgagcgcgaaataattatgagcacgatctaaccgacagaaccagcacatctaaagagccattgacgtatg

SEQ ID NO: 548702 - DNA, 312 bp, Homo sapiens
tttctccttacattaaggtctctgaaggcctccaggttaccaatttgcgagggtatagtttgaatttcattgcagctcacatcatgttccatcaaacggctgacatgcccacttgctactggccgtgacaccactttgttattactagcaattaagactctcaatggcaaattacacaagtgtaccggcaatgttgacagttggatccgactaatatttaagaatgttagagcttgtaggttaaaattgcctctggaatataacgaatacaattttggcacaagttgagattttccagagaaacaaagcgac

SEQ ID NO: 548703 - DNA, 153 bp, Homo sapiens
ctgactgagtgataccgagaggtgggacacgggacagcgctggtagggacgtagaatggagcccagcgaagtgccaacacccaagagacctcgtgggctgaccaaatgggaagcaaaaacaagggtgctgccaagacccgtggtcccacctct

SEQ ID NO: 548704 - DNA, 713 bp, Homo sapiens
caacagagcttgactccatctcaaaataaaaaaaaacagaaaaaaacctctgcatagcaaaagagtgaacagacaacctgcagaatgggagaaaatatttgcaaactatacacccaacaggggactaatatccagaattttcaaggaactcaaactactcaacaaccaaacagacaatctcatcaaaaagtgggctaaggatatgaatagtcatttttcaaaaaaagaaaagcaaatggccaacaagaatatgaagaaagttcaacatcaccaatcatcacagaaatgcaaattaaaaccacagtgaaatatcatcttacaccaatcggaatggctgttactgaaaagacaaaaaaataacagatgttggctaggatatggagaaaaggaaattcttatacactgttggtgggaatgttaattagcataacctttatgtaaaacagtatctaccctgtgtgtgtttgtatatacatatatatatacatgtatgtgcgtatacatgtgtgtgtatatatacacacacatatactagtatttcattgggtgtggatatgtggatatatattcatgcacacattgcaccacacacacaatggaattcttttaagccatgaaagggaatgaaccgattctccagagaaagacaaatgttcatggtttcacttttaggggggagcttaatagattggccattatttccccattaatgt

SEQ ID NO: 548705 - DNA, 122 bp, Homo sapiens
  misc_feature (115)..(115): n is a, c, g, or t
acgcccgcctactactactactactgctcgaattcaagcttctaacgatgtacggggacatgatgtgaagagtttcacaaatctttcaaaataaaaagtaatgacttagaaactncaaaaaa

SEQ ID NO: 548706 - DNA, 1071 bp, Homo sapiens
tgcctggtcccttgcagggctggtggtggcccggtgccctgtgacctactccgtgtggcctgcctgctgtgtgatgcctgtgccacacttaaatgcctgaatccctgtgctccaatgaaacctgtgatgatgaatgaccaatgatgtgtctggatgaagatgtgtagaaaattgttgtgcatgatgtgcctataaatgtgcagaaatgtgcaaatgagtgaaccctgtgcaccctgcttgtggcttttgagtggagtgccatgactccaattttaacatcactgaagtccgcaagaatactggtgtttaaccgaaggggacattagttatcaagactgccatgtataaatgccctttgagatctcagatatgaacttgcatgtatcgttatttgatatttggggtcagttgtatgagtcctatgtcaagcctatttgagcttaagcccatgacttgtcacattgggacgatggtgttgaccgatccaagccacctctcaacacacgggcattactggtggtaccaagcttggatatgacggacagggttgcatgaacaccatttactgggaaacacagttaagtatccgcaagtacagtctggcattcagaaaactagcctatatgcttgccacttggacaacacaacaatggttggagttgttcactacacgccttctatgaatccaagaacgtctggacatcgtactgcaaacctgttccattctttcttcgtggacaacccattccaaacaagaatgcttccagcaagaagaactggtaccatattacacatgatgcaaatgaacggggggtactggcgtgatctgccagattcctggagcagagcttgactcgctggaagaagtggaaccctacccggaatcactaaagctgaaccctcaaacggccggacaacaggagagaccagggcaaaaacagaagggaatggccagcatgcgcggacatggcgcaaaaagcctaaagcaaagaaaaccacaaacaataccaaaacccacagagccacagaacagccgaaagaggcagaaaaagagaggaccagcaagcacaa

SEQ ID NO: 548707 - DNA, 433 bp, Homo sapiens
ctagaggtgggtggatacaacggtcaggagttcaagaccagcctggccagatgatgaaaccccgtttccactaaaaaaaaaaaaacaaaaaaatgaatagagattaagtgaccggggggataccacaacaggacccaacatatgcttgtgggagtctcgaaaggagaagagagaaaaaggcaaagagagtatctgaagaaatatgtaatctcagtacttggggaagccgaggcgggcagaccacctgaggtgaggggttcgagaacagcctggccaacatggtgaacccccgtctctaccaaagatacaaaaattagctgggcatggtgacacatgcctgcaatcccagctactcaagaggctaaggcaggagattcacctgaacccaaaaggcagaggttgcagtgagctgagatcatgacactgcactcca

SEQ ID NO: 548708 - DNA, 1126 bp, Homo sapiens
  misc_feature (22)..(22): n is a, c, g, or t
  misc_feature (128)..(128): n is a, c, g, or t
  misc_feature (132)..(132): n is a, c, g, or t
  misc_feature (138)..(138): n is a, c, g, or t
  misc_feature (152)..(152): n is a, c, g, or t
  misc_feature (162)..(162): n is a, c, g, or t
  misc_feature (173)..(173): n is a, c, g, or t
  misc_feature (186)..(187): n is a, c, g, or t
  misc_feature (218)..(218): n is a, c, g, or t
  misc_feature (239)..(239): n is a, c, g, or t
  misc_feature (248)..(248): n is a, c, g, or t
  misc_feature (250)..(250): n is a, c, g, or t
  misc_feature (276)..(276): n is a, c, g, or t
  misc_feature (300)..(300): n is a, c, g, or t
  misc_feature (598)..(598): n is a, c, g, or t
  misc_feature (610)..(610): n is a, c, g, or t
  misc_feature (612)..(612): n is a, c, g, or t
agcggagtgaaggttgcccgangatggtcgggcctggcgttgggcgtgcggccgggctgtcttgcagcttccagggctaactcaggtgagatggagccgctatagtcctgaattcaaggatcccttgnattngacaanggaatattatcgcnaagccagtgngaggagctaanctgaggacggagnnaatatgttccgggagctcaagaagactcagnctcatcaaaagctgctccagncagggaaanancaaagttctgtgtttgaagacccagntcatcagataaattcaccaacatngatgatgataggaggaaacaaagtactggccagatccctcatgattcagactctggaagctgtgaaaaggaagcagtttgagaagtaccatgccgcttctgcagaggaacaggcaaccatcgaacgcaatcccctacaccatcttccatcaagcactgaaacaactgtgagcctatgcattgggctggtacccatcctcaaggggaggccgtttctaccaggtccctgtaacccctacccgacgcggcgtcgcgcgtttcctagccatgaagtggatgatcactgagtgccgggatanaaaagcaccatngnacactgatgccggagaaagcttgtcacacaagctgctggaggcttaccataaccagtgccctgtgatcaagaggacagccttgattttgccacaaacggatggtcagaggccaaccgtgcctggcccacatacgctggtggtagagtctccaggaggagtcccagggccctctggcgcgaagacaacagtgtgagctactgccacgctgaaaactaacctggtgcgttacggatggtacgtccttcgtaacgggtgggcacggccttcgtagaccagaatgtacgcaggcatattcactattccgtcaatccttctcactttgaggctgaaccttgctctctctgcccctatttcctctgcacacagcagcgcgcaccatgactggaactttcctccaggaacctcagagctgttactcttaccttcacggtggggcggaccttcggatttctacaggaagccgttacgtatcagacaaaagactactagccaatcctacgcctgactgggtac

SEQ ID NO: 548709 - DNA, 787 bp, Homo sapiens
  misc_feature (654)..(654): n is a, c, g, or t
ctcctgctccaccccaggaccctcagccctgaagcccaggaagccacacgtaaccctgtctcatagcctcctgcctggcctgagatagcaaccactggccaatgactccctctcctggaaactctgcccccagggcatccctggggccaacctggtgtcctgccgttaccgcacagtccccatctcatctgcacctggccgtgaagcaggctcatctccaccccaattgggccctcatcccttgctgacctacccgaggcccgctctcctctgcccacctctgcccagcctccctcagctctacttgctggcccagaactgtgctctgagcgcctgcttctcagctccctgtgaatgttcagatgccgctccagctcttcccggcccacactgagctcccgacgttcctcacaagcctaaggggcccagtgggcccccgggtcctcctctcacccagctccctgagccagacgcctgtgccccgactcccctccctcccttgccagccatgtgcaaagccactccaaaggctacttggttttcctgccggtctctggggacatgcacttctccctcatttcagccaccagcatcccgccaggactccttgtggcctcactcatccacttctgcctgccctgcccctcgaatcangccccagaggaaaacacgatcgttgtgccccatgctgaagccgtgcgatggcgcttgctgttttctcggggtagggctgtcacctcaaacatgccttccaaggcccactgggcgtctcagcttcactcggccc

SEQ ID NO: 548710 - DNA, 1252 bp, Homo sapiens
ggtttggtggcgtctaagggtttattttgtatgtgttttgtttagtgattttttgtgtattgggacggtgggagtaggaagttgtgtggtgtccggtgagtgtggtttagtgggtgggagtatagaggtggtttgagtttaggtggtatggtttgttaagtctatatgttgtataatgttcattgtttggtgtgaactgtttggtagttttattatcaggatctattgttggtgggttggtgtgttaatagttgaggggtgttgtgtgtcatgcgagctttacagggtaaagtactttgcgcctttagttagagtctgatgtgggtgatgtttgttgctgtgggttattaatggcgtcaagtgatggtattattttctcctaggggtgtgtcaatagagggtgtatatggctgttgagggatagcgttcagtgaagcggtgtgtcagtatagggttggattctagtgatcgtgctagtgtatcgcagttcaggattggatagtttctgcgatggcatatagttggaatcgttgtttgatttattttagggacggtggatggttattcttcgtcctcgggacaagatgtggcggaggatgtgcaggtgatcagggtcttaggtggatatgtcgctacctttatcatgggaggagtagatggtagcagcttgtgtctgcaggcggtgctggctgcttgccggtggtgaacaaattcggggagttgtatctaactcttatgtgagattcttggaatatagcatatctgatgagaataagccaaggcagaatgaagatgactgttgtggaaatgcggaagaacgaccctcagagcatcactgctgatgatcttcaccaggctgtctcgtggtggctcggtgtctggtcgtcatgcagtgcgtggtcagacaacgctgtcaagagaacgatggctgagagcaaagcagctagagtcttgtagagaagaccgaggcttcagcagcataaatgtgtgaatggaaatgaactttaaagatgtaatacctatgaagagtaatgggcaaactgtagccacataagttgtaaaattacagatattcagtgttataccacagttgttgttataggtaagtttctatcacaaaccagtgacatttcctgaaatcatagcctggtgtaacatcgtgatgctttagtatgatattcagtaaggagcttttaccttaactgagtttcactggagcttttgaaatattcgtccgtaggataatgatata

SEQ ID NO: 548711 - DNA, 114 bp, Homo sapiens
aaacactccttccatgacccagcctgattacccttgattaatgcaccaaaccaggtgtattaattgcctcctgctaacctaacattattactctcaagctttattatcctcaag

SEQ ID NO: 548712 - DNA, 1169 bp, Homo sapiens
  misc_feature (22)..(22): n is a, c, g, or t
  misc_feature (128)..(128): n is a, c, g, or t
  misc_feature (132)..(132): n is a, c, g, or t
  misc_feature (138)..(138): n is a, c, g, or t
  misc_feature (152)..(152): n is a, c, g, or t
  misc_feature (162)..(162): n is a, c, g, or t
  misc_feature (173)..(173): n is a, c, g, or t
  misc_feature (186)..(187): n is a, c, g, or t
  misc_feature (198)..(198): n is a, c, g, or t
  misc_feature (205)..(205): n is a, c, g, or t
  misc_feature (261)..(261): n is a, c, g, or t
  misc_feature (282)..(282): n is a, c, g, or t
  misc_feature (291)..(291): n is a, c, g, or t
  misc_feature (293)..(293): n is a, c, g, or t
  misc_feature (319)..(319): n is a, c, g, or t
  misc_feature (343)..(343): n is a, c, g, or t
  misc_feature (641)..(641): n is a, c, g, or t
  misc_feature (653)..(653): n is a, c, g, or t
  misc_feature (655)..(655): n is a, c, g, or t
agcggagtgaaggttgcccgangatggtcgggcctggcgttgggcgtgcggccgggctgtcttgcagcttccagggctaactcaggtgagatggagccgctatagtcctgaattcaaggatcccttgnattngacaanggaatattatcgcnaagccagtgngaggagctaanctgaggacggagnnaatagtgcagngaaagcngcaacggcaacaacaaacttccgaacttttgttccgggagctcaagaagactcagnctcatcaaaagctgctccagncagggaaanancaaagttctgtgtttgaagacccagntcatcagataaattcaccaacatngatgatgataggaggaaacaaagtactggccagatccctcatgattcagactctggaagctgtgaaaaggaagcagtttgagaagtaccatgccgcttctgcagaggaacaggcaaccatcgaacgcaatcccctacaccatcttccatcaagcactgaaacaactgtgagcctatgcattgggctggtacccatcctcaaggggaggccgtttctaccaggtccctgtaacccctacccgacgcggcgtcgcgcgtttcctagccatgaagtggatgatcactgagtgccgggatanaaaagcaccatngnacactgatgccggagaaagcttgtcacacaagctgctggaggcttaccataaccagtgccctgtgatcaagaggacagccttgattttgccacaaacggatggtcagaggccaaccgtgcctggcccacatacgctggtggtagagtctccaggaggagtcccagggccctctggcgcgaagacaacagtgtgagctactgccacgctgaaaactaacctggtgcgttacggatggtacgtccttcgtaacgggtgggcacggccttcgtagaccagaatgtacgcaggcatattcactattccgtcaatccttctcactttgaggctgaaccttgctctctctgcccctatttcctctgcacacagcagcgcgcaccatgactggaactttcctccaggaacctcagagctgttactcttaccttcacggtggggcggaccttcggatttctacaggaagccgttacgtatcagacaaaagactactagccaatcctacgcctgactgggtac

SEQ ID NO: 548713 - DNA, 233 bp, Homo sapiens
cggatggattggtgacacatcactcactacgtccttgagtaatctaacgaagcattagtgctttttctgccaactcaagtcgtttatctaaaatttcaaaatatcgttcttcactaccgcgagctagaatgccaatttgaggtaagtttaaacttactacaccaatgttaaaacgtccatcaaacttgtattcaccattttcatccttccaaggagataagaaggatcgacag

SEQ ID NO: 548714 - DNA, 1348 bp, Homo sapiens
gctagacccgacagactagtgctagtgggccaggctgtcgctggttcgagcagtggaggaagagtatgtgattgcagtaaaggaggggagtaaggttacatggatgattagtgaaatatgcgccatattctaaaagagatgaagaacgtgcataatgtatgtatagtacaaaagtacgtagcgtgttatcatctgggaattgatgattgatccgagaaaaagcgagcaggacgtatttctagaggaattaagagcgttgtgatagaaacaatttattcccatatataaacaagcgaataggaattagttgacaggtagattgcacaaggagcaaggaatactaatcgatattgttactagaatacgggtggactgacctctgtgttaatagagagggaagttatagataaggctttgggtgctagtcgtattgggaaactaacacgacggcctaattgaatatagagcaggttgaatagagtgtcgaggcgatagccaaaaatataatcgtatagtttggaatctatttaaggatatgtgtgcaaagtgttagggcttagtacacggtgagcgcgaatggcttgctaaaaaaatagtgagttaccgcgggaattggtctagtagaaatctacattgatctgagagcatattggtagaattaggggtgaaacgaaggagttacgcatttggctattggccggatactaggttagaagaattcgccctgttaggcattggcggctcaatgaacttagaaaagcttgagcaaattaaagggcttgggccaaactttgcggggatttccattgagcgcgtagggaaaaaggattactctaacggcaaacttgtgtaaatggtctccgagaattttttggagtacgcacacatgaaataagggaaaatttttgaagggcgtaatttgagcatgagacgtggaggttcaaataatacaggtttaaaattggaaggcaacacccaaaattggatttttgaccctgtgagagataatttagtaaatggccatcagcattataagattcgcgtacattagtacagttttatagaccacaaggagaaccgttataagttcccacagatataactctctgttcaaggcgggtggaccctatcacatactgagcttcggcaacatttgaacagaatgtaaatccgcccatttgactccgggaaagcagtgtgatagaattaacaggtcgaacatactcgaaatgtgtcacctctaagcgcccacctttcatgttcactccatttaaagcgtatctggaaagaggggggaatcccgattaattagagtttgcacagcacaaatgttgggcagaacaaaatt

SEQ ID NO: 548715 - DNA, 107 bp, Homo sapiens
cctcagcttatactctcccactgtatgactattactcataataatgacattgatgttaattcttacaagttgctttttggaccgtgctagctttgtccctgatcagt

SEQ ID NO: 548716 - DNA, 251 bp, Homo sapiens
agatgcagtctcgctgtatcgcccaggctggagtgcagtggcatgatctcggctcagtgtaacctctgtagcaagttcccccaggccgtgggcaggtctagaggtgctgtctgggagccagggactgcagtcaaaaaccttaaaagtctacttggtgttctagtgtactgtggctgagctggcactcaagccatgagatgcagcccttcccactcttccctcccctttccaaagaccccttcccctcgtgc

SEQ ID NO: 548717 - DNA, 241 bp, Homo sapiens
atactctcagcacagaagaatacagggagcgagtcattaacgttttcttttaaacctttatgatgacttccttatgaatactgaacgaacactgaaatggactcaggtatcctgaggacatctctcaactctgggcttagtttccccctctgtaaaattaggggtgcaactaatatgatctacaaggtccctttccagcggccgcattcctaatggtttgtcggggtaccgagctccgaaa

SEQ ID NO: 548718 - DNA, 196 bp, Homo sapiens
ggactcagctgaaaatgcaccctgtctatgaggtagaagccttcactttccaggatcttgtaggacattggtcagaattctgccagttttggtgggttttctccctctctttgattcatttacaaaggacagcataacaaacgggaggcccaaagacaatgcactgtatgttgatgtaaccaagaaagcagactcg

SEQ ID NO: 548719 - DNA, 221 bp, Homo sapiens
agaaatccttacctttaaaaaaagcttctagtctccataacccccaaagtactgcttattttgttttgaaggaattccagcccatcgtaggttgctttagttcactattcgtaacattcatgatagggcaaggatttgaaaacaggattcttgcttctgttagtcatcaggtgaccagagcatcctacacaaccaataaggggctctatgttttgtgccat

SEQ ID NO: 548720 - DNA, 776 bp, Homo sapiens
  misc_feature (744)..(744): n is a, c, g, or t
ctgcactaggtcttccaaactaaataatgtattgaagagaaaaaaaaaaaagaggaagagagggagctctgcacatatactgcggaaaggctatgtgagctctcacagtagagaaggtagcactctacaagccagcatgagagccctcatcagaatccagccatgctctaccctgctctgagactatcagcctccagaactgtgatgaaatattgttgctgaaaccacacactctatgggatttttttatgggagcccaagccaacacagacacagtcattgctgtcacttacagacacgagaactctgactaggagagagataagttaaacttgtccaaggtcacacaagccagatacacgtgaggcgagaagttgaccttgttctcctcaatacaaagccaggactcctccactccacatgtagatagcgccctcacagtcaacagccatatgtgcacacaccagagtcagcattagaccaagatgtcttaccaggagacagatgcctcatctcgaataaatatgagctaacaacttacccatgtaaaacattgaatctcatgagaaacacaaatgcagaagatgtggaaaactatgtgtaccacttaactgacagtgatagctcaatgatatccttatagtcttggaggggtttgtatatgtggtgaaacacgtgctcacgcactgctgatagactagtaattggcctagagagagaataaataaactcggaggtgaatanacaataatagctattctattttagaagaatgg

SEQ ID NO: 548721 - DNA, 178 bp, Homo sapiens
  misc_feature (54)..(54): n is a, c, g, or t
  misc_feature (73)..(73): n is a, c, g, or t
  misc_feature (146)..(146): n is a, c, g, or t
  misc_feature (173)..(173): n is a, c, g, or t
tttttttgaccattagaaccaaaaaacattttttcatgtattagaacacacagnacaaggcaacacttattcnattttctcatcttctggtagggatctgttggtggcccctcctgttgcactgttgctctccgagccagtgttantatcactggttccttcctctgccatantgtcg

SEQ ID NO: 548722 - DNA, 439 bp, Homo sapiens
gctcactgcaacctctgcctcccgggttcaagcaattctcctgcctcagcctcctgagtagctggggattataggcgcatgctaccatgcctggctaatttttcttggtatttttcagtggacgatgcgggtttcacctgttgtttggcccaggcctgcgtctcaaaacttggcttggtctcaaagctcctgacctcatgatccgcctgccttggcctctcaaagtgcgggattacaggcgtgagctactgcacccgaccaattcttgtatttctttttttctctgggaaaaaatgggcgcttggccaggtggccaaggcgggccatcaagcctctggagccaaacgtgaccggcccacaccttgggcctcccaaggggcaggactacacgggctatgagccacaatgccaaggccccaaggggctgcacaacgcgatg

SEQ ID NO: 548723 - DNA, 533 bp, Homo sapiens
gggatccatccaccatttattggaccaaaaagggggtagggccaggagctctaggactggcccgggggggttctaaaggccccctggggttggaaaacaatggtctggaccctctactggggggcaggctgggttccaagttcccccaaatagctcaagaagttaacccgttccgttccaccctttttgatcaggggggtcaactgctcctttgacttttcaaaagaaaacttggccccggcctgaaactttgggcttttgaccttttccatcagggccttgccataaaaagacacgggctggaagaccctgaaaaccaggctttccccacatgggtcctttgcctgtttccgaaccaaaactcctttaagggttcaaaatggggaggggatacccacatttctgggaacccctttttttttggtaaccaggggggagggggggccacacccccgcctttttcccttggggtgtgggccccccccgccataaaggcgcaatccccgggccccacaccatggcgccctccccga

SEQ ID NO: 548724 - DNA, 1200 bp, Homo sapiens
  misc_feature (241)..(241): n is a, c, g, or t
  misc_feature (873)..(873): n is a, c, g, or t
gtcatactgccataggctgaccgcgttgcatgaaagcacagttggttcgcgttaccgccagccatctgggagtcacgagacttgattcaacacgcacaaagcattcgtgtcatcattcatttccgttactgcatgggacttccaagccgtcatatgcgctcatccttcagaaagatgaagatggtgctgacgatggtcgcgtctttactagcagtgcaacaggcagctaattgcatgtggntaggcctggagtggacccttatgatattactcatctgacaacgaaagaccgtgtatgcagccggtccaatcacgcctcttagtgagatggagaatcgacccgcggtagcatgtcggtcgtcgacagacattgctcaccacgtgatcaaccaacaatagcgataagcagaattccttgttccatcgcgtcacagcgtgggcaaatagaccctttcgaagggcggtgagagaagatcgcttgagcacaaaattgtattgtgctcgattcgctctggtggctactgcgatgaattgagtcaatgtctctccgctgcacatcgagaaccagggattactcattagggtagatagtagttgcacaagccgagaggaaggtgggtgggatccgataaccatccttttgtttgggaagcgaaggcatggagaggagatccgcttggtaacgttttgaaatcgcctccccttgagcaagactggacgttatgtaggacttggccacagtggatccccacacctcatgcgatagcactgagaagcggtcagataagcgccttaacaatgtgtccctgccgaacaacacccctggaggcccatcgaatagtgcaacagcgaatttctatcgatagccaagcnaaaaaatccctcaattcggtccaaaggactcaactggggccgcattgtaaaagcaacgggctggtgtgggcaaaaagttggagaaccatggtaagtatacgaccccacatgttcccgccgcatgcggccagcgaatacaagccctgttttattgacctgtggcagtggtacctctgaacatagatgcccagtaaaaggaaaacttgtgagacagatcgagacctctctgagaattgtcggctagccgggacacacccagctcagggttgtggaccagaagatatagcaggtaatggcaatatgtaagaagccatttctttaggacac

SEQ ID NO: 548725 - DNA, 207 bp, Homo sapiens
tggaaccgccattgaacgtgctagacaggtgtgagttggaggcaaagctctaaagctcgagtcgtgccctcggtgcaggggagacaatatagggcttgataagtctggccatattgtcagcttattcttgagcttgatacagggcaacgtcatagtcataaaattcaggaattccctggcttctatttttccccattaagtgttgta

SEQ ID NO: 548726 - DNA, 1084 bp, Homo sapiens
ccacgcgtccggcgagaatgaatactattctcagcaatcagactgtcgactttccagatgatgtcgaccattactctgaacgggacgcacagtttatcgtgaatggcccccagaggatccctgcgtatggacttcatatcactagtcaatagtagaactcaccccttcttggaagagaagaagaaacagatggctccgaggttgacaaatggtggggtacacagaaaaggacctggctaccgtgcggactattgtgtacgtacatgtacagaatcgatgatcaaggagtagttatcgcttgggtctctccgcttaacaatgatggaggtctgtgctatgctcacttccccatcgaacgttgttcatcccaggagcaatgggttctctatgtttgaacatccgtgaactttactatgagtgtgcatattgatacatccagctaggattcggtatgagaacacatggttgattgcatgtggtaactaggtcatcttcgaagactcctagcacaagcactgaaatattcaatccctttggatgcgcacacttgacagtttgaagcctttgcttttccagaaagtcctaggctggcctcttgaattgcaatgcgagaggccaatcatacaggtttagaaaatagctaatggaacttattctaggagccacttgtatgggcggagtggcatactccttaatgctctctccgtggaccccaagaggggaaacctggatgtccaggacatcggcccgtgactgcacacgttacacgaattcctaaggcgcaagtttaacccggtgggcttacccctaccaacggacatgactcgccccagtacctgtacaaacagtcttatagcaccacctacccttgtcttggactatgctttcagcactttgacatcggcacgattaaacacaccgcacccctacctggcgcaaattataggaacccctatccttgtccttttcaaatgtcacaccacatccatacctgcacttggccacaaaagacagcccacccaaacccaactccacgacaccatagcacctgcaacacacagctcacaaggcaaaacatacacac

SEQ ID NO: 548727 - DNA, 667 bp, Homo sapiens
  misc_feature (436)..(436): n is a, c, g, or t
  misc_feature (512)..(512): n is a, c, g, or t
  misc_feature (667)..(667): n is a, c, g, or t
ggataaggggtgtaggtgtgccttgtggtaagaagtgatgttgtgttctgctcagtgcatcttatcaggaggcacatgctgtatgtctgtctcattattggggatgtcaacttctgttacttggccaaggttgtgtttagctgcatggagttgtagattcttattttacctcatgaatattcattctacatttatttatttagatgcccaaacggtctcagatttggcccgtgtgggtgtattttttaaaattggacatgggtatcaaatcttccaaacacttttgcaacatcatggaggcttgcatataatttttctgcatagatatattaatgtggcatattatgtaaatagttttctaatgttatgacaaccttttctggaatacatctcatttggttgtggtgtattctattctcagagtggtatggcattnctgttgctagtgttttatttagctctttgcatccatattcatatgtgatattgcccctatatattgttttgcgcgngtgcgtattttcagttagatataagattatagcttcgtggagtttggaactttcattaatttttgtgctttgaacaattatgaaccaggagctatggttttgggaggttaagtgaaccccctgaggcatttgatatgctttttgggctttgtgcn

SEQ ID NO: 548728 - DNA, 607 bp, Homo sapiens
cggacgcgtgggcgaggaagatgaagaagagcttggtgaagaagaaaggggtcagaagcgaaaacgagaacctgaagatgagggagaagatgatgactaagtggaataacctattttgaaaaattcctattgtgatttgactgtttttacccatatcccctctccccccacccctccaatcctgcccctctgaaacttatattggactgatatgtaacgatcgcatgtgggaacgagaggggaaagagtgtactgggagttgcaggaggggagggatggcggatggcggtggaaataaaatactattttatactgccactcttaataatttttcccctacttcttctctgtgtccaggtattttgtccctgtaaatgcgatagctaagtacacaactaagtgacgcattgcgatcctgacatctacaacagagagacaggcacaggagtacacatatacgtacaccaaggatataccccaagatcatctagcaggatggccagcaaaggctggggactggacgtcaaagaagagatcactcaatgccccaggaggggctggacgcacccacaccaaatcaaaagcacagggacacatgaccgatacc

SEQ ID NO: 548729 - DNA, 212 bp, Homo sapiens
  misc_feature (15)..(15): n is a, c, g, or t
aaatactgctggaangagcactgttcattctagttcattttggagacagaatcttcttggctgttttatggagaccagttaggattagcacctcaagtgtcagtctacctctcttcctacaaatcagttaaggagaaaaccagaatacaaaactgaagtttgtttgctgcttctatgatatagaggaaatttctcagtggcaactttgtagg

SEQ ID NO: 548730 - DNA, 310 bp, Homo sapiens
gatagtagcagatagagatacgggcgcactctcatgctgcacggacgttcctgagtgagcaggctctggctgtatatgcgatggtgcttgagatagtacctagagacatagaggatcggatcaaggagcgtgctgtgatgtatgatgaggtgacgatgtctgataacacgattttatgtgtgaacaagcctttacactgaagttacacatgaccgtgggaggtaatatgtagtgcctagatggatcgtacattagatgggtctagatgagaaccatatgcgatgagctaggaactcgatgtggctaccac

SEQ ID NO: 548731 - DNA, 906 bp, Homo sapiens
  misc_feature (1)..(1): n is a, c, g, or t
  misc_feature (3)..(3): n is a, c, g, or t
  misc_feature (23)..(23): n is a, c, g, or t
ncnttgtgtgtcggtgtgtcggntgacttgtatgcgttgaccaagcgttactggtccctgccgcctgtggtgcctttcactaatttgtcgccgtcatgtggttttccctgcggacttccccttgtgggccccggacacgcggtgccttatgtacaaatctgggccactttggagattttgccacccgtccgtattctgacacacattgggggtccctataacagccagaggtgggcccccggcccggtgcagccccctatccggtggcagtcggggcccccaccctgaattcttgccgggttgtcacccctccctcacccgccctgttttggcgcccccatattcacagtcgggcttggtggcccagacaccccgtcttgagataagtgtcgccttccggccggttgatggaaattcgcgcgcgttgcccgccagtagtggtcagggcccagcccagcccacgggtgggccccgagattcccttatttccggcgggaggggcaacaccacatgagcatcgtggatccgagctaccccacgaccgggctcccgtcccctgggtgtgtcccctgcttgtcagcccggggggggagggtacagcctccttcccctgggcaggagttcccgccgcaagttcgcagtggcttccccccatggggagccgggattctctgcccggtgatctttcggtgcgcgcctggtgtcccccggaggcagccccccagagaggtattcccggggggcatgggcgcgtggccagcgagacaggggcccggcggtttcacacccagggtctcccaacatagttgggcatgggtctatacagaccccctcagcgcgccccgcgcggccaagccccctggcctcgccttttttaacccaaaaagcccccccttccacaaatca

SEQ ID NO: 548732 - DNA, 203 bp, Homo sapiens
attttttggtggggtaccgtccagtgcattggaggatgtttagcagaattcttggtctatacatacatacatattggttgccagggggcaccttcactccaattatgacaaccaaaatgtccccagacattgccaaatgtcccctaggcagggggcagggggcacagggaagggtaaggtattatccacatggtgagaaccac

SEQ ID NO: 548733 - DNA, 451 bp, Homo sapiens
gggaaggggcccccccccttttttcccttgggggggcccctgtaagggcccaaaaaaaaaaaaaaatttttttgggggccccccccccaaaccccaaaaaaaacccgttttttccccctttttataaaaaatacccccttgggcccttttttttttttttttggcccccccaaatttttttttttttaaaaaaagggttctgttaaaaaacccccaattgggttttaaaatttcccccccggccgcccgaccaaaaaccccgggggggcccttgaaaggaaaaaccccttttttttaaaaaaaagaaaaacccctggggaaaaccccccccctttgggttgtggggggccccccaaatttccccccggggaaggggggggttttttggccccccgcccccccccctttttttttaagggggggaaaaaaaaacccttttggtcccccccca

SEQ ID NO: 548734 - DNA, 111 bp, Homo sapiens
tagtcagctcggtcccctctcaagaccctgcttctaacctccctgttcttatgaattcgacagcaaatagtaactactactaatcaacgcccataatcatacaaagccccc

SEQ ID NO: 548735 - DNA, 111 bp, Homo sapiens
aagtgattaaggatccactgggtgcttactgggtgctttacctgggtgctttacctgggtgctaccactgatgtctaccacggacctcttgcagaggggtacgagctgaat

SEQ ID NO: 548736 - DNA, 420 bp, Homo sapiens
ggtgagtgctcttgtcagcggctgctccgcaggctggccttggttagggagccacctggcaggacgctggcacagccgaggcgggagggtgcttgcctgaatcttctcctagtctcatttctgtgaggtgcacgtgctgccccccaggcaccccaagacagcagctgccacgcttccccttaacctggtttcccaccaaaaatagagccaaggagtgagatttctgacagttgggagttgaaaggattttcccctcgggaaacagggaaacttttgggacccagaaactgctgcattttgcatcttaggaatgtttcacagattcgaggtgaatgaaaagaaaatgggctcatttttactgaaatatgtccacatttccagctgtgttcatcttggtacttaataaatgctaactagtaa

SEQ ID NO: 548737 - DNA, 846 bp, Homo sapiens
  misc_feature (41)..(41): n is a, c, g, or t
  misc_feature (98)..(98): n is a, c, g, or t
  misc_feature (230)..(230): n is a, c, g, or t
  misc_feature (375)..(375): n is a, c, g, or t
  misc_feature (390)..(390): n is a, c, g, or t
  misc_feature (393)..(393): n is a, c, g, or t
  misc_feature (397)..(397): n is a, c, g, or t
  misc_feature (403)..(404): n is a, c, g, or t
  misc_feature (410)..(410): n is a, c, g, or t
  misc_feature (412)..(412): n is a, c, g, or t
  misc_feature (416)..(416): n is a, c, g, or t
  misc_feature (419)..(419): n is a, c, g, or t
  misc_feature (430)..(430): n is a, c, g, or t
  misc_feature (438)..(438): n is a, c, g, or t
  misc_feature (446)..(446): n is a, c, g, or t
  misc_feature (482)..(482): n is a, c, g, or t
  misc_feature (489)..(489): n is a, c, g, or t
  misc_feature (493)..(493): n is a, c, g, or t
  misc_feature (509)..(509): n is a, c, g, or t
  misc_feature (522)..(522): n is a, c, g, or t
  misc_feature (533)..(533): n is a, c, g, or t
  misc_feature (563)..(563): n is a, c, g, or t
  misc_feature (664)..(664): n is a, c, g, or t
  misc_feature (684)..(684): n is a, c, g, or t
  misc_feature (828)..(828): n is a, c, g, or t
taaaattgaaagtcaaaacaaaaaagggggtttattaaggnaaagccatatatatatatatatatgtatagacaaatccaaagattgttacttctttncattttaataacctctgcatttttcttttacacatttaggcagtgtgctttcttttctcctcagttaaagcaacaccttggccaatatttctaaatcatattttgatgacaacttacaggatcagtgattgngacaatgactagtgtatcaaacgctatctgatagttttcttagcatattccgtgtgtggtggtacatttattgtggtgtgcaaaatctgacaactgacgatttttctctgtcagcaaaactaacaaatttttaaaaatgattttnatagttataactaanatncgcntcgccnnccccgncngtcnggngggcggggggngtgtgttnggcggttncccaaatccttttacatgttttagatggcctttggnatatgancgancacatggctgtgtttnagatctaaaggtnttgggattttnaaaatcaaaaattactttcttatgcgaaanggcaatgcaaacggcaatcctacataatgtagaataatttttcttctgtacggctccttctaaaaaatgggtaaccacacacacacacacacacacacacnacataaatttagtccatctnaagaagcactccagctttctaattccacttttgaaggaaaaggcagaggcatgtttacattatcccagaaaacagaataaatggctttatttggtatcttcaagaagcttctcctttccgtagagaatgtaggtgttgtggganaaactgtaactggttttc

SEQ ID NO: 548738 - DNA, 399 bp, Homo sapiens
ctccataatgtgtgcccatgagtttgaggctgccgtgagccatgatcacaccactgcactagcctgggcaacagagtgaaaccctgtctctaaaaatatttttctaaaaaaatcagacagacaataacaagtgctgatgctattcacaacagcaaagacatggtaacaacccagcccatcagcagtggattggatacagaaaatatgttacacatacaccatggaatactacacagccataaaaaagaatgaaatcatgtcctttgcaacaatatggatacagctggaagccattatcctaagcaaactaaagcagaaacggaaaaccaaacatcatatgttctcacttacaagtgggaactaaacactgtgcacacattatggaagggtaccgagctc

SEQ ID NO: 548739 - DNA, 706 bp, Homo sapiens
  misc_feature (72)..(72): n is a, c, g, or t
  misc_feature (113)..(113): n is a, c, g, or t
  misc_feature (546)..(546): n is a, c, g, or t
  misc_feature (550)..(550): n is a, c, g, or t
agtgtctcataaatgtaagcggctgctgctaattatgattgtgactcccatcatccagcagctgtgaagtanagtgccaagtacctcttctgtagcatctgtctctctttttnaaggagggggtcaggagcagaatcttatttttattttagattttcagtgtctttgctttgggaaagtttagtacagtagagggcaattgaacccctgtgcacccattatcacccagcagcaatcatcacctcatggctattcttgtaaactcctggctcctctcccaccagattatttggaagcaatcctagttgtcataccgtttcatctgtaaattagtacatattttaaaaatatgactctttttaaaaaaaaacaaccaactattgataccgtgatcacaccagcactgtaataactccttaatgttggccgggcacggtggctcactcctgtaatcccagcactttgggaggccgaggtgggcggatcatgaggtcaggagatcgagaccatcctggctaacatagtgaaaccccgtctctactaaanaatncaaaaaattagccaggcgtggtgcggccgcctgtagtgccagctactcccgaagctgaaggcaggagaatggcgtgaacccaggaggcggagcttgtagtgagctgagattgcgccactgcactccaacctgggcgacagagtgagctccgtctca

SEQ ID NO: 548740 - DNA, 681 bp, Homo sapiens
  misc_feature (72)..(72): n is a, c, g, or t
  misc_feature (113)..(113): n is a, c, g, or t
agtgtctcataaatgtaagcggctgctgctaattatgattgtgactcccatcatccagcagctgtgaagtanagtgccaagtacctcttctgtagcatctgtctctctttttnaaggagggggtcaggagcagaatcttatttttattttagattttcagtgtctttgctttgggaaagtttagtacagtagagggcaattgaacccctgtgcacccattatcacccagcagcaatcatcacctcatggctattcttgtaaactcctggctcctctcccaccagattatttggaagcaatcctagttgtcataccgtttcatctgtaaattagtacatattttaaaaatatgactctttttaaaaaaaaacaaccaactattgataccgtgatcacaccagcactgtaataactccttaatgttggccgggcacggtggctcactcctcggcttcccaaattgctgagattacaggcgtgagccatctcacccaacccattcctctttttatggagaaggtttctcttagcaatctatatggttaacctagcatatagtttgtaaaggaaagatagtttttttttgttttgcatatcattaggctatctctgattttaaattattgcgattggatttcaggttcccttgtgtggccgtcatgccctacttcttatgcctct

SEQ ID NO: 548741 - DNA, 105 bp, Homo sapiens
acggccgtgtattactgtgcgagagtccctctccttcattgtagtagtaccagctgctactactactactacatggacgtctggggcaaagggaccacggtcacc

SEQ ID NO: 548742 - DNA, 732 bp, Homo sapiens
gaccccggtggctgaacccccgagcacagagcccacccagcctgacgggcccaccaccctgggccccttggatctgctgcccagtgaggagctattgacagacacaagtaactcctcttcatccacgtggggaggaagacttggctgccctgcttcccgacctctccggccgcctcctcatcatgctctgtcttccatgtgggcgctgagcggctccagcagactgctcttctcggatcgtcgtcccttcctccagggcttcctacagcagtgcaagtgcacagacgtgaccctgagcccctggacgtggggactgcgagtgccacctagcgcctggttgctgacgtacagccatccgccatcgagcaacgccactgtggccccagggagcgcctcctggtggtgtgatgactacagcacgctgttccggcgcgtgccccaggcctggcggcgtgtgtggtgtgactccgaggtgctggcgcagtggcatcccctaccaggactacttctacagctgcccaccgttatcggcttcctggtgtctggcccggatcacggcgcgggccgagtgtcttctgagatccgctaccgactgctgccgtggcgcctgtgaagtcgctcattgggaacgactcgtgcggcggctttgggactatgtcccccttctggagcgagagttccccaggctgggaagaggccctgggggcggggccagttcccgggctggatccg

SEQ ID NO: 548743 - DNA, 738 bp, Homo sapiens
  misc_feature (6)..(6): n is a, c, g, or t
  misc_feature (98)..(98): n is a, c, g, or t
  misc_feature (133)..(133): n is a, c, g, or t
  misc_feature (137)..(137): n is a, c, g, or t
  misc_feature (151)..(151): n is a, c, g, or t
  misc_feature (158)..(158): n is a, c, g, or t
  misc_feature (163)..(163): n is a, c, g, or t
  misc_feature (176)..(176): n is a, c, g, or t
  misc_feature (204)..(206): n is a, c, g, or t
  misc_feature (209)..(209): n is a, c, g, or t
  misc_feature (217)..(217): n is a, c, g, or t
  misc_feature (247)..(247): n is a, c, g, or t
  misc_feature (266)..(266): n is a, c, g, or t
  misc_feature (277)..(277): n is a, c, g, or t
  misc_feature (280)..(280): n is a, c, g, or t
  misc_feature (306)..(306): n is a, c, g, or t
  misc_feature (314)..(314): n is a, c, g, or t
  misc_feature (316)..(316): n is a, c, g, or t
  misc_feature (318)..(318): n is a, c, g, or t
  misc_feature (335)..(336): n is a, c, g, or t
  misc_feature (408)..(408): n is a, c, g, or t
  misc_feature (425)..(425): n is a, c, g, or t
  misc_feature (453)..(453): n is a, c, g, or t
  misc_feature (493)..(493): n is a, c, g, or t
  misc_feature (652)..(652): n is a, c, g, or t
  misc_feature (720)..(720): n is a, c, g, or t
gtggcngttgttgatttgttgttttgtttaaaaaaaaaaagggttcacaaacttggcagaacttttctctgctggcttcacggcctgttctgttctcntaggctccacatgggggcgcaggggggtgggagangganggggggtcgaggcnggtgaanagtanaaaaagaagcccnactgaaagtagagagggcagtcccgggnnntcngggggacngagggcggcggcggcggcggcggcggcccngcagcagcagtagcaccanccggtagggtngcngctcccggcgctgtcacccgccggcnggtgggcncncngggggctggtgaggcgnnggaggggcggggcgggtggggagcctcactttctgtgctctctcctctttgctccactgcttttggcgttgnttgtccgtgtggctgtntggggttgttgctgaggtacattttgtncatggccttgagggcctcggtgagatagttctgcagggcngtggccgcggcacacaccgcggggctgccgaagccgtgggagatgaggttgaagtgggtcaagcagctctggatgccgggctccaggatggggttgggccgtgagttccccaggggagatcggtcctgagccagcaggtcggtgaactctttgcatatntgttttgtagccaggagcatgttttttcttgtcacttgctcattgggatcggaatgttgtcggttganaaattcagctactgcttt

SEQ ID NO: 548744 - DNA, 1403 bp, Homo sapiens
ctgtccgtccccagtgggaggatgagctgtcccccgggggtcgattgtgatgcccttcgctcctgggagcgcccatcgtgtccgagtctttgtggggcacaccgcgtctttccgttgtgggccctttgggtgtcgtgggtcccttggatgtcgtgtgggtttgcacggcgtctttctgtgggctcgccctcattctagtggcactgggtctggtcgtcgcctgtgcccaagaggggtctgtttctccgtcttgggggggttttgctgacccccgtctcggggggttaggtcccagccaatgtcctacccgggggggtgccctcaaagaccgtctgggctcctgccccacgttgtgtgtgcgccgcagtgcgtgtaagggatgaacccccccgtgttcgctcgttgggaagcgtcctccgcggggtgtgcttcggtgttctcactggagtttgtgcgccgtcgttggggtgcccgcaagagatttgccgctgccagaagttgttccctggggaggacgtctccaaagcggcggtattttttctctgagtgtgtgccccttatgggatacggctgttacacgagggccttccaagaggcccctcccggggaatttttcgcacccacggggccgcagaaagtgaactagtgttctctcccttgggtgtatgggcgcccccccagaagggggaaatagaggcggtggttaccagagaggcctgtgggtggggccttgtagaggggcacgggggcccataaaccctcgggggcacacacacacgagaagaggcacataattgggggagggggacacgggggttttttggggatgttcgggggggcaacacaccacaaggccacagagcgaccccacattctggggaattggcacacaccgtgggcaaagaggcccacactgttgtttggggggtattatgttggctggcacctttttcccacgggggagaggacaacacctcggtcacagagaactgtgtcgcacatatccgagagtataaatctacagagagcaccaccccgctgttcgcaaaggtgaagtatagggttctgttggtgttcctcgtgtcctcgtgtctgttcacctcgaggcgacacaggggcttggaggggctctctctctatgagcactgttctctcctctgggtgtcctctcgtgttcacagctcgcccacctcgtgagtgatccaccacgtgcccgaggtttctcggctggtatttggcacaagttaaaacctcccttcctatgctggtttagagctaacacacttaaccaaaaaggaaaaaagcccctcgtggggagcactagacttgagagagatttataccacacataccacacatagccccaggaacatcattttgaaataaagaagagttttggacca

SEQ ID NO: 548745 - DNA, 164 bp, Homo sapiens
ccttttactctcagtagtgctctgggctgatggataaacacactagaatttgacaccctggatgtttgcagctctgacaaaaccactattagcagtcattgtgatggcttttagggtgtctcccgtcccaaaaattgttaatgagcggctattaatttttgaac

SEQ ID NO: 548746 - DNA, 110 bp, Homo sapiens
gagaaatagctcggggcaggtgctggggtatgcggcttcgtagcgcacttgcagcttggggctcttatctgagagggaaccaatggattgccactactttgtccttgggg

SEQ ID NO: 548747 - DNA, 169 bp, Homo sapiens
agaaataggcgtggatcttgacaatagtagtactgggtctccatgatgattagcaggtgggaagacacgttacatgccccagcaagagactccgagaagccaccaacaactggatagcccctgaactgaagagctgatccaccaggcgtcgctccatgggggctgagcc

SEQ ID NO: 548748 - DNA, 344 bp, Homo sapiens
tatgccatgtcctcagtgtttggactgccagctgcaaggcagagccaaacccaatatggccccatcatcccctggctcagctgtgctacctggccatgctggaaggggtttgatcttccaggaatttgcttcacagctctttcctgtcccaagatctatgcctgatgtgtaaattcaggacccaaaagggcacaaaaaagcaataactactaaatataaggaaaacaactctgtatacagcatgtataaagaaaagcaagatatatttggggagataaaagttgtaaaggcattaagatgtgtgtttgttgagaaaaaataaatttgtgcatttaagaagttaa

SEQ ID NO: 548749 - DNA, 265 bp, Homo sapiens
ctaagtagcgaattgcaggatgaacatccctgaacagccatccatggatgactggcgcagaccatccgcaaacaactccaggccccgcgtctgcgtaactaatccctgaacaaatccccggaaggtttttgccttccggggattttttatttggccaggcccaggcgagggatctcaatagccgggcagcgatccatcaccacatttaacccggcatcccgtgccagtactgccgcttgctcattaatcacccccagttgcatcc

SEQ ID NO: 548750 - DNA, 571 bp, Homo sapiens
atatcgtcggaccggcgtcgggaggaggatggagggtggtcctgatgtgatctttcaggaggacacctctcaacacctctgccgcagaaggcccctgagctccggggcccagaatcacccagatcccaagcctgaggtactctgttattgtggaggtcctgctcggatgatgacaaggacgaggacaccgatcccggcagtcaacagtcactgacgagtcggagatgcaggacatgatgacccggggaaacctgggcctcctggagcaggccatcgccctgaaggctgaacaggtgcagcacagtcatgcgagccgggctgcccggctgccgagcagagccagctgtgcctgggcagagcccagcggaaggcagcaaagacccctggacaactgtgcaggaagagattcactacaggtaacacgatccttcaagagctgagaagccgtgagcatcaaagtgtccaacaccaaggctgttgatggcactggaccacgttaccgggcttgtaccctcaacacaccgacgactttctggactgtgcacccaaaggactaggatcacccccaaga

SEQ ID NO: 548751 - DNA, 237 bp, Homo sapiens
tgggggggggggggattctacagagggggggggttaaaaaatgccgcccataattttttattttctaaagggatttttttttcccatacaaatagcccccatccctaaccaactggtatcttgggggcgtccttgggaatttaaaccctttaaacctaatttttttgttaaaagaccctaaaagccttcccagcggtttttcccaccctaggaggggagggaaaaaaaaactttcca

SEQ ID NO: 548752 - DNA, 168 bp, Homo sapiens
ccggatcttcgcgcggttcttcggcgcgggattcttcggcgccgggattccttcggcgccggatccttcggccgcgggattccttcgggcgccggattcctgccggggtcggccgccggattcctttaagtttcagctttgaaccatactccccccggaacccaaaga

SEQ ID NO: 548753 - DNA, 1426 bp, Homo sapiens
gcagcttataatgccattacttatacctgaagaatttcatgactttgatcagccactgcctgcacttcagcatgcacatcgcatgtggccccagccagttccagctctgcacatccagcagtcagcagtggcaagcagcatcaacccatgcagcagcaagcaagtttgggcaaccatcgagtcattttcaccaagcaaaatgcattttgcgtgcattttagggcaatggcatgcatcagtgcagcatcacatgcagcacgcacaggccagtagcttcacgcagagcatgcacgcaccatggttcaagtcaagccactcactcacttctcaaccctcctcattcagcagtctagcacaacagcagccacccagccacatctgcacatgcagcacacaattcacacccagtttcagcacatcatgcacagcatccaatatcacagggcatgcatcacatatttgcgcagcacggcacacatgcatgggtggcacatcattcagcatgcacccacacttcattcagtcaatcacatgcatggcagggtcatcatttagcatgcatcccccctgcccctcatctgcaggccaggggcgtagcatggtatagcccagcaagccagccctgccaccaatgcacgcatcatcggccatgcagagcatgccatcaacgtccatccacagggagcgagcgagccctgcactcacgtccatgcaaaccaagctgggcaccccagctatgcaacccaaatggcccacaccccatgcacgtgcatcccacacccaaccacttggtcccacaaatgcagggcacagacacgccagtcggcactggagcgccccatcctaggcagtactcaaactggtaacaacgcaaacccacaaaggccgccacaacggcacacccaggcaagcacataacatgggtggacaacgacgccacacacggagcctgggcactcaccccacgcaccactagaacgaccccactagctgacacacaggacgtaacaccgaacataattgcggatgacaacactcactgagcccccatgccaccgccacacactccccaacgccgcgaccgcccgcagcgaccagcgcacccaggacggccgcacgcccactacactggcgacgcaccaagccctggcaccggacccgtagaccggcccacgcgccgccacaaccacgcgcgacagccgaacacaccacacaacacagagcaagcgcccgagcgagggacccagcgcagcaaccgcacacacaaagagcgacccggcgcaccagcgcgctccacaactgacgaccacgagagcagcgccgcacaaccacggcccacaagacgacgcacaacgaaatcgaccaagcacagtgcagaccccggcggccgcgccacccacgaacagccagaaccgtcgaatgccac

SEQ ID NO: 548754 - DNA, 201 bp, Homo sapiens
gacacggcgctgaacgtcaacggtaacacctccctggtgaccatcaccttcagcgagacggtcaacaatcttgccctcggcgcgttaactgttgctgatggcagtctgagcaacctggtccaggtcgacggcacccactggaccgcgaccctgaccgcgaaccccggggtcaaccatgtcggcgatgtcatcagtcgacgc

SEQ ID NO: 548755 - DNA, 227 bp, Homo sapiens
  misc_feature (4)..(4): n is a, c, g, or t
ccgnagttaagggctacccccctctacacatttcagcaagaataatgatctaggccttgtttcctgagttgggaagggactggaaaggggattaaacgagaagaacaaaaatgaaagggtaggcatgatagcaggtaagaaattaaaacttcatctgtgtaactccagagaccagcaatcaggctctgaaacaacacagcttgcacgacaggcttaactttctactt

SEQ ID NO: 548756 - DNA, 255 bp, Homo sapiens
  misc_feature (238)..(238): n is a, c, g, or t
cgcgcgttcgggcactagataacccctttccgggttccagagtcggttagataaggtagtagattccatggatgcattagataaagttgtccaggacagagaagattctctctggcttcttcagcactgttcaagacagagctagacctgtctgcttggagcaatagacatctttgcgaagaatcatctaggcatcaagttcaatgccgtgcgttaataactctaggcccctatatanacagatacaatactgag

SEQ ID NO: 548757 - DNA, 420 bp, Homo sapiens
gtcctgcacttaatctgcactttgggccttacttgggggtaaatagcatcattgtgcacagaaatgccagacagtgttttgtgttgatagaaacgtattcagaaagcaatgcccattgttccccctggctaaataataattccgtttccaggcagtttgctgattaatcagacaggtgtctttcgttccaccaagaaaaacaaaatctgtcagcaagatgattaagaatagataggcatatttcaaaacaattaaaatagcatttttacaagtctggtcctttaaacattgagtagctgcctgctgttggaggctttcaggaaacacacaccacatccaagcatgccatcctgttaatacgcaatacgtctctaaaggtgctcttcaggcattcctccctgaatatgtctgaaacctcac

SEQ ID NO: 548758 - DNA, 170 bp, Homo sapiens
acagtgtgtgagcaccgctcctggctggcagcattgtcttgctctactgacctcgtgatctgccgccttggctcccaaagtgctgggattataggtgtgagccaccgtgcccggctgctggctgacattttcaaagatggcacgtggctggagcacttacgcgctgaaat

SEQ ID NO: 548759 - DNA, 155 bp, Homo sapiens
acgggatcgtgatccccttagcataggtatcattaaagcgcactcgacataatttacaatggaaccgaattacttttccttcatcatttcgtacctcttccacataatcatggcccactggatgcacatcactcctgtaaaggcagcaatgagat

SEQ ID NO: 548760 - DNA, 2610 bp, Homo sapiens
aagagagggaggaaggagaggagctccataagcccagacaagggcttgagagcagacaagggcttgagagcagacaagggcttgagagctggccaagcagtttctctcagcttctgtgttccagcccctctgtgggaggagagaagggcaggaccacaagcctgccagaggctgcggcctacagccggggagaggccagcccggcctacagtgcggacacaggacagaggggagccaggttctttgcactgaccaatgctgagagcagaccctcggagcagccgggttggaagtgtctctccacagtcaccagacagatccaggataggatgggcagcccagtgcaccgagtgtcattgggggatacctggagcaggcaaatgcaccccgacatagagagcgagaggtatatgcagtcctttgacgtggaacggctcaccaacatccttgatggaggtgcccagaacactgcactccgcaggaaagttgagagcatcatccacagttacccggagtttagctgtaaggacaattatttcatgacccagaatgagcgttataaggctgccatgcggagggcattccacatccggttgatagctcggcgcctgggttggttagaagatggtcgtgaattaggctacgcttacagagccctttctggagacgtggccttaaatatacacagagtcttcgtgagagccctcaggagcctgggctcagaggagcagattgccaaatgggacccactctgcaaaaacatccagatcatcgcaacgtatgcacagacagagttgggacatgggacatatcttcagggcctggagactgaagccacctatgacgcagccacccaggagtttgtgatacacagccccacgctgactgccaccaaatggtggcctggagacttgggacggtcagccacccatgccctggtccaggcccagctgatctgctcaggagccaggcggggcatgcacgcttttattgtgccaatccggagtcttcaggaccacaccccactgccaggaatcatcattggggacatcggacccaagatggactttgatcaaacagacaatggcttcctgcagctgaaccatgtgcgggtccccagggagaacatgctgagtcgctttgcacaggtcttgccagatggcacctacgtcaaactcggtacagcacagagcaactaccttcccatggtggtggtgcgggtggagctgctgtcaggggagatcctccctatactgcagaaggcctgtgtcatcgccatgcgctactcggtcatccgccgccaatcccggctccggcccagtgacccagaggcaaaggtcctggactaccagacacaacagcagaaactctttcctcagctggccatcagttatgccttccatttcctggcagtcagcctcttggagttcttccagcactcctacactgccattctgaaccaagacttcagcttcctgcctgagctccacgcactgagcacgggcatgaaggccatgatgtcagaattctgcacccagggagctgagatgtgccgcagggcctgtggcggacatggctactcaaagctgagtggcctgccatcactggtcaccaaattgtcggcctcctgtacctacgagggtgagaacacagtgctctacctgcaggtggccaggttcctggtgaagagctacctgcagactcagatgtcccctggctccacgccacagagatctctctctccatctgtcgcatatctcaccgcacctgacctggccaggtgtccagcccagagggcagccgacttcctctgcccggagctctacaccacggcctgggcacatgtggcagtaaggctcataaaggactcagtgcagcatttacagaccctgacgcaatccggagctgaccagcacgaggcttggaaccagaccactgtcatacacctccaggctgctaaggtgcactgctactatgtcactgtgaagggttttacagaagctctggagaaactagaaaatgaaccagcgattcagcaggtgctcaagcgcctctgtgacctccatgccatacatggaatcttgactaactcgggtgactttctccatgacgccttcctgtctggtgcccaagtggacatggcaagaacagcctacctggacctgctccgcctgatccggaaggatgccatcctgttaactgatgcttttgacttcaccgatcagtgtttaaattcagcacttggctgttatgatggaaacgtctacgaacgcctgttccagtgggctcagaagtcaccaaccaatactcaggagaaccctgcctatgaggaatatataagaccacttttacaaagttggagatccaagctatgaaataaccaacagtattcaagaagcaaccagcaccatcatgtgataatggtactatggcatatatgcaacattaaaatttaaattagaaaaacaaaaactatctaaaaaaaaaatttttggggggttgggcttcgaaaaaggttttttaaacatttgtttgggggggggggcccgttgggttgtgtaacgtggtgcaaggggttcccaagaaaactcggggaaaaaaaggggcggg

SEQ ID NO: 548761 - DNA, 635 bp, Homo sapiens
  misc_feature (44)..(44): n is a, c, g, or t
  misc_feature (122)..(122): n is a, c, g, or t
  misc_feature (529)..(529): n is a, c, g, or t
atattaagttataggcctggaggaggctctgtatgtcctcgagngactgacaacatcctccagattccagccataaaccaataactaggctggacccttcccactacataatagggctcagnccaggcagccagcttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcaggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtnaaggccactgccaggtccccagtgcgccccctagtggccatagctggttaaagttccccagtgcctccttgtgcatagaccttcttctcccaccccttctgccctg

SEQ ID NO: 548762 - DNA, 2544 bp, Homo sapiens
aagagagggaggaaggagaggagctccataagcccagacaagggcttgagagcagacaagggcttgagagcagacaagggcttgagagctggccaagcagtttctctcagcttctgtgttccagcccctctgtgggaggagagaagggcaggaccacaagcctgccagaggctgcggcctacagccggggagaggccagcccggcctacagtgcggacacaggacagaggggagccaggttctttgcactgaccaatgctgagagcagaccctcggagcagccgggttggaagtgtctctccacagtcaccagacagatccaggataggatgggcagcccagtgcaccgagtgtcattgggggatacctggagcaggcaaatgcaccccgacatagagagcgagaggtatatgcagtcctttgacgtggaacggctcaccaacatccttgatggaggtgcccagaacactgcactccgcaggaaagttgagagcatcatccacagttacccggagtttagctgtaaggacaattatttcatgacccagaatgagcgttataaggctgccatgcggagggcattccacatccggttgatagctcggcgcctgggttggttagaagatggtcgtgaattaggctacgcttacagagccctttctggagacgtggccttaaatatacacagagtcttcgtgagagccctcaggagcctgggctcagaggagcagattgccaaatgggacccactctgcaaaaacatccagatcatcgcaacgtatgcacagacagagttgggacatgggacatatcttcagggcctggagactgaagccacctatgacgcagccacccaggagtttgtgatacacagccccacgctgactgccaccaaatggtggcctggagacttgggacggtcagccacccatgccctggtccaggcccagctgatctgctcaggagccaggcggggcatgcacgcttttattgtgccaatccggagtcttcaggaccacaccccactgccaggaatcatcattggggacatcggacccaagatggactttgatcaaacagacaatggcttcctgcagctgaaccatgtgcgggtccccagggagaacatgctgagtcgctttgcacaggtcttgccagatggcacctacgtcaaactcggtacagcacagagcaactaccttcccatggtggtggtgcgggtggagctgctgtcaggggagatcctccctatactgcagaaggcctgtgtcatcgccatgcgctactcggtcatccgccgccaatcccggctccggcccagtgacccagaggcaaaggtcctggactaccagacacaacagcagaaactctttcctcagctggccatcagttatgccttccatttcctggcagtcagcctcttggagttcttccagcactcctacactgccattctgaaccaagacttcagcttcctgcctgagctccacgcactgagcacgggcatgaaggccatgatgtcagaattctgcacccagggagctgagatgtgccgcagggcctgtggcggacatggctactcaaagctgagtggcctgccatcactggtcaccaaattgtcggcctcctgtacctacgagggtgagaacacagtgctctacctgcaggtggccaggttcctggtgaagagctacctgcagactcagatgtcccctggctccacgccacagagatctctctctccatctgtcgcatatctcaccgcacctgacctggccaggtgtccagcccagagggcagccgacttcctctgcccggagctctacaccacggcctgggcacatgtggcagtaaggctcataaaggactcagtgcagcatttacagaccctgacgcaatccggagctgaccagcacgaggcttggaaccagaccactgtcatacacctccaggctgctaaggtgcactgctactatgtcactgtgaagggttttacagaagctctggagaaactagaaaatgaaccagcgattcagcaggtgctcaagcgcctctgtgacctccatgccatacatggaatcttgactaactcgggtgactttctccatgacgccttcctgtctggtgcccaagtggacatggcaagaacagcctacctggacctgctccgcctgatccgtgaaatacgatgtaaagccatccaggcaaaagagatgggaaaggtggatagtgtcaatctgaggatcaaagagatggaaggatgccatcctgttaactgatgcttttgacttcaccgatcagtgtttaaattcagcacttggctgttatgatggaaacgtctacgaacgcctgttccagtgggctcagaagtcaccaaccaatactcaggagaaccctgcctatgaggaatatataagaccacttttacaaagttggagatccaagctatgaaataaccaacagtattcaagaagcaaccagcaccatcatgtgataatggtactatggcatatatgcaacattaaaattttaaattagatattt

SEQ ID NO: 548763 - DNA, 262 bp, Homo sapiens
  misc_feature (171)..(171): n is a, c, g, or t
gagctggtccgacgacagggcgactccatcttcatggccaccccctcgtgggacggttgaccaccagcctaccacatcatcccagagctgagctcctccagcgggatgacgccgtccccatcacctccctcttcttctttttcatccttctgtctctattgtttcttgagncttttccgtgttctttcctctttgttcttgacgagacttcataagccgtccacgaactcctgtttacccccgatccccttctgacatttaa

SEQ ID NO: 548764 - DNA, 266 bp, Homo sapiens
aaccaacaattttcaacagcaattttaccagttcaacagaatccctgcaggctgggcgtggtggctcaaacctgtaatcctaggactttgggcaggccgaggtgggcggatcaccaaggtcacgagatggagcaccatcttggacaacatggtgaacaccccatctctcactaaaaatacaaaacattagccaggcgtggtggcaccatgcctgtagtccccagctcactggggcaggctgcaggcaggagaacgcgtcaaaatcg

SEQ ID NO: 548765 - DNA, 1171 bp, Homo sapiens
gacctcagagctgagctgggcatgagtagatgctcagtaagtggtgcacagggttggtccctatggtggaggccccctaacaccgcccaacccccctccatgttctcacagctccacgcactgagcacgggcatgaaggccatgatgtcagaattctgcacccagggagctgagatgtgccgcagggcctgtggcggacatggctactcaaagctgagtggcctgccatcactggtcaccaaattgtcggcctcctgtacctacgagggtgagaacacagtgctctacctgcaggtggccaggttcctggtgaagagctacctgcagactcagatgtcccctggctccacgccacagagatctctctctccatctgtcgcatatctcaccgcacctgacctggccaggtgtccagcccagagggcagccgacttcctctgcccggagctctacaccacggcctgggcacatgtggcagtaaggctcataaaggactcagtgcagcatttacagaccctgacgcaatccggagctgaccagcacgaggcttggaaccagaccactgtcatacacctccaggctgctaaggtgcactgctactatgtcactgtgaagggttttacagaagctctggagaaactagaaaatgaaccagcgattcagcaggtgctcaagcgcctctgtgacctccatgccatacatggaatcttgactaactcgggtgactttctccatgacgccttcctgtctggtgcccaagtggacatggcaagaacagcctacctggacctgctccgcctgatccgtgaaatacgatgtaaagccatccaggcaaaagagatgggaaaggtggatagtgtcaatctgaggatcaaagagatggaaggatgccatcctgttaactgatgcttttgacttcaccgatcagtgtttaaattcagcacttggctgttatgatggaaacgtctacgaacgcctgttccagtgggctcagaagtcaccaaccaatactcaggagaaccctgcctatgaggaatatataagaccacttttacaaagttggagatccaagctatgaaataaccaacagtattcaagaagcaaccagcaccatcatgtgataatggtactatggcatatatgcaacattaaaattttaaattagatattt

SEQ ID NO: 548766 - DNA, 308 bp, Homo sapiens
  misc_feature (187)..(187): n is a, c, g, or t
tgtgatgaacggaggggtgcggtgggcagaataacggcctcccaaagatgtccactgtgacagtccccagagcctgtgactatgttaggttacacatgccagtgggaactaaatgttgcatgatggaactaatggtggctaatcatgctgacctgaaaatatgaaagacgacctgggttctctgggntaggcgcaagtgtgatcatagagcgtccttaaaatgcggtaggagcaggccgggtacatgtgactcagtgcctagtgtgcgcagttgtggagacggggttgttgtcgaggaaacgaggtgt

SEQ ID NO: 548767 - DNA, 395 bp, Homo sapiens
aggatccccagtccgtgagccccttggaggactggttgaataagtgacatcagtgatacctggactgaacaacatcattgacataaaggtcactgacccccagctgctggaacttgggcttgtgcagatgccctgatggacaccgtctctatgtcaccatccctctcggcataaagctccaagatgaatactgcccctgggtcggtgcaagtcatgttgaggctggctgtgaaactggacatcactgcagaaatcttaactatgagagataagcacggagaggatccaacctggtccttggtgaactgcacccattcccctggaaagctgcaaaatacactgcttgatggacttggacccctccccattcaaggactactggacagcttcacagg

SEQ ID NO: 548768 - DNA, 1741 bp, Homo sapiens
  misc_feature (342)..(342): n is a, c, g, or t
  misc_feature (394)..(394): n is a, c, g, or t
  misc_feature (471)..(471): n is a, c, g, or t
  misc_feature (529)..(529): n is a, c, g, or t
  misc_feature (620)..(620): n is a, c, g, or t
  misc_feature (823)..(823): n is a, c, g, or t
  misc_feature (1273)..(1273): n is a, c, g, or t
gactcagcgccgacttcggagagaatgcgctctgtgtgtctctgctcccggaggattagctagtgaggcttcacacagacaggcgtccaacaattctgcgcgaacgagaagtgatgcgggatcccatgtgggctcctgagtccaattgctgcacacgggacatcacgagcgtggcgtcgctggctcgaggcacaggcagccaaaggactcgtagtgcacaccgtcgcctgatgaggcctcctgggttccgctgaatccttgcacgatggcttgcgcgtgccttctgacacgacggcgtatccatgggcgccgggtgagtggcggggtcacgggaggcgacgnctggcacaagcgcgcccagtggcctgggtggtgtaactcctggagagcgaantgctgcagggattcactcgtcatgaatggacgaagacgcggattgcgacaaaggccatgtggacactgacactcggnccttgggacctacttggacgcgttgcgacactagagatgatggaagcactggggcacnaccgtgaggagcgcagctatggttgggtagctagtcacacaatcgcagcgaagccgactgtaggggcagagaggacagggggagcctcgcnatgggttcccagaggaagctcgcgaagggccagtatgagctctacgaaggcacttcgaatgcctagggggagcccttctgaagagggatgccttggattcctcttgcgggggagagactcaacgtagttggcgcagcgaactagatcgctgcaattgcctctactccgaggggaattcgtagacaaaatcgtgccacggggtncttgggggccttgccgtagaccgtacccgtgtatagggacgaatcggagggtagttaaacgcatcgggaacgcccctgtgcattgccccatgaacggcgcatcatggcttggtgtgggacgcacgaaacgggagacttgcgcaggtgtgcattttgcgccgccatttagagttcacctcgtgattgatgagaattcgattcctagttcgtatggaaacaggagacttcggtacaccgggttggggacgaccccctttgaggaattgcgccaagcggaggttctctccgacagcggaaaggagataggtcttgggggtctggtaacgacttagcataggtggcaggggtataggctgcaccgaccaaaggaccgggagacgttgacacttttacagggccctgaggcgaagggctcgtgagacatttgcacaaaaagcgtcttgtgcggtntttggaaccccgttggtaggggtccagtatttggcgggccaaagagttcattcaaggagatggtccgtccattcgagtcccatggacaagaaagggtttctcggtgtcccagctgattgatcccaacgtgggaactctttatggaaaggctccacaggtgaggcttatcccccgagggggggttcctgggtcggaattgtccgtataccccaccctggtggggtggtcaccgcataaaagagatgtcaggggtgtgcacgtggtttcacaaagaatgtctctagaggggtaatgagattagagcccactcatgttgggggaacctcagggcaacccataataaatcttcctgtccgatgtgtgaaacactcaagcggatgatgtacatcatgtcccaaccgagcagcgggaaggctagattttgacagataccaaccagcaagaaagcgccgatgaatgaacgtactg

SEQ ID NO: 548769 - DNA, 443 bp, Homo sapiens
ctggaatgcagtggcacaatctctctgctcactgcagcctctgcttcccaggttcaggcagttctcctgcctcggcctcctgagtagctgggactacagacacgcaccagcacgcctggctcatgcctgtaattccagcactttgagaggccaaggcgggtggatcacgaggtcaggagatcgagaccatcctggctaacacagtgaaaccctgtctctactaaaaatacaaaaaattagccaggcgtgcgcctgtaatcccagctactcgggagtctgaggcaggagaatcacttgagcctgggaggcggaggttgcagtgagccgagattgcgccactgcacttcagcctgggtgacagagcgagactctgtctcaaaaaaaaagacaaaagtgatttcctgagctgctccgagctggagacagaaccatcagcctgggcg

SEQ ID NO: 548770 - DNA, 535 bp, Homo sapiens
cctcatcgcgtttatacttctcttaaagctatgcaaggcagctctggctaagtcttaaagaggaagaagaaagacagaagagagaagaagtaagaacgtataataacggcttgaagaattgagaagccaagcgtaaagaagaggaacgattggaacatgaaaaaagagaaaggaaaaagcaaaaagaaaaagaaagaaaagaacgcttgaaaaaagaagggaaacttttaactaaatcccagagagaagccagagccagagccgaagctactcttaaactgctacaagctcagggtgttgaagtgccatcaaaagactctttgccaaagaagaggccaatttatgaagataaaaagaggaaaaaaataccacaagcagctagaaagtaaagaagtgtctgaatcaatggaattatgtgctgctgtagaagttatggaacaaggagtaccagaaaaggaagagacaccacctcctgttgaaccagaagaagaagaagatactgaggatgctggattggatgattgggaagctatgg

SEQ ID NO: 548771 - DNA, 790 bp, Homo sapiens
ctacacaacaactgataggtgacatccgggaagactgtgacccccatagtacccagcctatgaggaaccagggactactacaagcaatttaggggataaattgcttgttgtaaccatgctgggggtgcctgagcatcagacacctgatcttgcaagaccatcattaaaagtctcactttcagtgttctcaaggtctctgagtcccttctttgggtttggacaggtgagtttatttctcaggacctggtggcctatatggggaactctgtgcctgcatggagtgggactccagccgagaggggagatgcatcccacctgatttaggtggcctgctctgcccaagtgtcttgtctccctgcagaaccatagacaaacctgagactgttattcaggagatgtgaaagtgacacagggagaaaagctggcaccccagcaactgggcaacctcgtgtttgagccaaggtaggaaaactggactatgtgtactgccttggtggttcagcattttcagaggtgagtgtgtgtgactgagatgtatctagatacgagcgagtgcagagtcccatccgtggttatgtcctccacagggaacagctgagacagatgaagtgatctcagggcatgcaggaactcagtcgggctagtaggaagctcgcacgagactaactgaaaaatgtgaaataagaattctaggcctagggaacagaggaaagaggggaactgaagagactccctctgaaattccccccgggaaaagccaagatataaaattttgcctgtttttttctgg

SEQ ID NO: 548772 - DNA, 385 bp, Homo sapiens
  misc_feature (288)..(288): n is a, c, g, or t
  misc_feature (308)..(308): n is a, c, g, or t
gctaagtagtagtccatggtatggatggaccacggtttgtttaatccatccgaggacctttttaaaatacttgtgcccagatgcagtggctcactcctgtaatcccggcacttggtgaggtcaaggcgggaggattgcttgaccccaggaattcgagaccatactgggcaacatggcaaaaccctgtctctacccaaaatacaaaaattagctgggcgtggtggtgcacacctgtagtcccagctacttgggagactgagatcaggaggatggtttgagcctgggagnagaggttgcagtaagctgangattgtgccactgactccagcctgggcaacagagccaggccttgtctcaacaatcaatcaatcgatcgtgtgttcct

SEQ ID NO: 548773 - DNA, 439 bp, Homo sapiens
  misc_feature (161)..(161): n is a, c, g, or t
  misc_feature (235)..(235): n is a, c, g, or t
  misc_feature (278)..(278): n is a, c, g, or t
tctagaggatcgcgggtcagtgatctctgggtcaagtgatcctctaagaagaaacagaaactaatctctctccatgacacgtgagaacacagtgtctgcagcagaaggagtgtaccctcaccaggaaccaaatccaggccagtacttggatcttatactgnctagctttcaaaactgtaagaaataaatggctgttgttgaagacatccagtctatgatattctgttacaccaanccaagcagactaagacagctgtgttccaataaaactttatttngcaaagcagacagtagggcagatttggctcatgggccaaagctgatgacccctggttaagaacacagacacagagtcaagaagtcctagaaacccactgggtgcagtggctcatgtttgtaatccccaaactttgggaggcctaggcgggaggatcacttg

SEQ ID NO: 548774 - DNA, 344 bp, Homo sapiens
acctgactgcttcgcctgctgcctttgcctagagcctcctgtgtcgggacgcgcaccacacccccctgtttcctacggtgcaccagccactcctactggtgctgggtatgtctatagtgatgggccacatcttgggacccggagacctggggcttcagtccctgcttcgcttcggctcactgggaactggaacaggcacgcagagagaggacgacaggtcgctgcaccacaatatcaacatgagaaccaccgagacagagttagtgctgtgtgtgcaacataacgggggtggaagttgaggacacgacccttttccaacaacaagattatcacatccgtactgg

SEQ ID NO: 548775 - DNA, 558 bp, Homo sapiens
  misc_feature (52)..(52): n is a, c, g, or t
  misc_feature (92)..(92): n is a, c, g, or t
  misc_feature (102)..(103): n is a, c, g, or t
  misc_feature (115)..(115): n is a, c, g, or t
  misc_feature (122)..(122): n is a, c, g, or t
  misc_feature (126)..(126): n is a, c, g, or t
  misc_feature (135)..(135): n is a, c, g, or t
  misc_feature (142)..(142): n is a, c, g, or t
  misc_feature (155)..(155): n is a, c, g, or t
  misc_feature (181)..(181): n is a, c, g, or t
  misc_feature (221)..(221): n is a, c, g, or t
  misc_feature (223)..(223): n is a, c, g, or t
  misc_feature (255)..(255): n is a, c, g, or t
  misc_feature (260)..(260): n is a, c, g, or t
  misc_feature (262)..(262): n is a, c, g, or t
  misc_feature (266)..(266): n is a, c, g, or t
  misc_feature (276)..(276): n is a, c, g, or t
  misc_feature (282)..(282): n is a, c, g, or t
  misc_feature (284)..(284): n is a, c, g, or t
  misc_feature (286)..(286): n is a, c, g, or t
  misc_feature (294)..(297): n is a, c, g, or t
  misc_feature (302)..(302): n is a, c, g, or t
  misc_feature (304)..(304): n is a, c, g, or t
  misc_feature (307)..(308): n is a, c, g, or t
  misc_feature (311)..(311): n is a, c, g, or t
  misc_feature (315)..(315): n is a, c, g, or t
  misc_feature (324)..(324): n is a, c, g, or t
  misc_feature (330)..(331): n is a, c, g, or t
  misc_feature (333)..(333): n is a, c, g, or t
  misc_feature (354)..(355): n is a, c, g, or t
  misc_feature (377)..(378): n is a, c, g, or t
  misc_feature (381)..(381): n is a, c, g, or t
  misc_feature (385)..(386): n is a, c, g, or t
  misc_feature (392)..(392): n is a, c, g, or t
  misc_feature (403)..(403): n is a, c, g, or t
  misc_feature (405)..(405): n is a, c, g, or t
  misc_feature (409)..(409): n is a, c, g, or t
  misc_feature (412)..(412): n is a, c, g, or t
  misc_feature (414)..(416): n is a, c, g, or t
  misc_feature (418)..(418): n is a, c, g, or t
  misc_feature (423)..(423): n is a, c, g, or t
  misc_feature (427)..(427): n is a, c, g, or t
  misc_feature (433)..(433): n is a, c, g, or t
  misc_feature (466)..(467): n is a, c, g, or t
  misc_feature (469)..(469): n is a, c, g, or t
  misc_feature (480)..(481): n is a, c, g, or t
  misc_feature (487)..(487): n is a, c, g, or t
  misc_feature (514)..(514): n is a, c, g, or t
  misc_feature (556)..(556): n is a, c, g, or t
ctcttcttccttaactttcttttttttatccatttttcacctgaaacttccnccccaccattcaaagtacaactcaagaataaaccatctancacattctcnncacacacattancccctanattnctcccctcncccatgnctaaagatttatnttttttaaataaatacagtaaaatcnaaaacatatgatgcataatttaatctgatgattcaaatgncncctcatttttttttttttccgttttcctcatncttcntngttnttttcctatnacatantncncgttactnnnnttttnanaannatncccntatatttcncattanncntctacagatagatacaatatnntcattttgatgtgtacatttcnnccncccnnagggcncaatttataantntttnctntnnnanctaanattntttttnaaatgagtatttttagcacacttagtaacagcnncntgttttaaacnnttattncctttttggtgaccaaattatatttgnccataattaaagaacccataaccttaaaataatatttaagancc

SEQ ID NO: 548776 - DNA, 165 bp, Homo sapiens
aggacgacgtagtcgtggtccaagagcttcatatgtgtattgtgacgcttaatggcctgcatatcttgcccttctaacataacacatgtaaggtgctgagttgtagaagttatttgccaggcagagaaagtgtctaaactacgaatgtcagtgatcattgtgggt

SEQ ID NO: 548777 - DNA, 110 bp, Homo sapiens
gtttttctagttttgtttgtttctcaaggttcattttttactaagccccttctgacacctaggcagataagatagagtagtgcgcctgggtccagaagtgcgcctgggtg

SEQ ID NO: 548778 - DNA, 818 bp, Homo sapiens
cgggggaatggatttgggaaagtaggctgtgtctggaaattttgttcaaggttttgggtatggttgtagatcttgtgtatgtattagttgttgctgtgttgttgacttgctgttgtgttaatgtaagcagcggatgagatgcctgagacttctagagagtgaaggagtcttccgcttgagagttggctgtcacaatctggacaaaggccgccagagccctgctaatcaatgttttgcgcttggttgtgctttgtaccccaccgggttccaagccagcttgtaagcccacaaggctttggttctcggcacatgcgccttacacagagactcttatgccaatctcgcgcgactgtcgggccctcaacgtgatgttctgggggacccactggaccactggtccagggatcaatcgcctcgaagctgcgcgacagcgccatgtctgcggtgcgacaacagtggagccggcagctcaccggcgcgacacaaccgcacttcccatgaagcaacccggcatacacggacgtgaccgtccgaaaccatgcatgcgctgcgggcgtgctagtctggaatacagcagcgggggccttggaggggaccgcattgtgcttgtcgtgatgggggcaagggcacaagtcctggatgttgctgtgtgtgcgagaggcctaaggctggtggcaagtgcacggggcacagcggagtctgtcctctgacgcgcaagtctgagggtctgggcggacgggcgtactgggtctgtgcatctctggttgcaccgcggcgcttcccagcaccaacatgtatacggcatgtttccagcagaa

SEQ ID NO: 548779 - DNA, 301 bp, Homo sapiens
gcgggagctcggatgtcggttctgtgaggctttacctgacacccgcgctttcccggcactggctgggagggcgccctgcaaagttgggaacgcggagccccggacccgctccgccgcctccggctcgcccagcgggggtcgccgggaggagcccgggggagagggaccaggaggggcccgcggcctcgcaggggcgcccgcgccgtcgcgggttgggagcgggcaaacggagcacaagtacgcggtgatggaggaggagcggagagcacaaaaggacgaaggacagcacgaggccaggaag

SEQ ID NO: 548780 - DNA, 311 bp, Homo sapiens
aaggattacctcgagtgtcgggaactgtcacttcaggttgtgtgagtgcgttacaaaaaaaaaaaaaaaaaaaaatccccttatccctcattggtattttaaaaatggcgtgaggtttatatagaattggtgtccatttttagggtttaaatttggcaaaaaacccattcccactatgcaaggtcctttaaaacttcagtgaaaatcacctctcattccctcagggttctctctttaattggaccaaaaccttccatttttcctctaattacaaggcgaccgggtgttctgagcaccctttcccccgaaca

SEQ ID NO: 548781 - DNA, 116 bp, Homo sapiens
ccagactgaccgctgagctccctggcactgtccacaaagaccatctgtatgccctgctcccactgctgggtccctaccccagctccgtgtgatgcccagtaaagcctgagccatga

SEQ ID NO: 548782 - DNA, 312 bp, Homo sapiens
cggtacccggtatggtggatgggtgatggataggtggatgaaggtgggtaggtgggtggatggatagtgagtagctgaatgaatggtggatagatggacggtgagtagatgcatgaatggatggatggtagatgaaggaatggttggatggtaaatagatgatggatggatggatggtagatgggtagataaattaataaaataataaactggagcctaaataaaaggaaattagaatagtaaagggatttctttcttccaagaggaatcccagcatctcctcttctcttctaaaggaaagtactgacttca

SEQ ID NO: 548783 - DNA, 137 bp, Homo sapiens
gaccttcggaatgctctaaagactgagtgataacagtttcaaatcaccatgaaggctttccttgcaaggcaaggtaaattctttccatgaggaaattatatggccaggatttaggcttaggttccaatggaagatga

SEQ ID NO: 548784 - DNA, 106 bp, Homo sapiens
tgtaccaggcgagcaagcccaaggacataatagaatctggagagtcctggggccttgttttgaaaaagacttgaaatacacttcgcatgaaagcactggacatgaa

SEQ ID NO: 548785 - DNA, 244 bp, Homo sapiens
actacggatgaacatccatactcgtccatgaccctcgaccatgtgtaccagtggaggaaggccttccggcgaaacatggcagagaactgaaccgagatgcgcatgaagagctcctggatggctgtgctatagcacaatgaaggtagactgccatctatgaggccacgaggtgggatgtcacagacggctgtcttgacattgtaagaggatccattccacaaagtagctgctactgctgtgatgg

SEQ ID NO: 548786 - DNA, 842 bp, Homo sapiens
  misc_feature (481)..(481): n is a, c, g, or t
gtgttctgtctatgtattgcgtgttctctttctgttcgtagtcgttgtgaccttctgggtggctgcctcgtttgtttcgcgtcttttcataaattggctagtacgatagtagacatgcattccggatccgcgattgggggaccgttgccgccgttcgggggtttctccgcgcgcggtgttggttactctctcaatatggcgcgttctctctccacgtttaagtgcgtgccccccagatctctgtgctggagaactgctcccccatactgtctggttcccgcaccttatgagcagtttccacggttgcccggtgcccgcgcaaaaaatccctgcgggtgtttctcccactttcctgcccgctggttttcttttccccccatccgcgtcctcgtggagccgctctggtccagagctttttatagagaataatttgtgaaagcttggtgcagacaccatcttcggataaaacgcgtgtgtcctnccaaaaggggccccccctcctttttcacaatcaaggcgctttccccgggggcgacccacttttcatcggccaaaaaatccgtatgaaaatcgcgccgagccacaccaggcacaactctgggggacatacacaaccacacctgggtactctgggggaaactaattcggcccccgcgaaacacgggtcagggttgtgccacaaactcgaacccacactttgccgccagagcccccgcgcaccagacagcggaggtggccgtgcccccccacgaggtcaggacatacggcagaacccaaagtaaaaaagccgcaggcatgggctcctcagattcaaaggggcggtaaaaattcccccccacaat

SEQ ID NO: 548787 - DNA, 444 bp, Homo sapiens
ggattatcacatatcctaacatttatttttatgtgaagatgatcgttttatatcaagggtgtatgctgtctgctcaagttcttgtgccctatccctttgggaccaacttaattcagtaagtctctgagatcatctcactctaattaggagcaggagcagtaggcaaggttgagcctgtgactttgccttcattagtgctgacctactaattagggtgaaagtaattgggaacaaataagatgcataagtgttccatagcatatggcttcaaggaagtggtcagaatggagctagaatgtcagtttcttggaggagcttgctttttttcatctttttttgttgttgttgttgttgagacggagcttgcagtgagccgagattgcgccactgcagtccgcagtccggcctgggcgacagagcgagactccgtctcaaaaaaaaaaa

SEQ ID NO: 548788 - DNA, 486 bp, Homo sapiens
  misc_feature (23)..(23): n is a, c, g, or t
  misc_feature (39)..(39): n is a, c, g, or t
  misc_feature (49)..(49): n is a, c, g, or t
  misc_feature (55)..(55): n is a, c, g, or t
  misc_feature (201)..(201): n is a, c, g, or t
  misc_feature (311)..(311): n is a, c, g, or t
  misc_feature (473)..(473): n is a, c, g, or t
aaaaaccctatccaccttggtancaacatcacgatttanaatggaaaancctaanatcattttcaagaaaagacctgcaatggccaatgaagaggttaataaccaagatatccgaggaaggacccagccacctccctccgcaggtctgcagatgaaggtttttgaataaatgccactgtgcatttcagaaaaaaaatctcnataacaacttgaatgatgttgtcctcctgattctctttctctctgcgacttaaagtggcggatattcggaactgtgaatgtacatagcgttgagttaaaccccttgtgtntagacaggacgcagcggcccctggtcctggggccagacccgtgggcaggtgggcatgggccctggctgcgggacctgctggggtgtgagggcagagggagggttgccatgaaggaacttgggattttcaatggaataaataaaacataaatctatactgggnctgaaaaaaaaaa

SEQ ID NO: 548789 - DNA, 1109 bp, Homo sapiens
gcacgacgttcgcagtctggtggatcacctgaaggtctgtccccggtacacggcagtgctggcacgctctgaggcatgaatggcatcggaatcgatggagctggagacccttgcagcatgcgagctgtgagacccgtgcctggtctatctgccagaccgggcgcctgcagtgtgcattgagtgcctgaatagcccagatcctcagcgactgggcaggactaagagaaggtgagcagacgagttccgtgaagctgggtcgagaccatgagacttggagctccccccaaacatgggaagcccaagaagcagaaactggaagggaaggcaggacatgggccgggccctggcccaggacggcccaaatccaaaaagcttcaggccaagatccaggaatatgacagttcactgatgaccctatcgactgtgccacggagtccccaagaaatgatgcccccaacaggttctgggcttcagtggcagccctactgtgctgacatcaccagcgaggaggtccggacacttgaggagtgactgaagcccccagaagatgaggctgagcattagaagatcccacccctggggaagcactagtcccagcgctggggcccaggaggacctgctggaggagcagaacggatggggcccgggcaagaggatgtggctgacaagaagacaggctcatggggccactgaccgaactggacactcaaagatgtggatgccctagtgaagaagtctgaggcccagcatggagacagcggaagatgggtgccctttggtgccctgagcaaggctactgcaggactggtgaagaaaaatattcccagggaggacccattctgccatggttggaacacaacagggagaaagagaaaacacacgagaaaaaagagaagacagcagaggcagaagacaagcgcgcgaacgcgaaaggaggacaaagacagggaaaaaggtaaggaccagacgaaccaacgagacagagacacagaaaaagggacgcaggaacagaggagaacaaacacggataggacccgagataccaaggagcaccaaaaagcagagaagaaaaagatgaccaccccacgcacaccacaacacaaagcagg

SEQ ID NO: 548790 - DNA, 222 bp, Homo sapiens
aaaaaaaaaaaaaccaacccccatgatttcaaggagtttggcattcctgaatcctttttccctgccaggggcctgtcacctgttttcactgcctcctttttcctgtcatgctcatcaggttatgggttctgttttagcccctgaacagagggctgaaacctcccctgcaggctggttttaggtctttaattatgttagaatcttgcccagccctggtaatgt

SEQ ID NO: 548791 - DNA, 561 bp, Homo sapiens
  misc_feature (544)..(544): n is a, c, g, or t
atgaagaggcaatggtccatctcaaaatactgcttttacaaaagcagaataaaagcgaaaagaaatgaaaatgttacgctacattaatccgggaataaaagaagccgaaataaatgagagatgagtggggatcaagtggatggaggaggctgtgctgtgtgccaatgtttcgttggcctcagacaggtatctcttcgttatcagaagagtggcttcatttcatcggggagcagaaaacagcaggcagcggtaaacagataagtttaactggcatctgcagtatggcaggtaagggataagtgcttatttaaaagagcgggggagtccttaaatatcaaccagggcactttctccggaccccttccctaggggatcccaggatggagaaatttttccatcgagccttttaaaaatggtaggactggtcccggtgggcttcagggaggggatagtacacttcactcagaggcatgggcatctttaaataatttcttaaaagcctctaaagtgatcagtgcctggatgccaagtaaggaaatttgtntagcatggaatccctga

SEQ ID NO: 548792 - DNA, 1342 bp, Homo sapiens
cgtacctcgttcttttctcacctctgtattctcatctttctctttccttcacttattgtagcctatctattttgtcttatatcttgtgctcttcttgcacacgtgtgttccctactatatatgtgtgctagtgtgtagtactcccttgctatctccttctgtcgtttctttcgcctgctgtcattcggcgtcgtctcttccttctttttttcttgctacgtaattactctatatcctaccttcacctactctttcctgcccttgtttttctctgtagtttttcatttctgtctgtgtttcggtgtgtagcccctcgtccccctcgttcgttttgtgtgcgctgttattcgtgctccttgtattccgtgtgcgtctttgttttttggtgctttcttcgttgtcttcctttaggtttgtgtcccctccgtgttgtcctcttgtctatttgtttttctcggggccctcgtgttgtgcttcgcctcgttgttgttcccctctctccttttgttgtgttcgtgtgttccgtgtcgtttctttcttgtgtcttcgcggttgtgtttgcgcgcttccgcttgttctgtccgtgttgttttttctcgtgtggcgctttcgtctctctcttttgtgtcctctttccgtcgtgttagcatcttcctctgttctgttttttgttttcttttttgttttgccctttcttctgtctcttcgtcagtccctggtttgatgggtccgtcgtcctggttgtctgcgggtatgttctcgttctgttgttctctttatgatgtgtttggtacgatcgcttgtagatgatctatgtccagccctcagcctccttgatgttatctagatgcagaagactagatgccctaaatctaggtagataggctacttgcccatcggtcatatcggcagtgttgctctcaagactcaagattggcagcccttccgcacgcgttgccgcacttgccatctccctcagagtccatgggagtccccataatatcccactatcatgtctttaagagtatatctggctccttgatcctagcaatcgggccctgggagtccaccaggtgggaataagcgcctctgtccagagtccaggtccttgggatgacagacagcttgcctcgcacactcgggccccactcaaggatgtagggccttcttctggtctccctgaccctctccctggtcatgggagcgtggggacggggctggtccttgggaggcgtcggtcaggggcatcacctccttctgctgcttcttcctgctcctaccctcaagggcctggggtctgcccagctgcctctatgcccttatgtgggctctcagcccactg

SEQ ID NO: 548793 - DNA, 362 bp, Homo sapiens
  misc_feature (217)..(217): n is a, c, g, or t
ccagtttgctgtgtggtggaacattatgaaaacgccattgaatatgattgcaaggaggagcatgcagaatttgtgctggtgagaaaggatatgcttttcaaccagctgatcgaaatggcattgctgtctctaggttattcacatagctctgctgcccaggccaaagggctaatccaggttggaaagtggaatccagttccactgtcttacgtgacanatgcccctgatgctacagtagcagatatgcttcaagatgtgtatcatgtggtcacattgaaaattcagttacacagttgccccaaactaggaagacttgcctcccgaacaatggtcgaacaccacagtgaggaatgctctgaagg

SEQ ID NO: 548794 - DNA, 445 bp, Homo sapiens
  misc_feature (441)..(441): n is a, c, g, or t
aaactatttatttagtgatcctataatccaggctgctttggcccttaaactaggccctcactgctccaggcatggggccacgcagcataacagagccaaccagtgcccagcagcctacagcctcagttaaggatgctataaccttttcatctgccgccgctcctgtcggcgttgtcgtttctcattgagctctggtgcaggggctccactgtctgctgtgaaccaggggcccagcacgtttacccacaaaaggtaaagggcccggcctggagccagaagccagaaggaccagatgtagagggagaaacagctgagcacctgaacaatggctgtcagtaggatcacatccttaaggtgctctgccatgccctgctccatgttgaggtccatgcaacatccatcaaaggacccatctcagagaaggatgccgagcatcgagcnggca

SEQ ID NO: 548795 - DNA, 945 bp, Homo sapiens
  misc_feature (127)..(127): n is a, c, g, or t
  misc_feature (151)..(152): n is a, c, g, or t
  misc_feature (159)..(159): n is a, c, g, or t
  misc_feature (210)..(210): n is a, c, g, or t
  misc_feature (216)..(217): n is a, c, g, or t
  misc_feature (222)..(222): n is a, c, g, or t
  misc_feature (224)..(224): n is a, c, g, or t
  misc_feature (274)..(274): n is a, c, g, or t
  misc_feature (286)..(286): n is a, c, g, or t
  misc_feature (290)..(290): n is a, c, g, or t
  misc_feature (320)..(320): n is a, c, g, or t
  misc_feature (358)..(358): n is a, c, g, or t
  misc_feature (386)..(386): n is a, c, g, or t
  misc_feature (392)..(392): n is a, c, g, or t
  misc_feature (418)..(418): n is a, c, g, or t
  misc_feature (452)..(452): n is a, c, g, or t
  misc_feature (462)..(462): n is a, c, g, or t
  misc_feature (464)..(464): n is a, c, g, or t
  misc_feature (476)..(476): n is a, c, g, or t
  misc_feature (479)..(480): n is a, c, g, or t
  misc_feature (488)..(488): n is a, c, g, or t
  misc_feature (517)..(517): n is a, c, g, or t
  misc_feature (529)..(529): n is a, c, g, or t
  misc_feature (945)..(945): n is a, c, g, or t
atcagaatacaaactgactagaaatacgcgtcaaaaccgagtacttaccaaagctcagagcatctgagtagcatgaatcctgtttgcttcatcaatctgaaggttatggcctttgacaagagggatnctgaacgactaaattagtcagttnntcgcttngtttacttaaatgtatggttagatggtttttgatctgcagtcttccctagntccccnnaaatnangtaataataacttccatgctgcctgctgtgttccagatcacagaggcagncaaggctcaggnaaanactggggcttgcttatggtcagcctatgtntgattgcacagtctttgacaatagtagcttactaagantgctcagaatgagtaagctttaggaaantactanaatgctgtgggagaataacaaaatcngttctctctcttcacttgacagaagcattaagtngaattttgtntnacatagagccantgnngccaaaanctttctatattgcctgtagatgatcggcntgctggtgtggnagtaatctgatcacagatattcttaaatcagagtgtggaatggtattagtcaaacatggtgccagtgtcttttacgaaagagcagatggcatagtgtcgagatgtagcttactctcgtgctactgtacagcttgaggatctgtcatcacctcccggtaacgttgtaaatacccaggttgcctcttctggtagtccatctcccagacttgtgactttgggcttttcattcttcaatgcatgaccgagtgccaaacttgattatctcgtaaggcacagctttcctccctcttgtgcctcctgttttccttttttctctcctggctcttcctctggtccccattccaattttctcatttggctcctttctcaattctggcagtctgaaattttgaaaccggttaataatccaagtgtgn

SEQ ID NO: 548796 - DNA, 186 bp, Homo sapiens
gggctggttatcagctgtagctagggtgcacatgtttgaggactgggagtgaaggcgaaggggaaacaagaaatgtgaggggaaggtggccgggcacggtgtgccacgcctgtaatcccagcactttgtgacggcgatgtgcgtggatcatctgagggcagggagtttgaaaccagtctggacaac

SEQ ID NO: 548797 - DNA, 284 bp, Homo sapiens
caacgcacgtgttgggccaacgcaccgtgggcactctggcctctacatctacaatctctatgccccgctgtgctgcacggggtgcccagccatcttaggtatgagaacggacactgttgtggtccaggatttgggctacatcttcactcgcctgccactcaagcggatgtggcatcaggcactgctgcgctcaggggataaagtgcgcattgaccccccctgcatctagacagcatacagctgcttccacctacctcaacaacccgtacggtgcgttggcccta

SEQ ID NO: 548798 - DNA, 132 bp, Homo sapiens
cccttatatgaggaacgtcactcgggctaagcagattgtgtggaatggtcctgtaggggtatttgaatgggatgcttttgccggtgaaccaagctctcatggatgaggtggtgaaagccacttctaggggct

SEQ ID NO: 548799 - DNA, 105 bp, Homo sapiens
ctgtcctgcgtcttacactattcctcatcaccaagaaaatattaacacaaactaccacctacttaggaggctgaggcaggagagtcacttgaacctgagggagcg

SEQ ID NO: 548800 - DNA, 739 bp, Homo sapiens
gtcatacttaggagtatatgcgggatgtcgacccgttattatcatacgctctcttaaagagggggactgccttagaacagtgacctgaacctattatccgtgagtctgggactccggggcaagctgtgggcacccaagctgttgaaagcctagacaggctacattaaacattcggcatgacaatgaacacagaatgaggacatcagctaaactgctgtataatcgtgagacgagactgagaaacggatcatcatccatcatgatgcggatagtcagtcactacagatatgtcacctaatcaaggacaaggtgcacgacggtacacctgggccctgactgacagaatcatgaatagcaagacagtctgcatccaagatgtactgcgtaagttcattctacatcacacaagcagcaacaagctgcgcatgctgtatcctaagggaccagaggactaaaggttccttcagctggaaagagatctctctacacacatgagtaatccgagcgcgcatagaaccacagaactgacgtaactacgccattttgggacgttcatgtaggtcctttaaggagatggcgtccatagggcatatattgatagaaaaccgtacattttgggaacaaattccatggagggactgacgactgggccatcataaggtaagggtcagactccccctcttgaagactctcttggttgtactgcataagcgaccacctgggcggtcttgcggcccgc

SEQ ID NO: 548801 - DNA, 327 bp, Homo sapiens
tgagacagaatcttgctctgtcatccagcctggagtgcagtggcacgatttcagctcactgcaacctccacttcctgggttcaagcgattctcttgcctcagcctcccgagtagctgggattacaggcatgcaccaccacacccgcctaatttttgtatttttagtagagatgaaatttcgccatgttggccaggctggtctcgaactcctgagctcaggcaatccgcccaccttagcccaaagtgctgggattataggcatgagccactgcacctggccccacatggctaatttttaaaagggttttggttccaccaaccttcact

SEQ ID NO: 548802 - DNA, 333 bp, Homo sapiens
tcatcttgggcctgtgttatccccaataaggaagtgaaggttggcgtaacgatcggtacggaactcgatcttgccgcccttaatatcggagacagccttagcgacatccatggtgacagtaccggtcttagggttcggcatcaggccacgcggaccgagcatgcgtcccagacggccaactttgcccatcatgtccggggtagcaaccacggagtcgaagtccaagtacccgccctggaccttggcgatgagatcgtcgtcaccgacctcgtcggcgcccgcctcgcgggcagcctcggccttctcaccggtgataacacaggcccaagatga

SEQ ID NO: 548803 - DNA, 291 bp, Homo sapiens
ccggtcctctacatgtatgctttacctaatctgcctctaggggcttgcaaggaaacggtttccggtttccgtcttcatttgacctcttaatgtcctgagcaatagtttttcgttattctgctgagggtacttttgttggttagctttagacatcattatttctactaattcacgtagttttgatcgtagcgccaaagtttcaattcttccactggttcttctggaaggaattagaacttttacagtgccttgcctgctcagtattatgttgttaaaaaagagtagaggcaa

SEQ ID NO: 548804 - DNA, 874 bp, Homo sapiens
  misc_feature (389)..(389): n is a, c, g, or t
attctctataaaccacaaagacataggaacactatacctattattcggcgcatgagctggattcctaggcacagttctaagcctccttattcgatccgagactggtgactgccagggaatcttctaggtaacgaccacatctacaacgttatcgtcacagcccatgcatttagtaataatcttcttcataagtaaatacccaatcaataatcgagagagcttttgagtgacattgtacatagtttctcccatacataatcggatgcaccccgtatcatggcgttctccccgacactaaacacaacagtaagcttctgctgcattcttatctccactctctccctcactccctactcggccatcctgcttatagtggcagtgacctgagnagccaaggaacaaccagagatctcgataactagctcatatcgcacttcgcccgtctgagtccgagaggcaacgtacatacacgcaacccttggcagcgctccgctagacctacaccatgtcttctccttgacatctgagtcagggtgatttccctctaatctattagacgcgtccagtacagattttcattcatctacagcaagttaattcaattattaaaaacctctctctcatgcacaataaaggcccataatgacccaataacgccccctactttcggtgcatgatccgtgcgctacatcacagcgagtccatacttgctccatatctcttccccagtcctagctgcctggcatcactatatcttactaacagaccgagaaacttatacacctagctttcttcgaacccgtccggagagaagggaagaacccaattcctataccaaaaactattgctgattttttccggtcaccctggagtt

SEQ ID NO: 548805 - DNA, 918 bp, Homo sapiens
ccacccccactctgcatcaactgaacgctaatcagccactttaattaagctaagcccttactaaaccaatgggacttatgacccacaaacatcttagttaacagacgtgaagcaccctaatcatctggacttcaatctacttctcccgccgtcgggaaaataggcgggagatgccccgagtcaggttatgaagtctgcttcttcgaatatgcaattcatatatgacaatcacctcggaagctggtactaagaggcctaacccctgtctttagcatttacagtccaatgcttcactcagacattttagctcacccccactgactgttcgccgcatgcgtgtagactatgtgctcgtacaaacctacaaaatgcactattggaacatctatacctattattcggcgcactgagctggagtcctaggcacagctctaagcctccttattcgagccgagctgggccagccaggcaaccttctatgtaacgaccacatctacaacgttaatcgtctacagcccatgcatttgtaactaatcttcttcatgatgtaatacccatcataatcggaggctttggcaaactgactagttccgcctatctaatcggtgccccgatatggcgtttccccgattaaacaacatatgcttctgacatctctacctccctctctcctactccctgttcgcatctgctatagtggaggccggagcaggaacaggttgaacaggtctacccctcccttagaagggaactatcccaccctggagctccgtagaactaaccagttttacttaaactaacaggtggttcctctatcttaggggcaaccactttcttcacaaccattattaatttaaacccctggctaaaccagtaccaaaggccctttgtttgaacaggcctaagacagaactattt

SEQ ID NO: 548806 - DNA, 660 bp, Homo sapiens
agaggacccgacggtcaacggaactttatcttagaataacatatctggcaaaaatgtccttcaaacatgaagaagaaataaaaactttcccagacaaacaaacactgagggattaaatcaacactagacctgtcctataagaaaagctaaagggagaacttcagtcagaaaggaaaggatgttaatgagcaataagaaataatttgaaggtacaaaactcactggtaatagcaagtacacaaaaaaatagaaagtgaaaaagtaggcgggggggatgaagttaaaacagagtttttatcagttttctttttgctgtttatttgtttacacagacagtgttaagttgttatcaggcaaaataatgggttgtaagagtatctacaaacctcataataacctcaaaccaaaaaacatgcaatgaatacacaaaaaataaaaagcaagaaactaaatcacatccccagagaaaatcattttaactaaaggaagacaggaaggaaagaaagaaggaagaggccagatgcagtggctcatacctgtaatttcagcactttgggaaagcaaggtgagtcgatcatttgaggtcaggagttcgagagtagcctagccaacatgatgaaatcctgtctctactaaaaattaaaaattagtgtgtgtcgt

SEQ ID NO: 548807 - DNA, 167 bp, Homo sapiens
acggagggcagcaggagagaacccctgagttctgcgggacagccccagttccagaacatgcggcaggtgattcatgcagaaccctgcgctgctgccctgcactgcttccaagacagctgggccagtgagaaccctacatgcttttacatgcaatatcatgcctggca

SEQ ID NO: 548808 - DNA, 825 bp, Homo sapiens
  misc_feature (564)..(564): n is a, c, g, or t
  misc_feature (710)..(711): n is a, c, g, or t
  misc_feature (758)..(759): n is a, c, g, or t
  misc_feature (771)..(771): n is a, c, g, or t
aagacaacgatcccagaggaggaggcgagcatactgctacaaaatacccaagcagggcggggcctttgccaaaagagtctccgtggcccctagagcgggccccagggtagttgctaacggttcagcaagaaattgaccttttctgcagccacctacctaagtggcagaggaaccccaacctctggcagacggtccgcatcccccatgtatggcaggagtgtacaggcgcgtcgggtcaccggggggccatgcctcggagaacccgattgcagctctccctgcacatcggtccaatgtcagcttccagacctggagctccagacgcgggcctgggggtcatctgaatgtaaccttcactttagagtcaccatactctcataatctgcactgttttaataaaatcttagtaattctctgtaaggagacggcgagtgaccatggaaatatttcatctcgtgcagggtctcattgtttatctcatggcgaaaatatacttttttaatggttggatgtaaacatgaactcaaacacgttttatttattaagatacaacctgaaccacanaaacaaggagatcaaagatgaagtggcttagacagaagtttcagtctctctccccagactgtctggaggtgagtggatggcgcttcatgaggttgctggggacccctgtctgctgggtctcttgctctgttgtcctgttacgacanncggtgcatggcatggcacatggtcggcatggtagatgctgggttgcnnccacacccacantccctgtgaggtgtttgtttttacttaattaccttagaatggtgagggcgggag

SEQ ID NO: 548809 - DNA, 3218 bp, Homo sapiens
  misc_feature (3092)..(3092): n is a, c, g, or t
  misc_feature (3095)..(3096): n is a, c, g, or t
  misc_feature (3098)..(3098): n is a, c, g, or t
  misc_feature (3101)..(3101): n is a, c, g, or t
  misc_feature (3104)..(3104): n is a, c, g, or t
  misc_feature (3106)..(3107): n is a, c, g, or t
  misc_feature (3115)..(3115): n is a, c, g, or t
  misc_feature (3127)..(3127): n is a, c, g, or t
  misc_feature (3132)..(3132): n is a, c, g, or t
gcggccgcctcaccagaccgcgtgcggacgggctcgcgggcggggcggggcaagctcaggccacgcccctgggcggtgcgcgcgggcggtgggtaggccgggcaggctcacgtgatgcgggccccgcggcccgccatataaacccgcgcgcccgccaggcgctgcggccgtcccgggccgtgactcctcctttcccccgccccgcctccgttcggagagccggcgggcgggcgcctctcggccaggaagcgcctcttggacgcgtgtgaccgatgcccagattgcacgaccacttctggagctgctcctgtgcgcacagcgcgaggcgccgaggccccccgcgagccagcgccgcggggctggcggccaaggttggggagatgatcaacgtttccgtgtccgggccctccctgctggcggcccacggtgccccggacgctgaccccgcgcccaggggccgcagtgctgcgatgagcggccccgagcccggcagcccctaccccaacacctggcatcatcgcctgttgcagaggagcctcgtgctcttctcggttggggtggtcctagccctggtgctcaacctgctgcagatccagaggaatgtcactctcttccccgaggaggtgatcgccaccatcttttcctccgcctggtgggtccctccctgctgcgggacagcagctgctgttgttggcctactgtacccctgtatcgacagtcacctcggagaaccccacaaatttaagagagaatgggccagtgtcatgcgctgcatagcagtttttgttggcattaaccacgccagtgctaaattggattttgccaataatgtccagctgtccttgactttagcagccctatctttgggcctttggtggacatttgatcgttccagaagtggccttgggctggggatcaccatagcttttctagctacgctgatcacgcagtttctcgtgtataatggtgtctatcagtatacatccccagatttcctctatattcgttcttggctcccttgtatatttttctcaggaggcgtcacggtggggaacataggacgacagttagctatgggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacctagtctagaatagggaggtggagaatgatgacttaccctgaagtcttcccttgactgcccgcactggcgcctgtctgtgccctggagcattctgcccaggctacgtgggttcaggcaggtggcagcttcccaagtattcgatttcattcatgtgattaaaacaagttgccatatttcaaagccttgaactaagactcaattaccaacccgcagttttgtgtcagtgcccaaaggaggtaggttgatggtgcttaacaaacatgaagtatggtgtaataggaataatatttatccaaaagatttttaaaaatagggctgtgtttaaaaaaaaaaacaaaacaagaaaagcagcagtgattatagagaggtcacactctaagtggggtcgcggcgtggccacgcttcacggtcacgctcgtccgtcctgcagtggcgtgtttacatggtcacacgtgtgtgtatcaccagtgggtcaactgcttgtcattcctcccgtggcagtttgtgtagacaatcttactgagcaaaaggcaatgaaaagtcttggttcccacactgcgatatattggaattttcacctcagtttatgaagtttatttcgaaatccatagtcatctaagaatgaatacctgtctgccatgtatttcaatcttagtgagccaaaattgtttgtttgttactacagaatagagatgactgttttttgccacagccctatggaatttgcaatctgtgattgccttgtaaaaaggagagtgcatatggcactgcattaaacgtgtggtgtttctagtcaatgatattggtgagcacaatgtattcatttaatggcatagaccataccagacctaatttgcaagtattgggtcttaaacttcaagtgcaatgtatatgaaaaccaatctgagccttgtatctcttaaatatttattttttttaacgtgtgagatgttcgagagaaggttctccattcatttcagtgctgcctggaggaaactcggcaatgatttctttcagttgtgaagttcctttcgtgttacaccctccactgaaccctcaaccttcgaaatactccagttttgtgggtttggtcatttttacttataaatttacctttttgtattttgcaatttacatgtgtttggtttgttttaaattctgtgaaagtggcttgattaaaagactccttttaaatggaagccaccagtcagcagaatggaagcttagaggaacttgcctgtgagcgctggtctttgtgtttggttttgtgatgtaacgatctttgctggggttttttgctttgttttgagggaaatgtcttggagtaaattttaagttcctggagttaatttgttttacaggaattttgttttttaaaaaaataggatcattctgaactttggaatgacccccttatatattttctgaaaatgaaaacagttacatgaaaaaaatttccaatgaagatgtcagcattttatgaaaaaccagaagttattagatgaaagcagcgagtgaatctttaaaacagacttgatcacgcacacacaataagtctttctctccgaaaccggaagtaaatctatatctgttagaaataatgtagccaaaagaatgtaaatttgaggatttttttgccaatagtttatagaaaatatatgaaccaaagtgatttgagtttgtaaaaatgtaaaatagtatgaacaaaatttgcactctaccagatttgaacatctagtgaggttcacattcatactaagttttcaacattgtgttctttttgcattcattttttacttttattaaaggttcaaaaccaaaaaaaaaaaaaaaaaaaaaanatnntntgnggngnntcgggccngaaaaagttttnaaccnttcgttggggcggggccccagtggttgtgcacccgggccaaggtgttcccaaggaaaaccccggccgaaaatggggtggggttccc

SEQ ID NO: 548810 - DNA, 263 bp, Homo sapiens
ctcgctattacccctggactatatagccaagacataagctacaaattatgccggaaaaactgtccatacagtttataactacttcttcatacattcttatggaccatcatccaggacatctgctttgacagaaatatccagcttataagtatcttcaaaaggttagaacttgtgaatgaaaaacatataagaatgtgagttaaaggatgatatagccattcagtatgctaagtttacacggtcttaaaatttgcacgtttaat

SEQ ID NO: 548811 - DNA, 3069 bp, Homo sapiens
gcggccgcctcaccagaccgcgtgcggacgggctcgcgggcggggcggggcaagctcaggccacgcccctgggcggtgcgcgcgggcggtgggtaggccgggcaggctcacgtgatgcgggccccgcggcccgccatataaacccgcgcgcccgccaggcgctgcggccgtcccgggccgtgactcctcctttcccccgccccgcctccgttcggagagccggcgggcgggcgcctctcggccaggaagcgcctcttggacgcgtgtgaccgatgcccagattgcacgaccacttctggagctgctcctgtgcgcacagcgcgaggcgccgaggccccccgcgagccagcgccgcggggctggcggccaaggttggggagatgatcaacgtttccgtgtccgggccctccctgctggcggcccacggtgccccggacgctgaccccgcgcccaggggccgcagtgctgcgatgagcggccccgagcccggcagcccctaccccaacacctggcatcatcgcctgttgcagaggagcctcgtgctcttctcggttggggtggtcctagccctggtgctcaacctgctgcagatccagaggaatgtcactctcttccccgaggaggtgatcgccaccatcttttcctccgcctggtgggtccctccctgctgcgggacagcagctgctgttgttggcctactgtacccctgtatcgacagtcacctcggagaaccccacaaatttaagagagaatgggccagtgtcatgcgctgcatagcagtttttgttggcattaaccacgccagtgctaaattggattttgccaataatgtccagctgtccttgactttagcagccctatctttgggcctttggtggacatttgatcgttccagaagtggccttgggctggggatcaccatagcttttctagctacgctgatcacgcagtttctcgtgtataatggtgtctatcagtatacatccccagatttcctctatattcgttcttggctcccttgtatatttttctcaggaggcgtcacggtggggaacataggacgacagttagctatgggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacctagtctagaatagggaggtggagaatgatgacttaccctgaagtcttcccttgactgcccgcactggcgcctgtctgtgccctggagcattctgcccaggctacgtgggttcaggcaggtggcagcttcccaagtattcgatttcattcatgtgattaaaacaagttgccatatttcaaagccttgaactaagactcaattaccaacccgcagttttgtgtcagtgcccaaaggaggtaggttgatggtgcttaacaaacatgaagtatggtgtaataggaataatatttatccaaaagatttttaaaaatagggctgtgtttaaaaaaaaaaacaaaacaagaaaagcagcagtgattatagagaggtcacactctaagtggggtcgcggcgtggccacgcttcacggtcacgctcgtccgtcctgcagtggcgtgtttacatggtcacacgtgtgtgtatcaccagtgggtcaactgcttgtcattcctcccgtggcagtttgtgtagacaatcttactgagcaaaaggcaatgaaaagtcttggttcccacactgcgatatattggaattttcacctcagtttatgaagtttatttcgaaatccatagtcatctaagaatgaatacctgtctgccatgtatttcaatcttagtgagccaaaattgtttgtttgttactacagaatagagatgactgttttttgccacagccctatggaatttgcaatctgtgattgccttgtaaaaaggagagtgcatatggcactgcattaaacgtgtggtgtttctagtcaatgatattggtgagcacaatgtattcatttaatggcatagaccataccagacctaatttgcaagtattgggtcttaaacttcaagtgcaatgtatatgaaaaccaatctgagccttgtatctcttaaatatttattttttttaacgtgtgagatgttcgagagaaggttctccattcatttcagtgctgcctggaggaaactcggcaatgatttctttcagttgtgaagttcctttcgtgttacaccctccactgaaccctcaaccttcgaaatactccagttttgtgggtttggtcatttttacttataaatttacctttttgtattttgcaatttacatgtgtttggtttgttttaaattctgtgaaagtggcttgattaaaagactccttttaaatggaagccaccagtcagcagaatggaagcttagaggaacttgcctgtgagcgctggtctttgtgtttggttttgtgatgtaacgatctttgctggggttttttgctttgttttgagggaaatgtcttggagtaaattttaagttcctggagttaatttgttttacaggaattttgttttttaaaaaaataggatcattctgaactttggaatgacccccttatatattttctgaaaatgaaaacagttacatgaaaaaaatttccaatgaagatgtcagcattttatgaaaaaccagaagttattagatgaaagcagcgagtgaatctttaaaacagacttgatcacgcacacacaataagtctttctctccgaaaccggaagtaaatctatatctgttagaaataatgtagccaaaagaatgtaaatttgaggatttttttgccaatagtttatagaaaatatatgaaccaaagtgatttgagtttgtaaaaatgtaaaatagtatgaacaaaatttgcactctaccagatttgaacatctagtgaggttcacattcatactaagttttcaacattgtgttctttttgcattcattttttacttttattaaaggttcaaaacc

SEQ ID NO: 548812 - DNA, 198 bp, Homo sapiens
cttgggaagcaagacaggcgaatacttgaggtcaggagcttgagacctacctggcaacatggtgaaaccccgtctctactgaaaatacaaaaattatccaggcatggtggcaggcgcctgtggtcccagctactcgggaagctgagacaggagtttcacctgagagaggaggatcacctgaggctgggcgtgcagtgg

SEQ ID NO: 548813 - DNA, 104 bp, Homo sapiens
cctttttgggggccccataaaacaagttttttcaaaaaaaaaggggggggccgggccggaatttcccggaatttttttcccccccgggccccccccgggtccca

SEQ ID NO: 548814 - DNA, 3303 bp, Homo sapiens
  misc_feature (3070)..(3070): n is a, c, g, or t
  misc_feature (3074)..(3074): n is a, c, g, or t
gcggccgcctcaccagaccgcgtgcggacgggctcgcgggcggggcggggcaagctcaggccacgcccctgggcggtgcgcgcgggcggtgggtaggccgggcaggctcacgtgatgcgggccccgcggcccgccatataaacccgcgcgcccgccaggcgctgcggccgtcccgggccgtgactcctcctttcccccgccccgcctccgttcggagagccggcgggcgggcgcctctcggccaggaagcgcctcttggacgcgtgtgaccgatgcccagattgcacgaccacttctggagctgctcctgtgcgcacagcgcgaggcgccgaggccccccgcgagccagcgccgcggggctggcggccaaggttggggagatgatcaacgtttccgtgtccgggccctccctgctggcggcccacggtgccccggacgctgaccccgcgcccaggggccgcagtgctgcgatgagcggccccgagcccggcagcccctaccccaacacctggcatcatcgcctgttgcagaggagcctcgtgctcttctcggttggggtggtcctagccctggtgctcaacctgctgcagatccagaggaatgtcactctcttccccgaggaggtgatcgccaccatcttttcctccgcctggtgggtccctccctgctgcgggacagcagctgctgttgttggcctactgtacccctgtatcgacagtcacctcggagaaccccacaaatttaagagagaatgggccagtgtcatgcgctgcatagcagtttttgttggcattaaccacgccagtgctaaattggattttgccaataatgtccagctgtccttgactttagcagccctatctttgggcctttggtggacatttgatcgttccagaagtggccttgggctggggatcaccatagcttttctagctacgctgatcacgcagtttctcgtgtataatggtgtctatcagtatacatccccagatttcctctatattcgttcttggctcccttgtatatttttctcaggaggcgtcacggtggggaacataggacgacagttagctatgggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacctagtctagaatagggaggtggagaatgatgacttaccctgaagtcttcccttgactgcccgcactggcgcctgtctgtgccctggagcattctgcccaggctacgtgggttcaggcaggtggcagcttcccaagtattcgatttcattcatgtgattaaaacaagttgccatatttcaaagccttgaactaagactcaattaccaacccgcagttttgtgtcagtgcccaaaggaggtaggttgatggtgcttaacaaacatgaagtatggtgtaataggaataatatttatccaaaagatttttaaaaatagggctgtgtttaaaaaaaaaaacaaaacaagaaaagcagcagtgattatagagaggtcacactctaagtggggtcgcggcgtggccacgcttcacggtcacgctcgtccgtcctgcagtggcgtgtttacatggtcacacgtgtgtgtatcaccagtgggtcaactgcttgtcattcctcccgtggcagtttgtgtagacaatcttactgagcaaaaggcaatgaaaagtcttggttcccacactgcgatatattggaattttcacctcagtttatgaagtttatttcgaaatccatagtcatctaagaatgaatacctgtctgccatgtatttcaatcttagtgagccaaaattgtttgtttgttactacagaatagagatgactgttttttgccacagccctatggaatttgcaatctgtgattgccttgtaaaaaggagagtgcatatggcactgcattaaacgtgtggtgtttctagtcaatgatattggtgagcacaatgtattcatttaatggcatagaccataccagacctaatttgcaagtattgggtcttaaacttcaagtgcaatgtatatgaaaaccaatctgagccttgtatctcttaaatatttattttttttaacgtgtgagatgttcgagagaaggttctccattcatttcagtgctgcctggaggaaactcggcaatgatttctttcagttgtgaagttcctttcgtgttacaccctccactgaaccctcaaccttcgaaatactccagttttgtgggtttggtcatttttacttataaatttacctttttgtattttgcaatttacatgtgtttggtttgttttaaattctgtgaaagtggcttgattaaaagactccttttaaatggaagccaccagtcagcagaatggaagcttagaggaacttgcctgtgagcgctggtctttgtgtttggttttgtgatgtaacgatctttgctggggttttttgctttgttttgagggaaatgtcttggagtaaattttaagttcctggagttaatttgttttacaggaattttgttttttaaaaaaataggatcattctgaactttggaatgacccccttatatattttctgaaaatgaaaacagttacatgaaaaaaatttccaatgaagatgtcagcattttatgaaaaaccagaagttattagatgaaagcagcgagtgaatctttaaaacagacttgatcacgcacacacaataagtctttctctccgaaaccggaagtaaatctatatctgttagaaataatgtagccaaaagaatgtaaatttgaggatttttttgccaatagtttatagaaaatatatgaaccaaagtgatttgagtttgtaaaaatgtaaaatagtatgaacaaaatttgcactctaccagatttgaacatctagtgaggttcacattcatactaagttttcaacattgtgttctttttgcattcattttttacttttattaaaggttcaaaaccnaaanaaaaataatagaagataacagagaaaaaactgttttggggcgccttcgcgcttggaaaaattttttaaaacatgtctgttgggggcggggggccccaatgtcttactgtgaacgcgggcatcagcggtttctcgagagaaaatccgggcacaggaataggcgctgggtctctcccccattataaaaaggcggggggcaccgagggtttctgcacaatccccgatggagg

SEQ ID NO: 548815 - DNA, 3097 bp, Homo sapiens
gcggccgcctcaccagaccgcgtgcggacgggctcgcgggcggggcggggcaagctcaggccacgcccctgggcggtgcgcgcgggcggtgggtaggccgggcaggctcacgtgatgcgggccccgcggcccgccatataaacccgcgcgcccgccaggcgctgcggccgtcccgggccgtgactcctcctttcccccgccccgcctccgttcggagagccggcgggcgggcgcctctcggccaggaagcgcctcttggacgcgtgtgaccgatgcccagattgcacgaccacttctggagctgctcctgtgcgcacagcgcgaggcgccgaggccccccgcgagccagcgccgcggggctggcggccaaggttggggagatgatcaacgtttccgtgtccgggccctccctgctggcggcccacggtgccccggacgctgaccccgcgcccaggggccgcagtgctgcgatgagcggccccgagcccggcagcccctaccccaacacctggcatcatcgcctgttgcagaggagcctcgtgctcttctcggttggggtggtcctagccctggtgctcaacctgctgcagatccagaggaatgtcactctcttccccgaggaggtgatcgccaccatcttttcctccgcctggtgggtccctccctgctgcgggacagcagctgctgttgttggcctactgtacccctgtatcgacagtcacctcggagaaccccacaaatttaagagagaatgggccagtgtcatgcgctgcatagcagtttttgttggcattaaccacgccagtgctaaattggattttgccaataatgtccagctgtccttgactttagcagccctatctttgggcctttggtggacatttgatcgttccagaagtggccttgggctggggatcaccatagcttttctagctacgctgatcacgcagtttctcgtgtataatggtgtctatcagtatacatccccagatttcctctatattcgttcttggctcccttgtatatttttctcaggaggcgtcacggtggggaacataggacgacagttagctatgggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacctagtctagaatagggaggtggagaatgatgacttaccctgaagtcttcccttgactgcccgcactggcgcctgtctgtgccctggagcattctgcccaggctacgtgggttcaggcaggtggcagcttcccaagtattcgatttcattcatgtgattaaaacaagttgccatatttcaaagccttgaactaagactcaattaccaacccgcagttttgtgtcagtgcccaaaggaggtaggttgatggtgcttaacaaacatgaagtatggtgtaataggaataatatttatccaaaagatttttaaaaatagggctgtgtttaaaaaaaaaaacaaaacaagaaaagcagcagtgattatagagaggtcacactctaagtggggtcgcggcgtggccacgcttcacggtcacgctcgtccgtcctgcagtggcgtgtttacatggtcacacgtgtgtgtatcaccagtgggtcaactgcttgtcattcctcccgtggcagtttgtgtagacaatcttactgagcaaaaggcaatgaaaagtcttggttcccacactgcgatatattggaattttcacctcagtttatgaagtttatttcgaaatccatagtcatctaagaatgaatacctgtctgccatgtatttcaatcttagtgagccaaaattgtttgtttgttactacagaatagagatgactgttttttgccacagccctatggaatttgcaatctgtgattgccttgtaaaaaggagagtgcatatggcactgcattaaacgtgtggtgtttctagtcaatgatattggtgagcacaatgtattcatttaatggcatagaccataccagacctaatttgcaagtattgggtcttaaacttcaagtgcaatgtatatgaaaaccaatctgagccttgtatctcttaaatatttattttttttaacgtgtgagatgttcgagagaaggttctccattcatttcagtgctgcctggaggaaactcggcaatgatttctttcagttgtgaagttcctttcgtgttacaccctccactgaaccctcaaccttcgaaatactccagttttgtgggtttggtcatttttacttataaatttacctttttgtattttgcaatttacatgtgtttggtttgttttaaattctgtgaaagtggcttgattaaaagactccttttaaatggaagccaccagtcagcagaatggaagcttagaggaacttgcctgtgagcgctggtctttgtgtttggttttgtgatgtaacgatctttgctggggttttttgctttgttttgagggaaatgtcttggagtaaattttaagttcctggagttaatttgttttacaggaattttgttttttaaaaaaataggatcattctgaactttggaatgacccccttatatattttctgaaaatgaaaacagttacatgaaaaaaatttccaatgaagatgtcagcattttatgaaaaaccagaagttattagatgaaagcagcgagtgaatctttaaaacagacttgatcacgcacacacaataagtctttctctccgaaaccggaagtaaatctatatctgttagaaataatgtagccaaaagaatgtaaatttgaggatttttttgccaatagtttatagaaaatatatgaaccaaagtgatttgagtttgtaaaaatgtaaaatagtatgaacaaaatttgcactctaccagatttgaacatctagtgaggttcacattcatactaagttttcaacattgtgttctttttgcattcattttttacttttattaaaggttcaaaacctctgccgaattcggcacgagcgcacgag

SEQ ID NO: 548816 - DNA, 3164 bp, Homo sapiens
  misc_feature (3038)..(3038): n is a, c, g, or t
  misc_feature (3041)..(3042): n is a, c, g, or t
  misc_feature (3044)..(3044): n is a, c, g, or t
  misc_feature (3047)..(3047): n is a, c, g, or t
  misc_feature (3050)..(3050): n is a, c, g, or t
  misc_feature (3052)..(3053): n is a, c, g, or t
  misc_feature (3061)..(3061): n is a, c, g, or t
  misc_feature (3073)..(3073): n is a, c, g, or t
  misc_feature (3078)..(3078): n is a, c, g, or t
gcggccgcctcaccagaccgcgtgcggacgggctcgcgggcggggcggggcaagctcaggccacgcccctgggcggtgcgcgcgggcggtgggtaggccgggcaggctcacgtgatgcgggccccgcggcccgccatataaacccgcgcgcccgccaggcgctgcggccgtcccgggccgtgactcctcctttcccccgccccgcctccgttcggagagccggcgggcgggcgcctctcggccaggaagcgcctcttggacgcgtgtgaccgatgcccagattgcacgaccacttctggagctgctcctgtgcgcacagcgcgaggcgccgaggccccccgcgagccagcgccgcggggctggcggccaaggttggggagatgatcaacgtttccgtgtccgggccctccctgctggcggcccacggtgccccggacgctgaccccgcgcccaggggccgcagtgctgcgatgagcggccccgagcccggcagcccctaccccaacacctggcatcatcgcctgttgcagaggagcctcgtgctcttctcggttggggtggtcctagccctggtgctcaacctgctgcagatccagaggaatgtcactctcttccccgaggaggtgatcgccaccatcttttcctccgcctggtgggtccctccctgctgcgggacagcagctgctgttgttggcctactgtacccctgtatcgacagtcacctcggagaaccccacaaatttaagagagaatgggccagtgtcatgcgctgcatagcagtttttgttggcattaaccacgccagtgctaaattggattttgccaataatgtccagctgtccttgactttagcagccctatctttgggcctttggtggacatttgatcgttccagaagtggccttgggctggggatcaccatagcttttctagctacgctgatcacgcagtttctcgtgtataatggtgtctatcagtatacatccccagatttcctctatattcgttcttggctcccttgtatatttttctcaggaggcgtcacggtggggaacataggacgacagttagctatgggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacctagtctagaatagggaggtggagaatgatgacttaccctgaagtcttcccttgactgcccgcactggcgcctgtctgtgccctggagcattctgcccaggctacgtgggttcaggcaggtggcagcttcccaagtattcgatttcattcatgtgattaaaacaagttgccatatttcaaagccttgaactaagactcaattaccaacccgcagttttgtgtcagtgcccaaaggaggtaggttgatggtgcttaacaaacatgaagtatggtgtaataggaataatatttatccaaaagatttttaaaaatagggctgtgtttaaaaaaaaaaacaaaacaagcacgcttcacggtcacgctcgtccgtcctgcagtggcgtgtttacatggtcacacgtgtgtgtatcaccagtgggtcaactgcttgtcattcctcccgtggcagtttgtgtagacaatcttactgagcaaaaggcaatgaaaagtcttggttcccacactgcgatatattggaattttcacctcagtttatgaagtttatttcgaaatccatagtcatctaagaatgaatacctgtctgccatgtatttcaatcttagtgagccaaaattgtttgtttgttactacagaatagagatgactgttttttgccacagccctatggaatttgcaatctgtgattgccttgtaaaaaggagagtgcatatggcactgcattaaacgtgtggtgtttctagtcaatgatattggtgagcacaatgtattcatttaatggcatagaccataccagacctaatttgcaagtattgggtcttaaacttcaagtgcaatgtatatgaaaaccaatctgagccttgtatctcttaaatatttattttttttaacgtgtgagatgttcgagagaaggttctccattcatttcagtgctgcctggaggaaactcggcaatgatttctttcagttgtgaagttcctttcgtgttacaccctccactgaaccctcaaccttcgaaatactccagttttgtgggtttggtcatttttacttataaatttacctttttgtattttgcaatttacatgtgtttggtttgttttaaattctgtgaaagtggcttgattaaaagactccttttaaatggaagccaccagtcagcagaatggaagcttagaggaacttgcctgtgagcgctggtctttgtgtttggttttgtgatgtaacgatctttgctggggttttttgctttgttttgagggaaatgtcttggagtaaattttaagttcctggagttaatttgttttacaggaattttgttttttaaaaaaataggatcattctgaactttggaatgacccccttatatattttctgaaaatgaaaacagttacatgaaaaaaatttccaatgaagatgtcagcattttatgaaaaaccagaagttattagatgaaagcagcgagtgaatctttaaaacagacttgatcacgcacacacaataagtctttctctccgaaaccggaagtaaatctatatctgttagaaataatgtagccaaaagaatgtaaatttgaggatttttttgccaatagtttatagaaaatatatgaaccaaagtgatttgagtttgtaaaaatgtaaaatagtatgaacaaaatttgcactctaccagatttgaacatctagtgaggttcacattcatactaagttttcaacattgtgttctttttgcattcattttttacttttattaaaggttcaaaaccaaaaaaaaaaaaaaaaaaaaaanatnntntgnggngnntcgggccngaaaaagttttnaaccnttcgttggggcggggccccagtggttgtgcacccgggccaaggtgttcccaaggaaaaccccggccgaaaatggggtggggttccc

SEQ ID NO: 548817 - DNA, 356 bp, Homo sapiens
  misc_feature (55)..(55): n is a, c, g, or t
cggcacgaggtgaatggggacagagtctcatctcgggaagatgaaagggttccgnagatggatggcagtgagggctgcacaccagcgtgagtgtccctaatgcccctgaactgtgcattgaaaaacagtgtacatttaggacagtacattgatgtgatgtgttttttgccccaataaaaagtatgcgactttaaaaaatgtccaatgggttcctggccacagcgatgcaagaggccagtaacggggagactgcaggcatgggggagggctgggcagggggtagagcatcagggaactttctgtactttctgctccattttctataaaccttaaagtgtgttctttaaaaaaaaaaa

SEQ ID NO: 548818 - DNA, 315 bp, Homo sapiens
gaatctcatgagatggagagcattctcaaattatactgagaagtagcctgggcgtgatggctcatgcctgtaatcccaccactttgggaggctgaggcgggtggatcacttgaggtcaggagttcgagactagcctggccaacatggtgaaaccttgtctccactaaaaatacaaaaattagctgggtaaggtggcaggcacctgtaatcccagctactcgggaggctgaggcaggagaatctcatgaatccgggaggtggaggttgcagtgagtggagatcatgccattacactccagcctggcaacagagtga

SEQ ID NO: 548819 - DNA, 3164 bp, Homo sapiens
  misc_feature (3038)..(3038): n is a, c, g, or t
  misc_feature (3041)..(3042): n is a, c, g, or t
  misc_feature (3044)..(3044): n is a, c, g, or t
  misc_feature (3047)..(3047): n is a, c, g, or t
  misc_feature (3050)..(3050): n is a, c, g, or t
  misc_feature (3052)..(3053): n is a, c, g, or t
  misc_feature (3061)..(3061): n is a, c, g, or t
  misc_feature (3073)..(3073): n is a, c, g, or t
  misc_feature (3078)..(3078): n is a, c, g, or t
gcggccgcctcaccagaccgcgtgcggacgggctcgcgggcggggcggggcaagctcaggccacgcccctgggcggtgcgcgcgggcggtgggtaggccgggcaggctcacgtgatgcgggccccgcggcccgccatataaacccgcgcgcccgccaggcgctgcggccgtcccgggccgtgactcctcctttcccccgccccgcctccgttcggagagccggcgggcgggcgcctctcggccaggaagcgcctcttggacgcgtgtgaccgatgcccagattgcacgaccacttctggagctgctcctgtgcgcacagcgcgaggcgccgaggccccccgcgagccagcgccgcggggctggcggccaaggttggggagatgatcaacgtttccgtgtccgggccctccctgctggcggcccacggtgccccggacgctgaccccgcgcccaggggccgcagtgctgcgatgagcggccccgagcccggcagcccctaccccaacacctggcatcatcgcctgttgcagaggagcctcgtgctcttctcggttggggtggtcctagccctggtgctcaacctgctgcagatccagaggaatgtcactctcttccccgaggaggtgatcgccaccatcttttcctccgcctggtgggtccctccctgctgcgggacagcagctgctgttgttggcctactgtacccctgtatcgacagtcacctcggagaaccccacaaatttaagagagaatgggccagtgtcatgcgctgcatagcagtttttgttggcattaaccacgccagtgctaaattggattttgccaataatgtccagctgtccttgactttagcagccctatctttgggcctttggtggacatttgatcgttccagaagtggccttgggctggggatcaccatagcttttctagctacgctgatcacgcagtttctcgtgtataatggtgtctatcagtatacatccccagatttcctctatattcgttcttggctcccttgtatatttttctcaggaggcgtcacggtggggaacataggacgacagttagctatgggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacctagtctagaatagggaggtggagaatgatgacttaccctgaagtcttcccttgactgcccgcactggcgcctgtctgtgccctggagcattctgcccaggctacgtgggttcaggcaggtggcagcttcccaagtattcgatttcattcatgtgattaaaacaagttgccatatttcaaagccttgaactaagactcaattaccaacccgcagttttgtgtcagtgcccaaaggaggtaggttgatggtgcttaacaaacatgaagtatggtgtaataggaataatatttatccaaaagatttttaaaaatagggctgtgtttaaaaaaaaaaacaaaacaagaaaagcagcagtgattatagagaggtcacactctaagtggggtcgcggcgtggccacgcttcacggtcacgctcgtccgtcctgcagtggcgtgtttacatggtcacacgtgtgtgtatcaccagtgggtcaactgcttgtcattcctcccgtggcagtttgtgtagacaatcttactgagcaaaaggcaatgagtttatttcgaaatccatagtcatctaagaatgaatacctgtctgccatgtatttcaatcttagtgagccaaaattgtttgtttgttactacagaatagagatgactgttttttgccacagccctatggaatttgcaatctgtgattgccttgtaaaaaggagagtgcatatggcactgcattaaacgtgtggtgtttctagtcaatgatattggtgagcacaatgtattcatttaatggcatagaccataccagacctaatttgcaagtattgggtcttaaacttcaagtgcaatgtatatgaaaaccaatctgagccttgtatctcttaaatatttattttttttaacgtgtgagatgttcgagagaaggttctccattcatttcagtgctgcctggaggaaactcggcaatgatttctttcagttgtgaagttcctttcgtgttacaccctccactgaaccctcaaccttcgaaatactccagttttgtgggtttggtcatttttacttataaatttacctttttgtattttgcaatttacatgtgtttggtttgttttaaattctgtgaaagtggcttgattaaaagactccttttaaatggaagccaccagtcagcagaatggaagcttagaggaacttgcctgtgagcgctggtctttgtgtttggttttgtgatgtaacgatctttgctggggttttttgctttgttttgagggaaatgtcttggagtaaattttaagttcctggagttaatttgttttacaggaattttgttttttaaaaaaataggatcattctgaactttggaatgacccccttatatattttctgaaaatgaaaacagttacatgaaaaaaatttccaatgaagatgtcagcattttatgaaaaaccagaagttattagatgaaagcagcgagtgaatctttaaaacagacttgatcacgcacacacaataagtctttctctccgaaaccggaagtaaatctatatctgttagaaataatgtagccaaaagaatgtaaatttgaggatttttttgccaatagtttatagaaaatatatgaaccaaagtgatttgagtttgtaaaaatgtaaaatagtatgaacaaaatttgcactctaccagatttgaacatctagtgaggttcacattcatactaagttttcaacattgtgttctttttgcattcattttttacttttattaaaggttcaaaaccaaaaaaaaaaaaaaaaaaaaaanatnntntgnggngnntcgggccngaaaaagttttnaaccnttcgttggggcggggccccagtggttgtgcacccgggccaaggtgttcccaaggaaaaccccggccgaaaatggggtggggttccc

SEQ ID NO: 548820 - DNA, 646 bp, Homo sapiens
  misc_feature (517)..(517): n is a, c, g, or t
gcctggccttcatgtctctcctggaggagaagttgctcccggtgctggtacatacttttgggatagacaccaagaagctacgtggaagtgacccgcgaagtggtatgcagaggctatgccctttcccctcgaacttcttcctgcctggccgcatgtcagcggcagtacatggaacggctacgagctgctgacttggggagcacaggcctgaggatcgaggaaggagctggagaaggagctgtagccgacaggctctgggagtgtctgaccctggtctctcagtggcctgggctcttcaataagttcttcttcggacagtgcccctgcctccttggacgctcttcgtcttcagctaacttggcgcctgctgtctgcaagtgcaaagactagatcctatgtggcgaaggcatgcaggtccacctgctggtgtggtctcgatagctaatctcttgtgtcctagttgtatcccatgagttctcatgctcatcatacattcaccctgcggactggaagctgnaggtaccaccgacaaacgccagacaccacggcagggcccagagacgtgacggacggagccagtaccgtggccaggaaccaggaatccataatctgtgctggctgagattgggccagcatggatgggcta

SEQ ID NO: 548821 - DNA, 3291 bp, Homo sapiens
  misc_feature (3165)..(3165): n is a, c, g, or t
  misc_feature (3168)..(3169): n is a, c, g, or t
  misc_feature (3171)..(3171): n is a, c, g, or t
  misc_feature (3174)..(3174): n is a, c, g, or t
  misc_feature (3177)..(3177): n is a, c, g, or t
  misc_feature (3179)..(3180): n is a, c, g, or t
  misc_feature (3188)..(3188): n is a, c, g, or t
  misc_feature (3200)..(3200): n is a, c, g, or t
  misc_feature (3205)..(3205): n is a, c, g, or t
gcggccgcctcaccagaccgcgtgcggacgggctcgcgggcggggcggggcaagctcaggccacgcccctgggcggtgcgcgcgggcggtgggtaggccgggcaggctcacgtgatgcgggccccgcggcccgccatataaacccgcgcgcccgccaggcgctgcggccgtcccgggccgtgactcctcctttcccccgccccgcctccgttcggagagccggcgggcgggcgcctctcggccaggaagcgcctcttggacgcgtgtgaccgatgcccagattgcacgaccacttctggagctgctcctgtgcgcacagcgcgaggcgccgaggccccccgcgagccagcgccgcggggctggcggccaaggttggggagatgatcaacgtttccgtgtccgggccctccctgctggcggcccacggtgccccggacgctgaccccgcgcccaggggccgcagtgctgcgatgagcggccccgagcccggcagcccctaccccaacacctggcatcatcgcctgttgcagaggagcctcgtgctcttctcggttggggtggtcctagccctggtgctcaacctgctgcagatccagaggaatgtcactctcttccccgaggaggtgatcgccaccatcttttcctccgcctggtgggtccctccctgctgcgggacagcagctgctgttgttggcctactgtacccctgtatcgacagtcacctcggagaaccccacaaatttaagagagaatgggccagtgtcatgcgctgcatagcagtttttgttggcattaaccacgccagtgctaaattggattttgccaataatgtccagctgtccttgactttagcagccctatctttgggcctttggtggacatttgatcgttccagaagtggccttgggctggggatcaccatagcttttctagctacgctgatcacgcagtttctcgtgtataatggtgtctatcagtatacatccccagatttcctctatattcgttcttggctcccttgtatatttttctcaggaggcgtcacggtggggaacataggacgacagttagctatgggctgatacccttctgtgaggagttgaatttgaagaccacttggctgtttcacaaaaccagaagtaattacagggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacctagtctagaatagggaggtggagaatgatgacttaccctgaagtcttcccttgactgcccgcactggcgcctgtctgtgccctggagcattctgcccaggctacgtgggttcaggcaggtggcagcttcccaagtattcgatttcattcatgtgattaaaacaagttgccatatttcaaagccttgaactaagactcaattaccaacccgcagttttgtgtcagtgcccaaaggaggtaggttgatggtgcttaacaaacatgaagtatggtgtaataggaataatatttatccaaaagatttttaaaaatagggctgtgtttaaaaaaaaaaacaaaacaagaaaagcagcagtgattatagagaggtcacactctaagtggggtcgcggcgtggccacgcttcacggtcacgctcgtccgtcctgcagtggcgtgtttacatggtcacacgtgtgtgtatcaccagtgggtcaactgcttgtcattcctcccgtggcagtttgtgtagacaatcttactgagcaaaaggcaatgaaaagtcttggttcccacactgcgatatattggaattttcacctcagtttatgaagtttatttcgaaatccatagtcatctaagaatgaatacctgtctgccatgtatttcaatcttagtgagccaaaattgtttgtttgttactacagaatagagatgactgttttttgccacagccctatggaatttgcaatctgtgattgccttgtaaaaaggagagtgcatatggcactgcattaaacgtgtggtgtttctagtcaatgatattggtgagcacaatgtattcatttaatggcatagaccataccagacctaatttgcaagtattgggtcttaaacttcaagtgcaatgtatatgaaaaccaatctgagccttgtatctcttaaatatttattttttttaacgtgtgagatgttcgagagaaggttctccattcatttcagtgctgcctggaggaaactcggcaatgatttctttcagttgtgaagttcctttcgtgttacaccctccactgaaccctcaaccttcgaaatactccagttttgtgggtttggtcatttttacttataaatttacctttttgtattttgcaatttacatgtgtttggtttgttttaaattctgtgaaagtggcttgattaaaagactccttttaaatggaagccaccagtcagcagaatggaagcttagaggaacttgcctgtgagcgctggtctttgtgtttggttttgtgatgtaacgatctttgctggggttttttgctttgttttgagggaaatgtcttggagtaaattttaagttcctggagttaatttgttttacaggaattttgttttttaaaaaaataggatcattctgaactttggaatgacccccttatatattttctgaaaatgaaaacagttacatgaaaaaaatttccaatgaagatgtcagcattttatgaaaaaccagaagttattagatgaaagcagcgagtgaatctttaaaacagacttgatcacgcacacacaataagtctttctctccgaaaccggaagtaaatctatatctgttagaaataatgtagccaaaagaatgtaaatttgaggatttttttgccaatagtttatagaaaatatatgaaccaaagtgatttgagtttgtaaaaatgtaaaatagtatgaacaaaatttgcactctaccagatttgaacatctagtgaggttcacattcatactaagttttcaacattgtgttctttttgcattcattttttacttttattaaaggttcaaaaccaaaaaaaaaaaaaaaaaaaaaanatnntntgnggngnntcgggccngaaaaagttttnaaccnttcgttggggcggggccccagtggttgtgcacccgggccaaggtgttcccaaggaaaaccccggccgaaaatggggtggggttccc

SEQ ID NO: 548822 - DNA, 2724 bp, Homo sapiens
gcggccgcctcaccagaccgcgtgcggacgggctcgcgggcggggcggggcaagctcaggccacgcccctgggcggtgcgcgcgggcggtgggtaggccgggcaggctcacgtgatgcgggccccgcggcccgccatataaacccgcgcgcccgccaggcgctgcggccgtcccgggccgtgactcctcctttcccccgccccgcctccgttcggagagccggcgggcgggcgcctctcggccaggaagcgcctcttggacgcgtgtgaccgatgcccagattgcacgaccacttctggagctgctcctgtgcgcacagcgcgaggcgccgaggccccccgcgagccagcgccgcggggctggcggccaaggttggggagatgatcaacgtttccgtgtccgggccctccctgctggcggcccacggtgccccggacgctgaccccgcgcccaggggccgcagtgctgcgatgagcggccccgagcccggcagcccctaccccaacacctggcatcatcgcctgttgcagaggagcctcgtgctcttctcggttggggtggtcctagccctggtgctcaacctgctgcagatccagaggaatgtcactctcttccccgaggaggtgatcgccaccatcttttcctccgcctggtgggtccctccctgctgcgggacagcagctgctgttgttggcctactgtacccctgtatcgacagtcacctcggagaaccccacaaatttaagagagaatgggccagtgtcatgcgctgcatagcagtttttgttggcattaaccacgccagtgctaaattggattttgccaataatgtccagctgtccttgactttagcagccctatctttgggcctttggtggacatttgatcgttccagaagtggccttgggctggggatcaccatagcttttctagctacgctgatcacgcagtttctcgtgtataatggtgtctatcagtatacatccccagatttcctctatattcgttcttggctcccttgtatatttttctcaggaggcgtcacggtggggaacataggacgacagttagctatgggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacctagtctagaatagggaggtggagaatgatgacttaccctgaagtcttcccttgactgcccgcactggcgcctgtctgtgccctggagcattctgcccaggctacgtgggttcaggcaggtggcagcttcccaagtattcgatttcattcatgtgattaaaacaagttgccatatttcaaagccttgaactaagactcaattaccaacccgcagttttgtgtcagtgcccaaaggaggtaggttgatggtgcttaacaaacatgaagtatggtgtaataggaataatatttatccaaaagatttttaaaaatagggctgtgtttaaaaaaaaaaacaaaacaagaaaagcagcagtgattatagagaggtcacactctaagtggggtcgcggcgtggccacgcttcacggtcacgctcgtccgtcctgcagtggcgtgtttacatggtcacacgtgtgtgtatcaccagtgggtcaactgcttgtcattcctcccgtggcagtttgtgtagacaatcttactgagcaaaaggcaatgaaaagtcttggttcccacactgcgatatattggaattttcacctcagtttatgaagtttatttcgaaatccatagtcatctaagaatgaatacctgtctgccatgtatttcaatcttagtgagccaaaattgtttgtttgttactacagaatagagatgactgttttttgccacagccctatggaatttgcaatctgtgattgccttgtaaaaaggagagtgcatatggcactgcattaaacgtgtggtgtttctagtcaatgatattggtgagcacaatgtattcatttaatggcatagaccataccagacctaatttgcaagtattgggtcttaaacttcaagtgcaatgtatatgaaaaccaatctgagccttgtatctcttaaatatttattttttttaacgtgtgagatgttcgagagaaggttctccattcatttcagtgctgcctggaggaaactcggcaatgatttctttcagttgtgaagttcctttcgtgttacaccctccactgaaccctcaaccttcgaaatactccagttttgtgggtttggtcatttttacttataaatttacctttttgtattttgcaatttacatgtgtttggtttgttttaaattctgtgaaagtggcttgattaaaagactccttttaaatggaagccaccagtcagcagaatggaagcttagaggaacttgcctgtgagcgctggtctttgtgtttggttttgtgatgtaacgatctttgctggggttttttgctttgttttgagggaaatgtcttggagtaaattttaagttcctggagttaatttgttttacaggaattttgttttttaaaaaaataggatcattctgaactttggaatgacccccttatatattttctgaaaatgaaaacagttacatgtttccaatggatgtcagcattttatg

SEQ ID NO: 548823 - DNA, 111 bp, Homo sapiens
atggcatctctgcgctacgtggtctacatgtacgctccttcccctatcatagcaagagcttatcacctttcatgtgtcacgccctcataatcatttctccttatctgcttc

SEQ ID NO: 548824 - DNA, 3164 bp, Homo sapiens
  misc_feature (3038)..(3038): n is a, c, g, or t
  misc_feature (3041)..(3042): n is a, c, g, or t
  misc_feature (3044)..(3044): n is a, c, g, or t
  misc_feature (3047)..(3047): n is a, c, g, or t
  misc_feature (3050)..(3050): n is a, c, g, or t
  misc_feature (3052)..(3053): n is a, c, g, or t
  misc_feature (3061)..(3061): n is a, c, g, or t
  misc_feature (3073)..(3073): n is a, c, g, or t
  misc_feature (3078)..(3078): n is a, c, g, or t
gcggccgcctcaccagaccgcgtgcggacgggctcgcgggcggggcggggcaagctcaggccacgcccctgggcggtgcgcgcgggcggtgggtaggccgggcaggctcacgtgatgcgggccccgcggcccgccatataaacccgcgcgcccgccaggcgctgcggccgtcccgggccgtgactcctcctttcccccgccccgcctccgttcggagagccggcgggcgggcgcctctcggccaggaagcgcctcttggacgcgtgtgaccgatgcccagattgcacgaccacttctggagctgctcctgtgcgcacagcgcgaggcgccgaggccccccgcgagccagcgccgcggggctggcggccaaggttggggagatgatcaacgtttccgtgtccgggccctccctgctggcggcccacggtgccccggacgctgaccccgcgcccaggggccgcagtgctgcgatgagcggccccgagcccggcagcccctaccccaacacctggcatcatcgcctgttgcagaggagcctcgtgctcttctcggttggggtggtcctagccctggtgctcaacctgctgcagatccagaggaatgtcactctcttccccgaggaggtgatcgccaccatcttttcctccgcctggtgggtccctccctgctgcgggacagcagctgctgttgttggcctactgtacccctgtatcgacagtcacctcggagaaccccacaaatttaagagagaatgggccagtgtcatgcgctgcatagcagtttttgttggcattaaccacgccagtgctaaattggattttgccaataatgtccagctgtccttgactttagcagccctatctttgggcctttggtggacatttgatcgttccagaagtggccttgggctggggatcaccatagcttttctagctacgctgatcacgcagtttctcgtgtataatggtgtctatcagtatacatccccagatttcctctatattcgttcttggctcccttgtatatttttctcaggaggcgtcacggtggggaacataggacgacagttagctatgggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacctagtctagaatagggaggtggagaatgatgacttaccctgaagtcttcccttgactgcccgcactggcgcctgtctgtgccctggagcattctgcccaggctacgtgggttcaggcaggtggcagcttcccaagtattcgatttcattcatgtgattaaaacaagttgccatatttcaaagccttgaactaagactcaattaccaacccgcagttttgtgtcagtgcccaaaggaggtaggttgatggtgcttaacaaacatgaagtatggtgtaataggaataatatttatccaaaagatttttaaaaatagggctgtgtttaaaaaaaaaaacaaaacaagaaaagcagcagtgattatagagaggtcacactctaagtggggtcgcggcgtggccacgcttcacggtcacgctcgtccgtcctgcagtggcgtgtttacatggtcacacgtgtgtgtatcaccagtgggtcaactgcttgtcattcctcccgtggcagtttgtgtagacaatcttactgagcaaaaggcaatgaaaagtcttggttcccacactgcgatatattggaattttcacctcagtttatgaagtttatttcgaaatccatagtcatctaagaatgaatacctgtctgccatgtatttcaatcttagtgagccaaaattgtttgtttgttactacagaatagagatgactgttttttgccacagccctatggaatttgcaatctgtgattgccttgtatattggtgagcacaatgtattcatttaatggcatagaccataccagacctaatttgcaagtattgggtcttaaacttcaagtgcaatgtatatgaaaaccaatctgagccttgtatctcttaaatatttattttttttaacgtgtgagatgttcgagagaaggttctccattcatttcagtgctgcctggaggaaactcggcaatgatttctttcagttgtgaagttcctttcgtgttacaccctccactgaaccctcaaccttcgaaatactccagttttgtgggtttggtcatttttacttataaatttacctttttgtattttgcaatttacatgtgtttggtttgttttaaattctgtgaaagtggcttgattaaaagactccttttaaatggaagccaccagtcagcagaatggaagcttagaggaacttgcctgtgagcgctggtctttgtgtttggttttgtgatgtaacgatctttgctggggttttttgctttgttttgagggaaatgtcttggagtaaattttaagttcctggagttaatttgttttacaggaattttgttttttaaaaaaataggatcattctgaactttggaatgacccccttatatattttctgaaaatgaaaacagttacatgaaaaaaatttccaatgaagatgtcagcattttatgaaaaaccagaagttattagatgaaagcagcgagtgaatctttaaaacagacttgatcacgcacacacaataagtctttctctccgaaaccggaagtaaatctatatctgttagaaataatgtagccaaaagaatgtaaatttgaggatttttttgccaatagtttatagaaaatatatgaaccaaagtgatttgagtttgtaaaaatgtaaaatagtatgaacaaaatttgcactctaccagatttgaacatctagtgaggttcacattcatactaagttttcaacattgtgttctttttgcattcattttttacttttattaaaggttcaaaaccaaaaaaaaaaaaaaaaaaaaaanatnntntgnggngnntcgggccngaaaaagttttnaaccnttcgttggggcggggccccagtggttgtgcacccgggccaaggtgttcccaaggaaaaccccggccgaaaatggggtggggttccc

SEQ ID NO: 548825 - DNA, 869 bp, Homo sapiens
actcccggagtaggtagttcgtagggccgggttctggggtcgtgcttctctttacttgtccactctaggccacgatgccgcagtaccagatctgggaggagttcagtcgcgcgtgccgagaggctttacctcgcggaccctatgagggacaagtgtggtatctcaatgtataggacattctgatgggaagttgtgtgttcaagtgacaggtgaatgaattggtgtggggtgtataagcagagagagacgcgagatgtggagaagatggagaaatttgtcggagaagactaatgagagctgaatggtaggtcagggaaggcacgcaggtaaggcatggaatggagagtggaatggattggttgttgagaggaaaggaacgaccgtgtgcggtgtgacgtgtagagaaaggtattctagtacttcagaatataagagtagtggtgtggggacagaaagtatgttggagtgtaactaagtgggcatgtgccagtaagccttagaggtcaagagtgtgattctcctttgacagttacttgtagagagctagggatgcagaatgttagcagttagaaggagcctctatctgcctgtgggcagatgacccagcaaactgcatctgtccttgagcaaacggagattattcggatgtcaggtacgcccatgtcatcgtcgttctggcaacttgtatcaggcacattttgcaaggagcatcttagggaaaaccaaatctctcaaagggcggcatcctttcatgaacgacctaactgtgccacttgtcgacgcacgcattgggcagacacgttgcggggcgacacacatcacactcggagttccccccagatcgcggcaagcgggccacgtgtgaggaa

SEQ ID NO: 548826 - DNA, 565 bp, Homo sapiens
  misc_feature (200)..(200): n is a, c, g, or t
  misc_feature (214)..(214): n is a, c, g, or t
  misc_feature (223)..(223): n is a, c, g, or t
  misc_feature (239)..(239): n is a, c, g, or t
  misc_feature (272)..(272): n is a, c, g, or t
  misc_feature (279)..(279): n is a, c, g, or t
  misc_feature (300)..(300): n is a, c, g, or t
  misc_feature (352)..(352): n is a, c, g, or t
  misc_feature (399)..(399): n is a, c, g, or t
  misc_feature (429)..(429): n is a, c, g, or t
  misc_feature (437)..(437): n is a, c, g, or t
  misc_feature (443)..(443): n is a, c, g, or t
  misc_feature (473)..(473): n is a, c, g, or t
  misc_feature (551)..(551): n is a, c, g, or t
gccgcggccgggccccgccctggggccgctccccgcgggttccgttggctgtggcggcagctgacgcttgtggcggcggtggcttcggggtgggcgtaagatggcgacacagcgcagggacccctaagcttgctgtggggctggctgtggagcgagcgcttctggctacccgagaacgtgagctgggctgatctggaggngccggccgacggcnacggttacncccgcggccggcacancctctcggtgttcccgctggcggcgggcatctncttcgtnaggctgctcttcgagcgattnattgccaaaccctgtgcactccgtattggcatcgaggacagtggtccttatnaggtccctaactccaatgccatccttgaaaaggtgttcatatctatnaccaagtatcctgataagaaaaggctgganggcctgtnacacanacagctggattggaatgtccgaaacacacnccacactgctggtttcgcacactccggacggaacttcacggacaacgccccccaaccgccttacctaagactttctgntgaaacgcactgtg

SEQ ID NO: 548827 - DNA, 249 bp, Homo sapiens
  misc_feature (192)..(192): n is a, c, g, or t
ccaaggaggtattgaggggtaagagagagctcttgtccagaagatagtatttctagtctgtaattattcataaccttcaagattacatttagcccttaccttcctggtgacatcttaaaattccctagaacatcagtcacagaattccaaatgcattctgacaccagagattttgtctaacttacacttgtnaacttcatagctacttctctattgagtggtaaatttcatttctaataatggaagagg

SEQ ID NO: 548828 - DNA, 889 bp, Homo sapiens
  misc_feature (413)..(413): n is a, c, g, or t
agcgggtgggccttactgctatggtgccaagcaaaaaaaaaaaaaaaaaaaaaaaaaaaaaaaaaaaaacaacccttttttggtcttttttacaatatttggcaaataaatcagggattgaaaccccctaggggggggtcccgggacccgggaagggggttttctgtactccaagaacagaattaaaagcgagcgagcatttgggtttcccaagcccttcccccttcttttcgtggttccctcggggggcccctcaaccttaagagaaatgaattcgtgtgcacctatacctcaccatacgtgctgtaagcttcactcagtgaacaccggcaccgtgaaaacttggaaccctttttcacactgggtggaacattttctttaaatatttttttccccctaaggtaagaagacgngggggtccgccacttacatgttggctgtcaggggcaatagtctcttcgagacacatccgcgggcttctctcaccagcgaaatctcccttccttcttacaccttagaggagcttccttccccaaaagagtggcgtgggcgattacacgggggtttacaaccaccccgggaggatccaaccccccgcaacccccccggtttttattattttctgtgtctttttttcaaaaaaagaaagagtgtggaggcctccccccaaagatgggttgccccccagagggtggtgggcccttagagaaccccccatagagcggctgaaagagaggagcattttctcccccgaacactcctaccgcctcccgtggagttaatgcctcgaacatataacccgggcttggtggcccccccacaccccagggtgggtgaaaactccctttttaaaacgtggctccagaattaggaaattataaaaaccctt

SEQ ID NO: 548829 - DNA, 396 bp, Homo sapiens
agctctaatttcttttgactgcggggtgacggcgctggatggcgcaaccggccgcaccgtgtggcaaggcaaggcggatgtcgatctgacctccggcccgggaagcgacggcacactgacggccgtggctggtgagaagggcaccgtcgtcgcgttcgacgagaagggcgcgcagaagtggaagagcaccgtcaacggtgaagtcctgaccgctccgctggtcggccagggcctggtgattgtgcgtacgaccgatggccgcatccttggcttggatggcagcaatggcgatcgcaagtggatctatcaacgctcgccgtcggcactgaacctgcgtagcagcctgccgatgatctttgccggtgacaatgtcatcctgggctttgccggtggcaa

SEQ ID NO: 548830 - DNA, 1404 bp, Homo sapiens
gcacgactaactgctacgtgacgctatcagctagagtgacccaagtgagcgccgtgcgcgatctacagctacagaccatacatgtgcacgcaccctacggcatctacaggcatgcctttgaggatggcttcgacaactgtgatgctggctggctctctgaccgcactgttcggtatcctatcacccagtcccgtcctggttgctatggcgaccgtagcagccttccaggggcttcggagctatgcggaggcgcaacccacaggaactctacgatgtgctatagcatttgcccgggcagactggggggcgaggtctctctacgctgggcccggcccgccgcctgacactggccggcgcgcgctgcacacgtgccgaccgccagggctgccgacgacttggcctcggctgggcacagactagcacactggcactggcctgcagggcctggaccacctgcgacccgggcctggctggccgacggcaagcgtgcgcataccacgcatccagcaccgccgacgccggccgctgcgagagcgcccagccccggcgccgctgccgcacccgcactaccgacctccgcctacacccggaccaggcctctcccacatcaccacgaccgacgcgcttcgaccgccctacctgctctcccgcagcctcactccacccccacgctcacacaccatggagcaccctagcagaccccaatcactcacgcggactcgaccggccacacactcccgcatccaccacaagggaccccaagcacacgaccactcggagccccccaccccggcgaacgcaccgcacagcaggacgcgacaaccccctgactttcccaacgagcaccccggcactgtccccccgccaggacggcacacacccccatggcaacccagccaccgacacaccacgcactacacaaacacaacccctcaacccacacacccgcagagcaccccacgacaggcaccccacacagcacacatcgccgcaccccgtagcgacccaaccacagtcagtcaccccacagcccacagccaacctagcgaccagccacaccaccacacctacacaccccgcgccgcgtcccccaccaaccacacgccccacaccaacgcccacctccaccccgacacaccggaccaccacaccagcacaccccgcacccggcaccaacgagcacatcaccacaccacacaccaacgccgcaacacacgataccaacacacccaccaacgacacaccagccccagccacgcacaaccacacaccacagcccacccccgccccaccccagcccagctagcgcgcacggtaccaactaccatactccgcccagacacccagccccacgaccacgcagcccccctaaccaccaaccacaccaccccccacacacctcct

SEQ ID NO: 548831 - DNA, 978 bp, Homo sapiens
  misc_feature (231)..(231): n is a, c, g, or t
  misc_feature (281)..(281): n is a, c, g, or t
gcttctcatagaagtcgaccaggacttgcttgcattggatgtgagattcacccggtaaatggtgaggaaaggcatagaaccaccaggctgcatgtgcgatgcggaactgcatccggatcatcgatcttgtccaacaatcgtaatcgtccgttgtggcgttggtcttctagagagatggattcatagtcagaagttatggatggtcataggtatctagtggcaatgtgggancgaattggaagattaggtgtgcttaaagcgaggatttgatggtctgattngtgtgtatcgaggcaaagtaatcaagtggcagttgaatctgacgaaatgagtctatggatgcgcctagagttgatgattggcactgagatttgagtatgctgtagtgctagtcgtaatgtttcaatgtcataggcactcgttctatggtggtgaatggatcgtggtgagggccaaaggtgcaaccgtcaagaatacgaagggagagataaaaggttctattcgagtagataaggggtatattataggtccatgatcagagatgattgtgcatcgtgtatgggtatcgtggggaaggatcgtttcgaatgtgtgtttggtgagtgagagtgaattggattgaactgcgagcgggtagatagcatggatggatggactattgctggtcgtatgtgatgcgacatgatgaatggatcgtgggagaccggtgagggctgagactctaggttgtccccttgggtgcccttgcggtctggtagaacacaaggggcggcgagttcaccggacggcgcaaagggcgtgggcggaaaaacgcactcgtcccagcgcgaggcttgagtgttaccaagggccactgagggcaaacgtgaccacgtggggcattcaccgacacgcttctatcccacaacagaagaaccaacctgtgcgagatcacacaacacacagagccaagaggcaccatgcctgtatcaattcggg

SEQ ID NO: 548832 - DNA, 182 bp, Homo sapiens
ggacccctcacggatacctcagtatactgaaaatccgaagatggcagcaagggagagtgtgaatgaagtgtgggtaagaaagataaagggaaaaattgtttttaagaaagttgaaactaagataaattatcctgtatcaatgtaccttggtctctcataatttagacattggcacttatttt

SEQ ID NO: 548833 - DNA, 732 bp, Homo sapiens
  misc_feature (1)..(1): n is a, c, g, or t
  misc_feature (16)..(17): n is a, c, g, or t
  misc_feature (62)..(62): n is a, c, g, or t
  misc_feature (86)..(86): n is a, c, g, or t
  misc_feature (166)..(166): n is a, c, g, or t
  misc_feature (174)..(174): n is a, c, g, or t
  misc_feature (278)..(278): n is a, c, g, or t
  misc_feature (290)..(290): n is a, c, g, or t
nccgggctggaggaanncggctcgagacaccagtgacacacacctttcacacacaccagcanacacggaacatttgagggactttnaggcaacccacagacagcacacacaagagacaccggcacacagaacacacccacacaggagcagcacacaccacacaccngcacacancacaacacacacaccacacacccgcagacacagagcaacacacacagcaacacacgacaaacaacccacacacaggacagcggacacaccagacacacacaccnaacacacagcanacactacacacctgcacacatcacaaccgccacacatgacacagtgtacacatacatgacaacacatacatcacacacaatacccacacatcacacaccacctatacacaccacacaacactgacacatgacacaccatatatatcgcataagcacacacatgacatgccacacacattcatcacatgccacacacatcacagcatgcacacacacacacatatgataacccgtacacataacagaccacatacacaccatacacacaggactccacacgttacaaaccacacatatgacacatacacccccacagacatacgacatcacacacgcattacgtagcgcgcgcgcgtgcgcgcgcgcgcacacaacaacacacacgcggacacatccgtccaaaagccggaaaggtttcatcaggtacccatattggttcggt

SEQ ID NO: 548834 - DNA, 477 bp, Homo sapiens
  misc_feature (18)..(18): n is a, c, g, or t
  misc_feature (23)..(23): n is a, c, g, or t
  misc_feature (27)..(27): n is a, c, g, or t
  misc_feature (73)..(73): n is a, c, g, or t
  misc_feature (89)..(89): n is a, c, g, or t
  misc_feature (93)..(93): n is a, c, g, or t
  misc_feature (107)..(107): n is a, c, g, or t
  misc_feature (112)..(112): n is a, c, g, or t
  misc_feature (117)..(117): n is a, c, g, or t
  misc_feature (127)..(127): n is a, c, g, or t
  misc_feature (156)..(156): n is a, c, g, or t
  misc_feature (178)..(178): n is a, c, g, or t
  misc_feature (410)..(410): n is a, c, g, or t
acctgggtgcaccttggnagcgncagncctaccactgcacctctgcccctcttttacctcagacgacctcagntcctggaggccctggnccanccattcacggatgncaagnacggnctttcacctnacaggcactaccatgtaaaacattgctgnccgtggtgttctcctacatagnccactctgctctacgtgggtccatggggtgttctctttaatcagatgggaagtcttcataaagccgcagtagaacttgagctgaaaacccagatggtgttaactgggccgccccactttccgggcataactttttagaaaacagaaatgcccttgatggtgggaaaaaagaaaacaaccacccccccactgcccaaaaaaaaaagccctgccctgttgctcgtgggtgctgngtttactcttccgtgtgcctttgcgtccgggttgggagctttctgtgtctaaccttcaactgctgtg

SEQ ID NO: 548835 - DNA, 497 bp, Homo sapiens
ctccataatgtgtgcccagccgggtgtgatgggacatccctatagtcctagctactcaggaggctgaggcaggaggataccttgagtgacctacgatcgtgccactgcactccggcctgggtggcagagaaggtgcctgtctcttaaaaagaagaaaaatgacggccaggcgtggtggctcacacctataatcctagccctttgggaggccaaggcaggcggatcacctgaggtcaggagtttgaaaccagcttggctaacatggcgaaacctcatctctactaaacatagaaaaattagctgggcacgtggtgcatgcctgtaattccagccactcggaaggctgaggcatgagaatcgcttgaacccgggaggcagacgttgcagtcagtcgagatcaggccactgcactccggcctgggtgacagagcaagactctgtctcaaaaaataaaaataggctgggtgcagtggctcaagcctgtaatcccagcactt

SEQ ID NO: 548836 - DNA, 442 bp, Homo sapiens
cggcagacggaacttaagcgcaaattttgaacagataaacaatgatagtgatcaccagataccagggtgttaatctttatgtgaaaaagtcttggtgatggtattgattgtgaactgtctccggcaaagagttttctccatattggtacaatcactatgtgcaaacggttatgattggacgggtggtcgcatgcaaagtgttttgcgttttgtagtgttgtctcctccccagtaataagccactataagcagttacagaaacttaactggtagaatgtgtggccacaagagccattgtatgtatgctttaggctcagtcgcaaaggaatagcgccaggctcacctacactaaaccagtatatgcgagagaattggcaatgtgtacgaagctgttcccataccctgtatatctatccccgtaccagtccatgcactctccttt

SEQ ID NO: 548837 - DNA, 128 bp, Homo sapiens
aggactcacggttcctgtggactgctcacctagtggcaataggctccagagctcctgagacgtccctagctcctggcttggagccctgctactgccatgccctgagcaccagaggaaggccattagac

SEQ ID NO: 548838 - DNA, 217 bp, Homo sapiens
aacgccctggagccaattttcaagaaaggattttccaaaggataatatttttctaataaatgcggctgcaacctcgtgcgcattcaattaaataggccaaatttttgctgtttaggtcatttccaggcttacacttgagctgtgtgcccagagatcatgcatttagatttatattttggccagaaaattcaaggttataatatatctaagaactacc

SEQ ID NO: 548839 - DNA, 798 bp, Homo sapiens
tcgataatggcccattggggcaaaaagcctggttagcgggggcgggcctcctaggtgaaaggagggtggatggaatataagggtgttagtcatgttagccttgtttcaggtgcgaaatagtagtagggctcggtgggtgcgtggagttattaagttggagttagtaggacatgcgggtagatagtttaggaataattataaattagtttacaattaagaaagtggtatatgttaaggtgttgtcacgtgctaaacacgtgcttattatttcactccttagtgtgtggtgtacatgtgcaggagttatggcttaagagatttggcgatagcgtgggtttgtggttaaactccaccttcaactgtgcctgtgctagtgagtggaataagattgagaagattgaggagaaaggctttacgttaaggtgagggagaaaattggcgtatatgatggagatgggggctagttttggctcagtttgagaaagaagcaggccggatgtcagaggggtgcctgggggtaacctcggggactcagaaagtgaacggggggctatccctagtttaatggctatagccattatgattataacggatgagaatggatggacagcatggaagggccatggaccggagagaaaactggtcgaagaaggatgcaatagcaggcaacgacggcggagcagccggagacaaccgagggcgtacgggaacaggggctatccggcaaacggaaacgcacgacgaaatcaggccacccgtaaactggcctagcggaacgtgcgcatgcaaaaacagccg

SEQ ID NO: 548840 - DNA, 1195 bp, Homo sapiens
agcggggtcttgctgagcgcaaggcggtggagtgcctgaggcctgagtgcctggggctggggtgggctggccgggctggctgttggcctcgcgccttcccctgctgtgtctgcgctgggctccgcgggcggtatcggagtgtcgtgcggcgctgtggcgggtgaacgcgcattgtcggagtgactgggccctgcggaacgaggaggtgcggccaggcgcatggggagccctcgggagcgggcccggcctacagcgaccggccccggccgtgtcccgggaggatgcgggctgcggccggccggcgcggagaggaaggcacccagggcattgtggacataatgctcatagtgtggcgatagtgcttagggcccattacttgggggcatgccatgcgagagcaccaagggaggctccgcaaggggacattgtcttcccattaaattccatgcgatggggagtgccaaacctaggtgcgggaaccctggggctaacagcacacgtaccgttacttgtgccatgggcaccttggtttccaaggccttgtaccttgggacttgaaacggcgggcgacgggggtccgaccaggacgataacgcctattccaattgggaaggctgcgttctagcacaaggcccccacgaaggcaaggggatccacatgaagccttcaattggggcccgaagggacccgcttggaaaattccgcttcgtacccgtaggcccccccgaagtgacaccattgggccacgcgccaaggtttccacttgtcatgccagaaggcacaagcggggaatccagagttggccttgcagtaggcattagaagcccaatgatagccgcgcaacagcttggagaggacggggcccgaagcggactttaaattcaagcgggcgcccccttgggaaacacaagaagggggaaccaactttcgaaggtgcgcaccaaagggcgtacccacagcaaaccgcgcagggtgccatcaccggggacagggcttggtgcacggggaaagactgttcaatatatagtatatcaaaggtagggccaaacaccatttatcggcactactatgaaaaggaacaattgtgggcccggagaaggaattacagacagaggtcagcattggtccggtcggccaaagtcgcccctgggggcgcattgtgcattgggggaggtggttctttgagggagaagcg

SEQ ID NO: 548841 - DNA, 330 bp, Homo sapiens
  misc_feature (302)..(302): n is a, c, g, or t
  misc_feature (316)..(316): n is a, c, g, or t
aaaaatgcaaagtctaatagcagaatggatcaagcagaagacaaaattagtgaacttgaagacagctatttgaaaactttagaatttctgttttttttttgtttatttcaatatttttaatttatctgatagcattctgaattccttctctgtgttttcttgaatttctttgagttttctcaaagcagctattttgaattctctttctggaaagaaggtcaccatatctctttcttcagggcttggcctcctgggtgcccttatttgagttccatttagtgagggccatgtttttccagggngggtgtttgatgcnttgtggggaaaccc

SEQ ID NO: 548842 - DNA, 140 bp, Homo sapiens
gggatccccgtcagccatggtgatgcgactgtcgagtgcgttcgtagttctgagttggctaagtcagaatagtaatgaggatgtcagtccgtgcgcgactaatacgattatgactgcgccgtgtaaagcttacagtgggg

SEQ ID NO: 548843 - DNA, 552 bp, Homo sapiens
  misc_feature (15)..(15): n is a, c, g, or t
  misc_feature (62)..(62): n is a, c, g, or t
  misc_feature (65)..(66): n is a, c, g, or t
  misc_feature (93)..(93): n is a, c, g, or t
  misc_feature (95)..(96): n is a, c, g, or t
  misc_feature (143)..(143): n is a, c, g, or t
  misc_feature (147)..(147): n is a, c, g, or t
  misc_feature (161)..(161): n is a, c, g, or t
  misc_feature (176)..(176): n is a, c, g, or t
  misc_feature (179)..(179): n is a, c, g, or t
  misc_feature (187)..(187): n is a, c, g, or t
  misc_feature (210)..(210): n is a, c, g, or t
  misc_feature (250)..(250): n is a, c, g, or t
  misc_feature (263)..(263): n is a, c, g, or t
  misc_feature (272)..(272): n is a, c, g, or t
  misc_feature (279)..(279): n is a, c, g, or t
  misc_feature (281)..(281): n is a, c, g, or t
  misc_feature (286)..(286): n is a, c, g, or t
  misc_feature (292)..(292): n is a, c, g, or t
  misc_feature (304)..(304): n is a, c, g, or t
  misc_feature (318)..(318): n is a, c, g, or t
  misc_feature (336)..(336): n is a, c, g, or t
  misc_feature (350)..(351): n is a, c, g, or t
  misc_feature (400)..(400): n is a, c, g, or t
  misc_feature (425)..(425): n is a, c, g, or t
  misc_feature (431)..(431): n is a, c, g, or t
  misc_feature (434)..(434): n is a, c, g, or t
  misc_feature (445)..(445): n is a, c, g, or t
  misc_feature (475)..(475): n is a, c, g, or t
  misc_feature (507)..(507): n is a, c, g, or t
taaaaagaagcagcnttttcatgaaatgcttggaggtgaacgagttctcagcatgtgagagncgnncatcccattgactttgaagtgtctctngnntaatagaagaaaaaaggggagggtgaagaaaaggaggaacatgctanaaancttatgagaattangcaaatgtgagggangancaaccgantgagcaactccactttttctatntgacaactttctacatctgactgttgattttggccgttgnctggctgaaagancgtgggagngcctagngnccctnagaagngcgctggttctncaaaagagagaggnggagaagccctgcaggangcgctgaccacttnncagagaactgagagtgcgtgctcccaaaagtttgaaccaacagcctaangtgaaaagaaactgcacttaaaggnaaaggnggnaatggtgatgnactgggcttatgtgagaatgtgtatatgtncataacagagcgccagaatctttctctcagtnacagcctcaggcaaaccacgtgctggttggtgggtgctgcaggga

SEQ ID NO: 548844 - DNA, 267 bp, Homo sapiens
aaggtactataggagaacttatacaaatatacaataaatagactatcccctcaccaagtgggcaacggatacgatcagacacttcccaaaatgaagacatttatgcggccaacagacgcatgatacagtgcgggtcatcactggtcatcagcataaatgcaatctaatacacaatgagataccatctcatgccagttagaatggcgatcattaaaaagtcaggaatcaacaggtgctggagaggatgtggagaagtaggaatgcttt

SEQ ID NO: 548845 - DNA, 357 bp, Homo sapiens
gcgggcgatgtcatagtatgggtcatcccacttcaggtgtgtgacaagttccggggagctgcttttggagtcatctgaggaacacagcagggtcaggggacaagccaggggctggcaccatgctctgccccacagcatgctgtctggcccttcccccagtaaggcccatgctcccagcccaaacctgggactggtctgccccatcctgccctcctggcgtctcccttcagcagaaggagtgcttccccctctaaagcgcctgtagctgcctgagaccagacacaagcccacctgacttggggaggtcaggcatttaatccgagggccagttcttctcatcgatggaggcgagcttca

SEQ ID NO: 548846 - DNA, 316 bp, Homo sapiens
  misc_feature (14)..(14): n is a, c, g, or t
  misc_feature (168)..(169): n is a, c, g, or t
  misc_feature (278)..(278): n is a, c, g, or t
tatgtaagtcaganacttgtatctacataaagacaaaaacagcattagaggctaggcaggatggctcatgcctgtaatcccagcattttgggaggccgaggtgggaggatcacttgaggatgggaattggagaccagtctgggcagcagagcaaggcctcatctttannaaaataattagctgggcctggtggcatgcacctgtattcccagctaccgagaaggctgaagtgggaggatcacttgagcccaagaggttgaggctgaagttagctatgntcgtacactgcactccagttaggcaacagagcaagatc

SEQ ID NO: 548847 - DNA, 280 bp, Homo sapiens
gaaccccggtgcgggccctttccgcagcagcaacagcaacagcttatcaaaaaaaaaagcgagatacccgaaagtgcggttttaaaaaggatgtgtttcacccctccaaaagagaaagagctcatggagcgccttaagaagctctcagtgccaaccagtgatgaggaggatgaagtacccgccccaaaaccccgcgtggggaagaaaaccaagggtggtaatgtttttgcagccctgattcaggatcagagtgaggaagaggaggaggaagaaaaacatc

SEQ ID NO: 548848 - DNA, 598 bp, Homo sapiens
  misc_feature (149)..(149): n is a, c, g, or t
agcggaagcaccggaccaggcggaaggcgagcagtgccaatctacagcgaagaaagtctcgtttggtaaaagcgagaggggaaagcctgtagtcatgcagaagatgttgacagagtcacgagacttgtagctgctcgcggaaagccagntggcgctttgagcctggaccctgttcctggcgttctaccaaatctgccctgagagaaacagaggttcggcctcgcagaacctcctcagtcggactgtgtggcactttctcacggctaagagtagaccccccggtggcgtcacccagggggagttgaccccaccttttggcactggggaactgggccccagggactccggggagaacacccgtggtcgcgggcccacttcaggcaccctgagagaggaggagcggttttggccctgagccctggggccctatgggggattggcaatagtgcatcacggtgcgccatttgtgggcacagattcggccaattgggccccatggcgattccagtgtgtgcgctaggtttagggtttggccccgaccggcgaaccccccaaaagaccgcgcgaattgggaggaccaaggccacaaggcaacaga

SEQ ID NO: 548849 - DNA, 171 bp, Homo sapiens
  misc_feature (64)..(65): n is a, c, g, or t
cggccgctgaaaacactgtagtaataaattttatatgccaaaaaaaaaaaaaaaaaaaaaaaannaaccaatcgatatcagctatcgatactgacgactcagaggtgcgtacatgcactataagtgagtcgatacatcactagcatgatcacgagactgactagtacagct

SEQ ID NO: 548850 - DNA, 401 bp, Homo sapiens
  misc_feature (343)..(343): n is a, c, g, or t
tacagcgccttgttgctgctggcccccttgttggggccggctctgctgagggccatcattctggttcccatcaccggcagagggttgagattgctgtcctcccaaagctggaccctgacgctcctcatctatgaactgctcagagtctcctccatctgatattaccaagggaacgtcttcttggctgacatcttcatctaagtcctgagctgagctgaaggccagcagggccactgacagcagaatcagaagcatcttgcagaaggctctgttgtcactcccaactgtatgctctacctacagcgccttaacctacacgctttgtgactttgcctgaggaggnggtggaccttgttgctgctggcctccttgctgtggtggtccctgctgatgccatcatt

SEQ ID NO: 548851 - DNA, 120 bp, Homo sapiens
agacacgaagctgctactgttggaatggtgggccaggagtcatcccgagccattgtggacaggagggcacaagtctgccggagcagataacatggtggttgtgaggagagggacaggagg

SEQ ID NO: 548852 - DNA, 104 bp, Homo sapiens
ccgtacgttgggcccgtactggttctttatttcaaaaagacacttgtccaatattcagtatcaaaacagttgcactattgatttctctttctcccagtacggcg

SEQ ID NO: 548853 - DNA, 1030 bp, Homo sapiens
tctgctaccgtgactaaaatggaagcgttttgggggtcgcggcccgaactttgggcggggggtccggccccaggacagtttataccgctttccatccacttcccgattccttcagtggactccggcgttctgcacttttacagaggttccaatcacgcggaacccagaaaccccattggtgaccgggacctcagtcctcggcgtaaagtttcgagggcggagtggtgatgtgccgcagacttgcgtgggatctccatacgggcctcctttgagcctcgttatccgaaaacattcttcttcgcatttatgtgcgagttcaacaaccagctaccatgtgctgggtgcctctgtggcaggactatacgcggtgatttcccacgatattttgtgaacgcaagtttctgcggccaaattggctgacttgattgaaggacgcttctgtgggacagagtggacccacagattattagctcctataaacgcatatttcatctcattggcttgacacaggggccatttgttaacagtccggcgcttcggaaagattgaacccctttttgttggaaccacccagtgggtcattcgaaggccatcatggctagattggagaagcacgcttcccttcagggtatagtggtggcaccattggcttgggggtgtaacgccctattggaaacgccacgcttttcgcagtgggccccaaccgtgggtaaatggagcggcatactttggtgcttacacgcacctccgtgctatgcacaacaaaggtttctggaacacaaaggcgcgccacagggaggctttatagccccacagaacccggtaggggccccgagcaactttcttagatacagaaaccgctttgatcttttgcaaaagattgtcttggttacaataacgcggaaatattgccccgttttctttacaaagcgggtttatcaaaaattaggaccacgttgttccaccacgaaaacaacagttgtgtttgcaacacatcgagaggacccatgtgttctacaagaaagaacca

SEQ ID NO: 548854 - DNA, 150 bp, Homo sapiens
cacgcacaccccagtactagcttcacggacacgagcgctcatcggggatcggccagaaccaggtggcgctgaaccccgcagaacaccgtgtttgacgcgaagcggctgatcgggcgcaagttcggcgacccggtggtgcagtcggacatg

SEQ ID NO: 548855 - DNA, 678 bp, Homo sapiens
caaactcttatttcagcattaactcaaaattccatagtccaaagtctcatctgagacaaggcaagtcccttccacctatgagcctgtaaaatcaaaagcaagttagttattttctagatacacagggatacaggcattgggtaaatacactcgtttcaaatgggagaaattggccaaagcgaaagagctacaggccccatgcaagtccaaaacccagcaggcaaatcttaaagctccaaaatgacctcctttgactccatgtgtcacatctaggtgatgcaagaagtgggttcccagggtcttgggcagccccgcccctgtggctttgcagggtacagccccccttctggctgcattgagtgtctgcagcttttccaggcacacagtgcaagctgtcagtggatctaccattctggggtctggatgatggtggcccttttctcacagctctgcttggcagtaccccagtggggactctgtgtgggagctccaaccccatattttcctttgacactgccctagcagaggttatccctgagggcccccccctccccttccccccacaggaaaactttgcctggattttcaggcattttcatacatcttttgaaatgtaaggcggaggttcatgaacgttaaatctttgactttggtgcatttggagggcttaacaccacc

SEQ ID NO: 548856 - DNA, 352 bp, Homo sapiens
  misc_feature (190)..(190): n is a, c, g, or t
agcgagagaatgaagccctgcggtgcggccagggtgccagcctgaccgtggtgaagcagaacgccgacgtggccttgcagaacctccgggtggtcatgatcagtgcccagccctccctccagcaactgccttccccagcccagacaatgaatcctgccgccgaacacccttaaatccacagccgaatttntgaagttaaagacgaggaggaagactcttgaggacccctgggtgttctcagcatgaagctccgtgtataccctgaggtcaccaccgctcgatctaaatgtgcagttgtgtccttaaatatgcagtcttcacccagagcaaagtgttgatcgcaagagtcaaa

SEQ ID NO: 548857 - DNA, 729 bp, Homo sapiens
  misc_feature (627)..(627): n is a, c, g, or t
gcagtggggatgcagctgttggacaggtattgggggcaaggttggtagggaggacagaactgtcacttgctgttacaggcacaggtgattaaaaatgctaaatatgcaaatttaagcttggtcagtatatggaaaagttgaagggaaaatactggaatgcttcttcaaaggttaaaaaataaccgagtctttggggtaattgtgaccccacgtgctctctggccctcaagcatgtaacctcggggtctgaggcccaggacccaccccccttggcaccctccaaccgcatccctgctcagtacctggtgtgggtacaacaggcaaggaattggcacaacccaaaatgggccttttgctccctcttaataattgaagaaattcccacattttactcattctggtactggtgtgtggcctcaagattcttctagtattgcttctgatgaatgattcatggtctatacataaaagaagtaggcactgaagtattgctgaatttgcagtcactggtagtccggtatacagagctacttccacgtggtggttacgaatgaggccagtgtagatgatgactcatgttcctgctcgggtggctttgggccggcttggtgtccaaaatagggattngactttatgcatcagctggttatttcaagatctgggaactatttgggactttataccagtaaacattttatagtttagaacaaagcgaccataaaaacaaaa

SEQ ID NO: 548858 - DNA, 194 bp, Homo sapiens
ccagggtcgcacgcgtgagactttttccgccgcctccgccgcagacgccgccgcgattgcgcttacgtcgcctcctacctgctggctgccctaggggcaaactctcccccagcgccaaggacatcagagatctttgacagcgtggtatcgaggcggacgacgaccgctcaacaaggttatcagtagctgattgg

SEQ ID NO: 548859 - DNA, 1412 bp, Homo sapiens
  misc_feature (221)..(221): n is a, c, g, or t
  misc_feature (251)..(251): n is a, c, g, or t
  misc_feature (333)..(333): n is a, c, g, or t
gggagcctgcgagagtccggaaccgtgagtcgcagtcggcgagagatcccctgtgctgtgcgagagggtggcggtggccccgatctctgaaccctgacgccggggtgttgggccaatggtcgggaggagtcatgtcggacctgtgacctggcagtatcggagcaggctgtcggttcgcttgcgtatgcttcatcacatggtagatgcggaaggtcaacggngccatgttgacgctacatagtccatcacgnagagtcattggatacgaggacgagcagatggtgcagtagaggtgtgactcggccagtgtcttacagatgtgtcggtgatgantcctatgtgcacaaagttgctatgaccctcaacacgaagctgtttcatgaagtacgggatggccggacgatcccttgtagtatccaaatctacgcctcgtttcaatagggaggtacctttggttggacgcgctggcgtatcatactaggcgcgtcgtacaaaggggttcgcgtctcgttgcatgctaggcgatcgttgccgtgttcggcttactccgtggatctgcgatcaatccagcttgcatcccgtggtgcattaccattgtagtagttctgcgcatgtattcgacgtcatgcgtctacttgtggcgttcataccggagtagagattgccattgcggcagaagttatcgtggctccgtgtagagctggtgttgtgctgcatacttgagaccatgacgtatactttgtgaacgtaacgcttcagactctgtgctagggcgatgctattcgaattggccaaagatcttacttgcgtgccaacggtggggccattgtactcgcccttccattgcgagaaaccctggtgatcaggattccggacaatacgacccgaaaagccaagagggttgccctcaattgatgggggcccattggtgtgaaacctcccctctggggtcggaaccccatgaatgaaaacacaacagagcttgggtgggctgttgtaacccgccggagggacgccggggtaaacctattttggccacacgacacgatggtgggccccgattcaacagcaaacacatgaacacttggggcatcgaatactggcggggccccacccaaacgtggggacgggcacgggggatcaacaacaggggggcggcctaacaaaaacaaggggaggccccctgcgtgtgttggtgtgacggccccacacatcggttgtaacgctgttggaaaagttagtcggagcaacatgttgagaggagagagaaaattcacacagagagaaaacccagtaggcgggaggaccacgaaaacgagcttccccatcaacacagtggacagacgcgcaaacgaaaggagcacagcaccacagcatgagaataatgcgcgcaaaggatgaggaatatagaa

SEQ ID NO: 548860 - DNA, 429 bp, Homo sapiens
ctcccctggagcggttttctcgttaagggtgacagcctgcaaggtagccatccagcagcctgggaaggcagcctctggttaacaccagagacagacatttaggagcaggaggggtttgggcaggagctttatgctgaagaggttggctaaacatacatattcaacaggctacaggaggagctatgaatattcatgtaggtggttgcagtccatgcttattgaacaaacatgtgtggaacatatgatcccagccgggcatagtggctgacgcctgtaatcccagcacttggagaggctgagacaggcggatcacctgaggtcaggagttcgagaccagtctggccaacatggtgagaccccatctctactaaaactacaaaattaaccaggtgtggtgatgcatgccttttactcgggaggctgaagtgg

SEQ ID NO: 548861 - DNA, 610 bp, Homo sapiens
gcgcccttttttttttttgttggggagttattaattcttaattaggatccaggtttcaaacaaggtaaaaggcaggggcaagaggggttcaggtagggggatgatgagggaacaccagactgtggctagtggggccacgtgccagaagccaaaggggaacccgtgggcgtggaaggggtgtggagagggggtggacaaggggccagcctagaggagcagacggggctcagcggagtggtgtactcggacatagggaacctcgacatcctcgccgctctcgtcgttacagcacagctcaagcaccagcgcccgacgtggggcccagcgtttcgcttcgacacacggctcacaatctcgtgtcatcggctgatccaaccgttccttgagcctgggcagcgtggcatgaagaaggaatagagcatggacacgcccgtggggacagcagggggatctctaatttggcggcacggtcttaaaatcagtccgaggacctggttcggagggtcatctcctcaccattaggctgaacgcccttgtaacctcacaagcgatcccacaaggtccactctgggtatatacgtactgggtgacataggtgccggccacgcgg

SEQ ID NO: 548862 - DNA, 291 bp, Homo sapiens
  misc_feature (26)..(26): n is a, c, g, or t
tcaccataattaggaaacagactgtnttcttaatttgaaacacaacagtataaatactatagtaaagttgggtgcagtggatcacggctgtggtcccagcactttgggagaccgaggagggatggtcacttgagcccaggagtttgagaccagcctaggcaacatagagagaccttgtctcaacaaaaaaatttaaagttagccaggtgtggtggtttgcacctgtggtcccagctactcaggaggcttgggtgggaggatcgcttgagcttaggaggtcaaggctgcagt

SEQ ID NO: 548863 - DNA, 411 bp, Homo sapiens
cggctaccggctcgattctttgcctcagatgggcgactgttgcttttaatcattttaatataagaaagactgcagaaaatattccaattcaaagtgtatgtgaccatgaaaagggtgggttctttccaggagttctggtttgactgtgggaggccctgctggcttttgtgcctgttgctaaatgtgaacccacagaaagtgtcatcacagccacactgaaatgagttactctagacattgtcctgctgcagttacgaaagcactgactaaaccgtgaggaatctcagttcagcttatcccgtaatagtcactcgctgatattttgcctgaaataacccttgaatcatgtttgctggacagacaaagtccagactgaacagtggtctcagtaatacacaaagctcggcagga

SEQ ID NO: 548864 - DNA, 328 bp, Homo sapiens
ccccggacatggaatccagcattccatcatcacagggctcccaggcctgtgcacagtgcatcttagaggaagagccatgcctaaagtaccttcccatcaaagagcatggcttggtttcgtaaaaacctgtcttttgtcatactagattatcttcagaaacactgacccctggccctgagcactgaaagagcggttagagtgatgcggctggccacggcatcgaccactagcagtgagtgctgcgcccccaccacgcccccaccctgcgctctctgtggtggccagtctcagcctggagcatcagaggcctgactgggcgaatggaatt

SEQ ID NO: 548865 - DNA, 415 bp, Homo sapiens
tgagacctagcaggatcccggcaggagacacagacagatggaacagattgaagaaaaaaataattcaggtcaaaaaggatggaatataacttcgtgcttgggttattttcctatgttcgcatcgaaaacaagacatttcggtgcacatagttcatctttcctcttttttaccatttgtctggtggagaaaaaatactttttctataataaaatatgttatttcttggtttttaccgtaactttttcttcttttttgccgaatataattttgtaaactgtcacttcgcgggcaggtagcgatcgatgccatgtgggccccagctcacccgggtggaggctgtgagctgaaatcgaacccaggcaggagatggcgcgacggtggacgtgcaagggagggcacggtgcacaatacgag

SEQ ID NO: 548866 - DNA, 627 bp, Homo sapiens
tgtagaaagaatccaattgttaagattcaaccctgtatagtaattacagacagtaaattataagtagagtaagggtggctgaatagaagcagcaaacatgcttaaggcaatgcaaagcagtagctaaattctgatgataaggcaagagaaagaaaaaccaaaagtgtggaccaagaacttcatagcagtgtggggccatttgtgtatggagaactgactctgcatacttgtatggacattattacctttctcatcagttaatatttattgaactcttagggtgtgctgggcgctgttgtaattgcgggagatactaagaaatatttagcacagattctgccctaaagtttggttgacgtagaaagaaaatgtgtcaaaaaaaatacccaagttactacagcctatatgatattggaaagtactagaaaagttcagaggaaggaggaattatggaaagtcggattggtgtggaaaggaatcacaagcaagtacaacagatactgatagctttttatcaaaactatttcatcttatccctgggcccacaacttcccttgccatcttagatgtggccacgtgaatgagttctagctaatggaatattagccatgccctgtgccatttcca

SEQ ID NO: 548867 - DNA, 261 bp, Homo sapiens
cacgggtccctgcgcacgaccacagcatttcgactcgatgctgatccgccatccgggagacagaggcggcgctcggagtttggacagactcagctggcggcattccgggactgacggagagccgatgagtgcctcacaggagatggagtcgtacccgtggcgctgctcgggcctttgtaccgttcccgaggtgatgtcgcctcgttctggagaccgtccatcctataccgatgtcagaaggcatgacaggtgttggaagta

SEQ ID NO: 548868 - DNA, 821 bp, Homo sapiens
ggttcaaaccctctcagtacatggaattctttgggcgtctcaccgaggatgttgaggggaataattggcggtcgctttttcggtcttggaatatccaactccggctaaaggcgttgctggttgtgcccgccagaattttaaggggcaacaagtttgtccaagggaccctgtgcatttggctttagatcgccggcaataaccctggcggagcaatgtggccaatggttaaaccccgcactccgtccctcgggggagaacacgatcggaaaaagccgcggggaacccgagctctggaaaaagcgttaaaggctggcgagcattcttaaacaaagacgggggccttatgcccccagggtaaaatctagagcgacggggccgccccgggaacaatgaacgcgcagagtggggcccaaggtagagacagcgggcccgtagtgtatcactaaagtagaagggaccggtaaattgcgacagccggggtctttagcggctcccctatggatgatgagcatctttctcctgagcaccttccagtggtgtttagtatctatgcggttctaaaaagcaaagaagatggctgaagacacgctcctgaggacaagcagtctcaagactttcccaaatattttttaggcttctggcaaatgcaatggttcgggaatccgcagacaataatgcgcggcggggttttcggcacacaagatatgcatggcccctagcacccgtatcagggaggccgcgtcaaacacacccaaaattggttgtcaaaaagccgcccccttttaaccccaaaaaaaggattgcaccccgcaacaaaaaca

SEQ ID NO: 548869 - DNA, 448 bp, Homo sapiens
ctgggctcaagcagttctcccacctcagcactttgggaggctgaggcaagggatcacttgagggtcaggagtttgaaaccaggccggccagtatggcgaaaccccatctctactaaaaatacagaaaaattagttgggcgtggtggcacatgcctgtggtgtggtcccagcttcttgggaggctgaggcatgagaatcacttgaacctgggaagcagaggttatagtgagctgagattgcaccactgtactccagcctgggcaacagagcgagactggctcaatatatatgtttatttattgaagtgttgaacttctctgacattctgttaaaacgtctggatcaccctagaaacaaatggaggcgaacagttttgtgtagactatcagtggatttgtggacttccctgaaatgtatctttggatcgcaagttaaaacctcataatct

SEQ ID NO: 548870 - DNA, 480 bp, Homo sapiens
aggaagggcatagctcctggcccaggtctaggcagtgctgcttgcgttcgctcatcctcactttcctcctctaaccccaacaacatggaggctaggtcttgccctggaagcgtggaggcccggcccggggctggggtctatgtccagcagcgcaacagagtcgggcagactttctgcattgacaaatgtgactaagggtgccgcagcccttctgcacccagcacagtctgcccagcccagtcctgctcccccgggcactgcacaggctgtctgggggccagaccacccattgtccatccttgttgtccgtgagtccttggcctccaccaagcacgtgtggcattgtgtgcctgcttagtgactccgtggtttgtgaggagcagagtgtgtatgatttattgcctcagaagacatatacgtcttctgtgtaaacagatgcaagtaagacaacagtttgtcaacaataaaataagaaaaaag

SEQ ID NO: 548871 - DNA, 101 bp, Homo sapiens
gctggtggctgggtgcagtgtcacgcctgtaaagaccaaatatgatcataaaagatgctgcagttggctgggtgcagtggctcacgcctgtaatcccagca

SEQ ID NO: 548872 - DNA, 407 bp, Homo sapiens
aggcaggcaggtcacaagtctcagcacagtcctgccacctacttatttacttatttttagagacagggtctcactctgtcactgtggctagagtacagtggtgcaatcatagttcactgcagcctcaaactcttgggctcaagcaatcctcctgactgggcctcccaaagtgctgcaattacagatgtgaaccactacacctggccctgccatgtacttactatatgaccttgggacaagtcatttcctctctcttgagccttcctcatttcttttttttccagacagagtcttcctccgtcacccaggctggagtgcagaggcacaatctcagctcactgcaacttccacctcctgggttcaagcaattctcatgcctcagcctcccgagtagctggggttacagg

SEQ ID NO: 548873 - DNA, 492 bp, Homo sapiens
cggccccggctctagtggatccccgatgtagtcccaactggtcgtgactgggatgtgaggacgggcagaggtgtcttccacggtctcattgccttctgagatgagtgcccacacctgtaggctgaatgaatgggcgccccagataatggatcctagaccgttgcagctctatcctcctccacgggaaggagcagcccctggatgaggagctgaaagacgcctttcagaacgcctatttggagctgggggcctcggagaaggagtcctaggtttctgccatcatctttctgtcagatgaacaagtttccgtgaagggttccagtttgacacgtgacgatgtgaatttccctatcgataatctgtgctttgtagggctcatctccatgatggaccctccatgggcggccgttcctgatgccgtggggaaaagtgtcgaagtgctggaattaaggtcatcatggtcacaggagaccatccaatcacaggtaaagc

SEQ ID NO: 548874 - DNA, 202 bp, Homo sapiens
gggacccagcccatcccaggctgtgccctgatggaatgggttggaagcttctgccagtgccagtctgggatttccctggccgttttccctgtgtcctgcacagcctgtgaggatttttgtcaaagagtaaagaactcagaaggctttttagaattgtggtaaaatatgcacaacataaagtttatctttttaaaaaaaaaaa

SEQ ID NO: 548875 - DNA, 871 bp, Homo sapiens
  misc_feature (4)..(4): n is a, c, g, or t
  misc_feature (132)..(132): n is a, c, g, or t
  misc_feature (154)..(154): n is a, c, g, or t
  misc_feature (165)..(165): n is a, c, g, or t
  misc_feature (170)..(170): n is a, c, g, or t
  misc_feature (316)..(316): n is a, c, g, or t
  misc_feature (343)..(343): n is a, c, g, or t
  misc_feature (346)..(346): n is a, c, g, or t
  misc_feature (349)..(349): n is a, c, g, or t
  misc_feature (365)..(365): n is a, c, g, or t
  misc_feature (370)..(370): n is a, c, g, or t
  misc_feature (372)..(372): n is a, c, g, or t
  misc_feature (377)..(377): n is a, c, g, or t
  misc_feature (413)..(413): n is a, c, g, or t
  misc_feature (437)..(437): n is a, c, g, or t
  misc_feature (445)..(445): n is a, c, g, or t
  misc_feature (457)..(457): n is a, c, g, or t
  misc_feature (473)..(473): n is a, c, g, or t
  misc_feature (493)..(494): n is a, c, g, or t
  misc_feature (504)..(504): n is a, c, g, or t
  misc_feature (508)..(508): n is a, c, g, or t
  misc_feature (703)..(703): n is a, c, g, or t
  misc_feature (786)..(786): n is a, c, g, or t
  misc_feature (811)..(811): n is a, c, g, or t
gcanacaagtgtgaagaacttctggaaaaaacagtgaaaaactgcttggccctggctgatgataagaagctgaaatccattgcattcccatccatcggcagcggcaggaacggttttccaaagcagacagcngctcagctgattctgaaggccntctccagttantcgtntctacaatgtcctcttccatcaaaacggtgtacttcgtgctttttgacagcgagagaataggcatctatgtgcaggaaatggccaagctggacgccaactaggctgagcaatgacagaaccggctgcaccatgtaccccaccttcngtttaaaagaaaaaaaaaatccccttnacnccnactgggaggtgggacncctgngnttttnagttttgctcatctagggaaaataaggctttggttnccagtttaattgtttttgaccttntaaaatgnttttatgttagnactgatagttggcatnactgttgttaagcactgtgnnccagaccgtntctnacttagtgtaacctaggagattttatagttttattttaatgaaaccctgattgacgcacagcagtggggagaacagcgtcttttacctgtcaccgaagccaggaagccccgtttgtaagcgtgtgttgtggtgctttattgtacatcctccagtggcgttctttttactctaatgttcttttggtttcccccctncagaagaatcatgaatttgcaacagacctaatttttggttactttttgtcttattgatggatttgaaaatgaaagatttaatnaaggcaaagcagaatatgttgacantaaattatatttgcaatttggaatttgtgtgagttgatttagaaaaatgttaaacccgtt

SEQ ID NO: 548876 - DNA, 553 bp, Homo sapiens
ggcaggcttcagaaaggtgtagcagctatctatcgcctaacgacaaatcttcaatggaaccttagtgaagctcaacaaggctatcgattaacatagctgaggatagtagagccataataattgcatgggggtaccccaatctgaagtcagtaaatagaactaaatctacaagcgtggttatggcaaaatcaataagaagcgaatagctaagacagataacgctatagatagctcgatctactaggtacatacggcatacatactagcatggaggatatgattcatgagatctatactgtaggaaaacgcttcaaagaggcaaataactatcctgtggcccttcaaatagtactactccacgaggtggaatgaagacaataccaaccatatagtagaaggtggagatagctagacaacagggaggaccagatcaacaggctaattagaagaatgaactaaggagtctacccaagacaatattactaagctggaaggataaaaaaacagaaacagaaccacaattagaaaaacaacaaaaaacaaaaaaaataaa

SEQ ID NO: 548877 - DNA, 361 bp, Homo sapiens
aatgaggatatagatcacaccgggcatcgatcattactggggggagacatgtaacagcctctagctattagagaatatatactacttaatgagtcagctatagtcccccgtacagcatgctatcaatgggattctttattaaagcaaacagccgtacatataaatggcagcacagtatagctctactctaggtacttttcagagagtataatatttaattcatggttatccaatataaacaaaaactcaactaaggaaatattggtgagtacatattttctgaaagatatgaaatcttatatattgaggataagagtgatataaaatctttttctggattaaaccagttgatctgagagca

SEQ ID NO: 548878 - DNA, 262 bp, Homo sapiens
ctctcaggtatcagcacccaagtagttgggattacaggcgcctgccaccacacctggctaattttgtatttttggtagagatggggtttctccatgttggtcaggctggtctcaaactcccgacctcaagtgatctgcccgccttggcctcccaaagtgctgggattacaggcgtgagccaccgcacccggcagagttttataatgaaaaattaactaatattctagtatgaagtgaggaggatattgaaccggatagcttg

SEQ ID NO: 548879 - DNA, 466 bp, Homo sapiens
tgagaagggagtatggcagggctgggatgcggctactgagagtgggagagtgggagacacaggaaggaagatggagattggaagtgagcaaatgtgaaaaattcctctttgaacctggcagatgcagttagggtgtgcagtgctgtttggagattgttacagggagtgtgtgggttgacacatgtgcatcaggcccaggaagggcacaggggattagcactacagtagtcacatgggttatcagggtatgccagggggataacccgtcccggctatctgtgggtttccttgagagtagaggggccccttttgtgctggtgggagttagaaggagcaacacacaggtgtggtgggttggccttggacccctctgtggtgggaagcaggggtgcccggcagggttggtggagttccctgccagacaacagaccacacagtcctccaaaaataaacattttatatagac

SEQ ID NO: 548880 - DNA, 315 bp, Homo sapiens
tacaggatctttacagcatcctgaacagtgaggtgtaagatgcagtgagctgaaacctcaccactgcattccagcctgggccagaagagtgaaactccatcttggctgggcacggtggttcacgcctgtaatcccagcactttgggaggccgaggtgggcagatcatgaggtcaggagatcgagaacatcctggctaacatgatgaaaccccgtctctactaaaaatacaaaaattagctgggggtggtggttgggcgcctgtagtcccagcctgctcgggaggctgaggcaggagaatggcgtggacccgggag

SEQ ID NO: 548881 - DNA, 294 bp, Homo sapiens
aaagatagaaattttctctttataaatgcccccaccggtttctctttagatccggaatttttgacctcaaattcttaggagaaaccaatttatgcgcgcattatcctgcacctctttccgtgtattattgtccaaagcgaaccaccttgaaaaaaaggttggaagaaaaggaaattaaggagaggaattataaagaaaggaatttatgttccacaggtgaattccttttttttttttttataattctgggaacttataaattttttaaaaccacacctgttttccccctggtgc

SEQ ID NO: 548882 - DNA, 112 bp, Homo sapiens
gtctagaggatccctggagagcggaggccatgggagagcagaggcaagaggagggcgcagagccgccagcaacgcgcttgtcatggatccgtgtgggtgcaacattggtccc

SEQ ID NO: 548883 - DNA, 1590 bp, Homo sapiens
taaagaaccctctatcaatagagggagactatacagaaaatagtcaaaccactattctacaaaaggcccgtatcaggcgggcgggcttcgaagccaaagtgattgttggggatgtgtaaaggtggaaattattagttgggcgggatcgaagcagaatagtggagggaaatgtggacgccatataatggactgtagaatgtcctggggaacgccgtggtggcttcacaaacaaagtggtgtgacccgtataaatcgccgcccggaacaagtgggtgaaggggagacacctcgaaagaatacctctgtggaggctgtgctagggacgggctacaaatagaagcaacccgagttcaacacactgtggtacacatacagccgagagtggctgtgtgaaatatatcactgtgtgagctatcacggagggtggtgtcctctctatattatacacacccatagtggggtgaggcccccgaggggggaaatatggaaatacctccctgtgaagtgccagaagatacaaatcaggggagtgggtggtccacaggaggagtggtgggggaacactctcacaagggggacaaattaatagcgcgcgggcggagacagttgccccgcgggatgcgggaggagacccaaggaggcccccctcccaaaaagtggagaggggggaaaagaggggacataagcgcgcgacggcagggtggacacaacacagggcctcacagaaaacacactcccccgggagagaaaaagaaaacaacaacaccctctcatgagacgcgacaacaacctcaaccaccacggggaatcaaactcccccgggaatatcacgacacgggggcccattattcgggcggcccccacgtgcgtggtgcgtgatagcacgcgaggcagccccatcgggcgaccactctggtgcaatatccccaccgagtgggttaaacaactcggggcgccccaaacaccatgtgggcacacacaaggcgcacacagaacggtggctacggcgcaaaagaacagcgcccccaaaacatccaggagcgacaacgagtgccacactaggaccacgtggaacacagaggacaccacccccacagttgaccaaacagcccccggcccacggacacacaaccacgagacaagcgcgccagaaaaaaaggaccccccagtaacaaaaaagagccacaagagaagagacggggagagcacaacctaataaccacaacgacggcacaaacagcccccacggacacgcgcgtgagaacaaagagtcggtaagaggaacaaccacaccacaaaagaagacgtgagggaaagacacccccaaacgacagtcacagaaacgaaaccacagatgacccacataccctaaataatcaccccccaaaaaatatggagtccacccccgcaagcacacacacacacatgcggtgaacacaacaaacacaaaaactacaacacacacaatacaacccaccaacaaacgaccacgcaatacagagagcacagacaacgacgacaacactaactaacaatagcaaccacataaaccacaaagacacaaccggaaacacgaccgacccacaagca

SEQ ID NO: 548884 - DNA, 287 bp, Homo sapiens
taatctacgaggactcccttaaaagctaccgcagtgaccatggagcgcggttggtctacaagacgctacttcccctatcatagacgcgcttatcacctttcatgctcccgccctcataatcatttaccttctgtgcttcctagtcctgtatgcccttttcctaacaagtcacaacaaacataactcatactaacatctcagacgctcaggaacatcagaaccgtctgaactatcctgcccgccatcatcctagtcctcatcgccctcccatccctaacgcatccttt

SEQ ID NO: 548885 - DNA, 102 bp, Homo sapiens
  misc_feature (55)..(55): n is a, c, g, or t
ttctgcacatcaccggcaggtggcagccgagtacagtggtatgacggatcatggncccagcacccgtccacagactacgtgcctgtctcctgtgactgccct

SEQ ID NO: 548886 - DNA, 266 bp, Homo sapiens
caactccacttatcctaggtcatcactcattccatggtatgcttactttatgccaggcgacggtgctggtcactgatggtacacaaagatgaaaggatagagtcctttactttgaggtgctcacagcccggtgacgaagcccgatgtcacacgggaaggaaacatgaggaacacgagcacctcctaccgtctctcaaacaagacgctaaacttcccatgacggaacagtgcggacgccacaacctgacagacgacgggggcacagc

SEQ ID NO: 548887 - DNA, 1552 bp, Homo sapiens
  misc_feature (252)..(252): n is a, c, g, or t
  misc_feature (290)..(290): n is a, c, g, or t
cgcgcttgcaagcttagctccgtgggattgcgcgcaagtagggccagaatggagatcctgtacctacatggtcgactgcctctcgtcatgcagtcctagaggtggctctggtgcgacgtacagatgactcaacgtgcgattccgacgacagcatccgtgagttctcgagctggatcgtgtcccctgacaccctatcactgtcccgacgtgtaccgcatgaaatctatcatgcgacggcaacgcaacatatanttgcaccgcgtgataaggtagcgtcacacatatttctntatgcccggaaacataagggggatacattagcataagtgtttcccatgcagtcgcgtgggtacgttagacgcattcgcgttttaagcgcgtaccgtgacatagtagtttggggtgtatgcaaacgacggcggtcgaaacgctcacattgtctgccgcgggcagtacccacaacactttgttcttaagctccccaaaggcgttctgggggcacaccatgttctgtgggggaggaagcatgtccatcgcgattaaccatacacgctcgtgagtgaagggaattcaacttgtgggccccacaggtccgtcgcagggcagcatccacttttccccttcgggcacatgacatatgaccatggcgtacggcgcgggtaagctaggcttgggggagttacttgggctcgaggttgccggtatcaatctaatccacaacggcctgcccttatccgaaggccaagcaccaaggggtaattacccggcccaaattggagggggaccacgattcgcaccaagtttctcggcttatcgtagggccccatccttagcacaatgaccacttaccccgttggaaaaggccatggttaccctcacaatttttgccacccctgcaaaaacggaacccgggaaccatctcaactatactccttgatgcgtctgggagttggagactggtccgcagttgaaaattccctgcaggtcgggagatttgctcgtggcccattgcgcaccttggtacaaagcgggtttttgccccctcaggtgggctcgcaatgaccccgagccggaaggtagactcccaggcgggggatacatcaaaaatctcaaagcaagacatttacaaaagacccatgaggagcccacaagcaggagcggggggagcactcgggccctttccaatgaggccacagggaggtggacaacatcaccctgcagcgcgggagacacgacaatatccgaccaccagaagcgggggcgcgtaaacccacgcgaaagggggggggccccaggtggagtcaaccccgcgtggaccacaggcgcggctagaaaacaaaggggaggcgaatgcagcgagaggaacagcgggccacaacacacaagcagagcggtggcacaaaacagagagaatacctactagcaaaacgcgtgagagggccctccaagcagagggaggctctcacccacgactcatcagccagaaccacgaaaaagaagccccaccaagaacacgacgccgcaacagcagaggagcgccagcaaacaccag

SEQ ID NO: 548888 - DNA, 210 bp, Homo sapiens
  misc_feature (112)..(112): n is a, c, g, or t
  misc_feature (117)..(117): n is a, c, g, or t
  misc_feature (133)..(133): n is a, c, g, or t
  misc_feature (141)..(141): n is a, c, g, or t
  misc_feature (143)..(143): n is a, c, g, or t
ctcacgtaacggtcagagagggaggtcagcttctccaggtcagcacgcagggcgtggaatccactcaggagggtgacgtccgcgatggccatgccagacagccccaccttgncgttncgccagatgcacacgntgtagtgnancctggactcctgctcctgcactaccttggcgctaacttctgcggcggttccgtgactctggtaagac

SEQ ID NO: 548889 - DNA, 156 bp, Homo sapiens
gtgtcttgaagcccagaaccgatgttcttgtagtaccgggggagcttctcctttgcagtttctcccagcaggaccctcttcttgtttggaacgatggtcggctgctattggtaggcacgctcagtctgaatttcggcatcttcccagtttgccaga

SEQ ID NO: 548890 - DNA, 152 bp, Homo sapiens
  misc_feature (82)..(82): n is a, c, g, or t
  misc_feature (90)..(90): n is a, c, g, or t
attccttcaaggtttactgcaacttcacagccggggggtcgacatgcgtcttccctgacaagaagtccgaaggagtaaaatngcccgctngaccaaagagcagccttccacctggtatagtcagtacaagtgggggtccctgctctcctatg

SEQ ID NO: 548891 - DNA, 130 bp, Homo sapiens
  misc_feature (83)..(83): n is a, c, g, or t
  misc_feature (101)..(101): n is a, c, g, or t
  misc_feature (118)..(118): n is a, c, g, or t
aacaggcagaggcactggtgtcaggcatcagcagcttctcctcagagtccaggtctgccgctgccttcgtgcccacgtcttantccctgcgccgggacaanaatgcctggctcctgangctgcttttgac

SEQ ID NO: 548892 - DNA, 790 bp, Homo sapiens
  misc_feature (42)..(42): n is a, c, g, or t
  misc_feature (73)..(73): n is a, c, g, or t
  misc_feature (112)..(112): n is a, c, g, or t
  misc_feature (136)..(136): n is a, c, g, or t
  misc_feature (208)..(208): n is a, c, g, or t
  misc_feature (289)..(289): n is a, c, g, or t
  misc_feature (304)..(305): n is a, c, g, or t
  misc_feature (308)..(308): n is a, c, g, or t
  misc_feature (312)..(312): n is a, c, g, or t
  misc_feature (320)..(320): n is a, c, g, or t
  misc_feature (329)..(329): n is a, c, g, or t
  misc_feature (348)..(348): n is a, c, g, or t
  misc_feature (493)..(493): n is a, c, g, or t
  misc_feature (495)..(495): n is a, c, g, or t
  misc_feature (668)..(668): n is a, c, g, or t
  misc_feature (681)..(681): n is a, c, g, or t
  misc_feature (705)..(705): n is a, c, g, or t
  misc_feature (744)..(744): n is a, c, g, or t
aaaaaaatataacattgtataaaacaaaaaaaatattttttnttccaatattaaaaaaaaaaaaacatttaanaaacattttaaagcacaactcttctatataatcagtttnatgatctgaattaaaaaataccgntggataatcatgttcttgatacacatttcctttttttttgaaaagaagtctcgctgttgcccaggctggaanacaatagcacgatcttaactcactacaacctcagcctcccgggttaaagagaaaatcatgcctaagcctaccaaatcactnagatatacaaggagnnacnacanacctatgnaagactatnttttttatgatttaattanagataggatatcaccatgttggtcaggatggcttgaagcacaaatcatataggtacattagaggaaattgcttcctaaccacaataaacactgtgtacaggtttttaaaatgtccctagatacacattaattttttgaagtcagncnggccaaacttgcaagaaccaattatatactagaaccaataaacattaagagctcaaactaaaaaaatgataaaaagaaaaatactcaggttctacaaacgtcccataatttgtctttaaataggcagaaacaatttaaaaaaaaagatggaactgtctaaaaggtctacagcnaccttagcaagtnaatataaaaacaaaaagttgatanactataaaataagatgcttcggagcagctacaaaaaccnttataaatacagccatttagaaaggaagatcctggataagaaataa

SEQ ID NO: 548893 - DNA, 128 bp, Homo sapiens
gcaggctcccccgttactggcatttcctgcagaatggaagcagagctgaggctgggtaaagttccttagcctgaatgattttggccttgcaaagggatctagtgatagcagttccaagacacgtccag

SEQ ID NO: 548894 - DNA, 199 bp, Homo sapiens
ggcgccgtgtagatctagaggatccctcatttcctcataggtagagagccaccctctcatccgtagggtggcatttgatgttcagccgcaatgcgttggacttgctgtcagccggcaggtcacgagatgaaggctccattacaagttgttctctagaaacagctaggatccctatggagtgtattggctcccaagaatc

SEQ ID NO: 548895 - DNA, 415 bp, Homo sapiens
  misc_feature (34)..(34): n is a, c, g, or t
  misc_feature (42)..(42): n is a, c, g, or t
  misc_feature (45)..(45): n is a, c, g, or t
  misc_feature (53)..(53): n is a, c, g, or t
  misc_feature (86)..(86): n is a, c, g, or t
agcttgcccagggcagtgacttctggtccacttntgtccctnggntgtgtccntaagacccagggaccctggaaggttcacctgtnggtgtcacacggttccttcttcacacagcaggaacagaggtacagagaatggcgtccaggcctccttaaggactctcaatccatgagacaggaagccccacagggaagcagtggccccccgccccctatctcctcacatacagcactctgtaccttctgctcatttttctgtaaacctaaaactgctctaaacaatgaagtccgccacgcagaaactgcacacggatgttgagagcagctttactcataactgccaacactcagaagcaaccgagatgttctccaacagctgaataaataaataaactgtgatacacctaaaaaaaaaa

SEQ ID NO: 548896 - DNA, 385 bp, Homo sapiens
tgtcagaagagcgggaggaaagagctccggcggacagggctcccaggcccctccaggacgaggttggaggaccaagcgcagaagcaggaacagaggtacagagaatggcgtccaggcctccttaaggactctcaatccatgagacaggaagccccacagggaagcagtggccccccgccccctatctcctcacatacagcactctgtaccttctgctcatttttctgtaaacctaaaactgctctaaacaatgaagtccgccacgcagaaactgcacacggatgttgagagcagctttactcataactgccaacactcagaagcaaccgagatgttctccaacagctgaataaataaataaactgtgatacacctaaaaaaaaaa

SEQ ID NO: 548897 - DNA, 1031 bp, Homo sapiens
gtactgcttcgaggttggctgtcatggctaagctgctggggagccgcaagaggcgcctggcgtaatcttgacagtgtgagacgagttcctagcttacgggctttgactaccgagtcctgaatctcgatggtcctgaagaagttctccacaagtctggcagacacgggacagctacgcgacggctgctccggtagtccgagataagcctgggcgggatgcccctcggccacgccgcgcgtaacacggccgtgcctcatggagcacaaaaggacccagcgtctctcggctcgaacggacagaggacccccgagcttcctacgaagtaccctgcagggacgaatgacccagagcccgtgctatcacttatcagccgtactcggaacagactctgcagcgcaggacacaggggccccggtaccactgccctgcccagactgtgctgcgcaggcacgcccagctgacgtggggcgcgcatgcgacgccggagccgcaccgccacaaccccaccgcggcgcaccagaagccccccccaaaaagccccattaacacgcgccgccagcactgacactccctcgtcccccctggtcgacaccgtctcgcccaatgcctacgaatcacacaatgcgtccaaggcagaggtccaagccaaacaagccactgcggccatcccagcatcccaacaaggcttgctaacccactgcaaacgctgggataccatcgggccgatcccccagacgccagcacttgctgcgcccaaccaaccaccgacaggtatcaccccgcacaacaaggctgagctgagcggccagcacaatactcccactgcgcctcagcgggcaccggtctgcttgcgcctccccagctgtcatctgggctcaccccccttcccttgccctcccggcgcaccctcccttggccttgtcctccccagcaaaccccttgctgtctttggcgccccggtggtggctccaacgcgaccatgcacgcgagtgcgcgtgccagttcccgccccgctcccctgcgcacccccg

SEQ ID NO: 548898 - DNA, 498 bp, Homo sapiens
acagccaaacgcaaagtattaggcaaggctgctgagaactgacagaatggcagatcaagggtggaactgagatgatccaaaatatcataggcatcatgagaatgttaatggaagaatttattatctgagcatcctctgtaatgtcccttccaaatgactctgatctatatagttttcacaggccaggatctcagtggcacccgtatgttctgttcttgctttgtgatgagtctacataattaaagaggaagtccttcctcaggctctgataaaaatgcatcttcttgtagccttcacaaactttcccgtattcacagtgtccccaaattactgcaaaacaagccttataggacttccaaaagctggctcttcagctaaataaagaagagactggaactcgtagtcatgggcttaccttctgacacagactttcatatctttccagaaagatagaatgccagtctttcattaatctccatatccatagtaatcattagg

SEQ ID NO: 548899 - DNA, 446 bp, Homo sapiens
ctaatctactccctaaaaggagtctagttcattactgagtttatggcttccctacatttccctgtttctgacctcaggtgatcaacccgcctcccaaagttctgggtttacaggtgtgagccactgtggccagcctgtttcttttcttatacaaacaaacctataatggtaaggtttaatttatgaattaggcacagtgaaagattaacaacaacagactaataataaaatagaacaattacaacaatatactgtagtaaaagttatgtgaatgtaatgtgctctctctctctttcatgtgtgtgtctcactctctctcttgaaatatcttagtattttcagccatagttgaccagtgataacggaaaccacatgttgtaggctgttcttcattgctgcaaagaaataccagagactgggcaacaagagcaaatgtccatctcaaa

SEQ ID NO: 548900 - DNA, 226 bp, Homo sapiens
  misc_feature (142)..(142): n is a, c, g, or t
tgatctaccggatcttatgttacggtacggcacgcagatgtgtatctcagtcttcgactacaccacagatcatggcaacactaggtccttaaccactgagcgaggcagggatcaaacctgcaacctcctggttcccagtcgnattcacttccgctgcgcaatgtcaggaactcctaaaaaaatggttgtggtatctctcttcttttcccttggtccataacatatt

SEQ ID NO: 548901 - DNA, 636 bp, Homo sapiens
ttgggtctgtgcctccctccctgtttgggcgcaacctctgggccgacgacaggggccgcccccgggtgtgcgtattccgccatgtcgcgccctgaggtggccatcgcccccctgctgagatgcccccttggtcgcgcgcttctgggcccgaatcaggttcgtggtgggcgtcgcagcatgagggcacttgccctgttggtgcgtggaatcgccggcgggggatgcatcccccggtgggctctcacaagagtccttagcacctcatgtacaggggtgttgaatctgcgcgccacgtgctcgcttgtccagcttgatcacataagtgtgccgagactgctagcgcggatcccacaaggcgggtcccttttccctcgtagcttcatggcggacgcagtcgtataatatgtctgtcctggggtcctccatagcccccctctggtggtcgccaggcacaccgccccgctgtctccctttgttgatccgcccgggggccccaagaccttcccccttaacgcgccgggtcgatcgtgcgccacgtttccccgtggcgcccgcaccgtccgtggaggtcgtactagtggccgccccgccccggggggggaaagacccggcctctagggcttgtccaaaaaaaca

SEQ ID NO: 548902 - DNA, 271 bp, Homo sapiens
  misc_feature (113)..(113): n is a, c, g, or t
tagacgacttcatgagaggtatataatagctcagttcagaagagctttccttttgatagagtggagcagcagagccagagaaataatgttacaactggctttcctcaagactntgctatggagattcaaacttgaccttccctgccaggttctgctttgaaggcttacttataactacagacgtcgctgatattaaaagcagtttatttgtcgtctaattagatgtttatatttttattcttctcttcaggacttaattatgctagtttaa

SEQ ID NO: 548903 - DNA, 1068 bp, Homo sapiens
  misc_feature (849)..(849): n is a, c, g, or t
cgcgcggaccgaggtgcgtcttgaagcactacgtgtcccactcgttatccggggttcccccgtggtgggacagtgattcaggtcagtggcgccgagagtcgagggcttccatccaggtaaagtcgccgaggcctgcagtggggcattcccacacgcgcgggtcggtgagacgcgttgactcctacctcagttttacccgtcctatagtgagccgtgtaccttcggcaaacgctttcctgaaaccacgggggaagtggcgagagggcgcggggatgcgttggcgattgtgcggggtaaactcagagctcagtcgtgcggtgggcgagaggcgtcgtggtcagggctcataggaggggggcgcagcccgtgggacccccagggtgtctggccgattggggaggacacgggggggagcccgagtgcgaagcggacttcgaaccccattcgggagactacgaggagatcaaactttgcaacaagtcctcagtggttgaagtgggtaaccgttgcgcacttccagggttgaccccaatcttgtaaatcttgggtgagcccatcaggccttcacttcacgaatgggcgtccaatgggcatggggtcccttgggagcagcccttgggcaggtgggtactgctaagtcaacctgtgctaatgaaagtctcgtcgagcgaagatccattcgggactttgggccctttgtggtcccaagaaaattaccagcccgagacgcccaagccaagtttggtcaccactcagaggtttggtgcaacacaaacgattaagggcccaacgattcggtgccgggtaatcctagtccttcagtgggagaagacctttgggcactaggtncggggcccctatcttctggctatattccatttggtctcgggaattcacatttctctggagaagccccccaaggggcttttgggttatccatagaaaccatgttgcccgaaagaggattagagaggaagtatctattggaatgaaaacttattaagtccagtgggccaaggaacaggccgcgatggggatctcaaacccgctctggggaatattccccag

SEQ ID NO: 548904 - DNA, 201 bp, Homo sapiens
gagctgagagatagaccgcatacgtgagatgtagctcagcagactgtatccaaagactataagtaaacggagtcgagttttaacctctaatgcagtgtggatggagaattcaaaactgacagagtttggaaatttgccacccatcagaggcagtgaacattttcaagtcggactccttgagctccatgggatacctgagct

SEQ ID NO: 548905 - DNA, 380 bp, Homo sapiens
gagattagcagcagaaaggccattctctcaaatctcacttactccacacctgataagggggagagtttgggttaaagaatacgcaagtagatgttcctattgtctggctgcaatgaggagaacagttacctttaatccagggacgtggccatcctgagagggcctggctgggtgttacgggaaataaataccctggcctcacaatgttgcttccctttagtttcttccgccaaaccgggtctccttgttgaacaaagccaactggagccaatggcaaggaggattgttcttgttgatgttttaattttagacccagatcacattagaaaagaataaaacctatatctaacagggtaaatagaacataagagtccgagtta

SEQ ID NO: 548906 - DNA, 1005 bp, Homo sapiens
gcaatctttgtgtcgtcagcacagccgcagccgcatagtctccagcacaacatgcgtcaaagcgtgaatggatccgagcagctcccacgtgattcagtgtcgctattgtcgtcgcctgcgtcatcatgtatgctcttaactcaggtcatcagtgagatattgtagccattactgacctctctaaagatctcgactacatggtcgacatggtaaccatcattatcgcatgtccatccatactcgtgcagaacattccattggccatcgccatacaggttaggacgatccgtgtgaagcttagtcagatacacatgtgcaaatccatcatctacccaatttatccatacggaagtcgagtatgcgctcaccaaaatagcgtaagtagaggctgatgcattaacactgagttacgtcgttgataatcctattgggctgtcttacatcaatcatggcaataaagtcgtagcatcaattggcagcggggagttccatagaaggtcatacatactctggtcccctcattctggctgatgaacccccctgcttcgtgcaatgggtagtgaacccatagaaaagtctttagacatctgcattcaagacgataccacccagctattagggcttctgagaaccagatagacatgtttcaggaacgtcctggaaccaaggatcatctctatgaaccaaattataggtaatccgtggggtatgcttacgtggacacatgagttccgatgatcatgtggtagccaagccaaaagatcgtggctggcgcctctcggagataactgtggcgtgaagggctgggaaattgctgcagaaaattatcctataagctcttactgtgctgactgccctcgcttaaggcaacaagtcatccctgaactgacggggcagtcaatgggattggctaacgggttcccaataccaactgtattgatgactgaactgcggttgaagaacggcatatatgactccacgtgtagcgttataggccccagaact

SEQ ID NO: 548907 - DNA, 1396 bp, Homo sapiens
tccaaaacgggtcaaacttttttaaaccaagtgatttttcacaaaccaaattgtgtgggaaaaacacaccttctcccagacaataaagaaaatctcctctattaaagggtgcattttgtgcctgtgcaaccatctcttcttctccccatgtgtcgtggccctgttgtggtctcagggatttgagagggcacgtgttctccggaggggagcgccctctcgaggggcccccccttgaacccgtgggaagaagaggggaggcttgtgaaacgccccccgtgtggtgcgctccccgagggcttcactgtggaatataccctctctctcttcaccctgtgcccttctctcctctctgtggggctctcccagggaggtgtgcccctgtgccgctgtgacctcttcactgctgtggcagggtgtgtgatctctgtgggagacacccggggcgcttgccacgtgtcgcttgcgcgcgagtgtgtgtggagagagacagcgttggggcgggagagcgggtgagaacactgtgaaacaaccacccaggagcccccccttataggcgagcaaacacacacgcagcacgcacacgcagacagacacgcgcagcgcaagagaaaacaggagacacctcacaccgccgaagctaacaccccaagaatacgcgcccgcgtcgaccacacggagacacaccccatcaaaacttaggggggcgcccctgtcggccacattttgggcgcccctttccccacaacttctttacaaagattatgcgccccattaacacaaagagatgtagcgcactacagacctctctacatatatcccaggcgacatatttgtgcccccaagaaatgagtaacatatacccccatcactaaaaaaagtagggggcgcctctgaagcgcaaccacagcggcgcgaaacaggccccccccaaacccccccagagaggctactccaagaaaagcggcccaccacacgaatcgcccggtgctgtgccccaccgcgctcccccccacccaccacggaaagacgatgggcggaacacatcctacacaaaacagcaagcgcggcgacccaaacaccagcatcacaccaacaagcgacacaccccaacaaagggcacaagccaccactgaggggtcgaccaaacaacgcgtggagacaaatccatcaagcagaaaaaaacaccctgccaagttgtaaatcaacccacgccaacaggacacacggtgcgtctaaacccccagagacaccgcgcccccccagcacagcgacagcggaggcacaaaagcgggcgccccaacaagataacacaccactggacgtgcaaacgcagccggcagcgaataggcaacaagtccccagcacaccacgaccagaccacggacgaaaaaccaca

SEQ ID NO: 548908 - DNA, 791 bp, Homo sapiens
tcaaaccacgcccctggggcaactaaagacatctgagaaaatgtgacacctctcagggtgtgaggaactacagatgtccccataggcttggactccagagtcctcgtggatttagtagtggtgggatccagtcagccgtttctgaaaaaggctggagaatcgggaagggagaaggctacgccgatcatggaatatgccatgatggtaatccatgggcgccgacagcaaggagacgccggtggtcaccatcgacacacagactggcaggatcgaggacatcccatgaagagactagatagaggagacacgacaatcaactgatggactacaatcctcaaatcacaacacagagatcaatcgacacagagcatgcaaagacagcccaaaagaccaaaagggaactcaccatggtatcaagactcagcctggaagatgatggagaatactccccatacatgaggagcctcacgaagccagagcagcagagaggctggagaaggatgtcaacactcacagggtgagcaccaagacacctttccgagaagcaaggatgcagacaagacagtgacccctgaagacggtggagaaagagagggaccaccgaagaaacacacacggaaacaagaaaaacaaaatacccatggcagggcaagccaccgggaacacccccaaggggagggtggcacaggatgcagaccggatagaaacggtggagaacaaccacaggaagccgatatagtacatgagaaagcaggggaactcgctcagagacaatggacactgagaggcaa

SEQ ID NO: 548909 - DNA, 768 bp, Homo sapiens
  misc_feature (192)..(192): n is a, c, g, or t
  misc_feature (661)..(661): n is a, c, g, or t
tgaaacggagtctccctctgtcgcccaggcttggagtgcagtggcgcgatctccggctcactgcagcctccgccctcccgggttcgggcgattctcctgcctcggcctccggagtatctgggactacagttgcttttcaccacgtctcggctggttttggtatttttcggtagagacgggttcactcatggntgcgccaggagtggctctatctcttgacctcgtgattccgccccactcggcctcccaatattgctgggatttgcaggcttgagccaccgcacccagcctacaataattttcttaaactttaccttttatttaaagtcctagttccccggctttgcatagtcccctatttgaaactataactgttctctgtgtacgtgattgataaataaacccctatttagccttagaagaaaaaaccttgcacgatatacgcgtgtgtaaatgggccttagtctggaacgcaaaaacacaacacatttcggcccttcttctagcgcaccccgtgtaggcgctttttcactttgccccctgtcaccttctgtcttcacattgtaggggttctgagtggtccctgtaaatttcagggcttcttggcccagtgcctccgtgttaaaaccccgcgtgccaggagcaggtttcttgggcgcgnctaattcccatagagctctgggacgattaccttcacggaactcctgtatcctgggccttagcccaacgcctcttcaagtagtgccgccggccgcgcccgtccccctg

SEQ ID NO: 548910 - DNA, 441 bp, Homo sapiens
cccacgagaggcacgagggtgcacgttcacatcagctcgcaggtgcagtactcacctgaggaagtgtggggcatggttctcaataatcctcgtgctctagctgaagattgaggcagagcagaccatcaaggatgcagtgatcaccgggccagtcttctctcaaccaggccgagcgccgagcggtgacagaaggctgctcgtatggatggcctcaaagtgctgcagctcatcaaggacaacaccgccactgccctcagctatggtgtcttccgccggaaagatattaacaccactgcccagaatatcatgttctatgacatgggctcaggcagcaccgtatgcaccatcgtgccctaccagatggtgaagactaaggacgctgggcttttcactgagcagcgcaagggtcagagcgcaaaggatgtgcgggagaacccgcgt

SEQ ID NO: 548911 - DNA, 659 bp, Homo sapiens
  misc_feature (39)..(39): n is a, c, g, or t
  misc_feature (64)..(64): n is a, c, g, or t
  misc_feature (160)..(160): n is a, c, g, or t
  misc_feature (207)..(207): n is a, c, g, or t
  misc_feature (219)..(219): n is a, c, g, or t
  misc_feature (234)..(234): n is a, c, g, or t
  misc_feature (245)..(245): n is a, c, g, or t
  misc_feature (250)..(250): n is a, c, g, or t
  misc_feature (255)..(255): n is a, c, g, or t
  misc_feature (259)..(259): n is a, c, g, or t
  misc_feature (273)..(273): n is a, c, g, or t
  misc_feature (283)..(283): n is a, c, g, or t
  misc_feature (300)..(300): n is a, c, g, or t
  misc_feature (305)..(305): n is a, c, g, or t
  misc_feature (315)..(315): n is a, c, g, or t
  misc_feature (321)..(321): n is a, c, g, or t
  misc_feature (323)..(323): n is a, c, g, or t
  misc_feature (345)..(345): n is a, c, g, or t
  misc_feature (357)..(357): n is a, c, g, or t
  misc_feature (376)..(376): n is a, c, g, or t
  misc_feature (433)..(433): n is a, c, g, or t
  misc_feature (447)..(447): n is a, c, g, or t
  misc_feature (469)..(469): n is a, c, g, or t
  misc_feature (492)..(492): n is a, c, g, or t
  misc_feature (494)..(494): n is a, c, g, or t
  misc_feature (512)..(512): n is a, c, g, or t
  misc_feature (514)..(514): n is a, c, g, or t
  misc_feature (516)..(516): n is a, c, g, or t
  misc_feature (541)..(541): n is a, c, g, or t
  misc_feature (568)..(569): n is a, c, g, or t
  misc_feature (585)..(585): n is a, c, g, or t
  misc_feature (634)..(634): n is a, c, g, or t
atcttattagaaatacaagaagtgcacttaatacaaggnagttagtttctcggtgccaccagtnaggtggacatacactcacatcagtccctcaaacgaaggtttcgccagatttccctccagatttctgagatgatctgaattcaggaaggtctgagtnaacttcttccagaaattacagtgaacaagctgaccttaacttttggntcctcccgaganatactaatgaaaaanctatttttttncagtnggccntgtntttgctggaaaatnggcatctgcngctcttcaccggcaggngcggngcccacagcngcggtntncaagcgcgaggtagcacttgcngccccatcaganatatatgatatcaaaaaancaacctaaacccatatgctttttggtcaatcagaggttctgctcctacagattaggntgatagctcttggncttatatttattaatatttgtnatatatgatctccaaggttcttntnctgttcctaaagctagtntncngctacagcttttattaacaactgtncatcttgcgatgtgctgtgccttatgnncgatgtctcgtcagancagaccaggggtggtactgggtttcctatagcttctctctgcatctccnaagcaggttttcaaacacattttac

SEQ ID NO: 548912 - DNA, 413 bp, Homo sapiens
cgcagtggctcatgcctgtaatcccagcactttgggaggccgaggcgggcggatcacttgaggccaggagtttgagaccagcctggccaacatggtgaaatctcatctctaccaaaaacaaacaaaaaaaaaatgggccatagtctgtagtcccagctactcaggaggctgaggcaagagtaaaactaaaaacaaaattagctgagtctgtggtcccagctactcgggaggctgaggcaggagaggggcttgagccctggagtgcagtggcactatctcggctcactgcagcttccgcttcccgggcttcacgccgttctcctcctcagcctcccgggtggctgggcctacaggcgcccgcaagcatgcccagctagtttttcttggtaatttcaatagagacggggttcaac

SEQ ID NO: 548913 - DNA, 622 bp, Homo sapiens
accctactttgattgcctgggtgctgagttatggcttgactatggacgagatgtgtgtcctcttgggggaaagactggggagctcgtgccgattgtctgtcaggagtcatcccctgggctctagttcgcccctctctctctctgggtcctcgatcaggaccaaaccaagagaccagggttcactgtgccgggtgcaaaaggcccatccttggtacgcgcgtttctcttgaacagtgctggacagggcctggtcactgtcaagtgcgtccagtgctgtgaatgtaaatgcaacctgaccgaggaagtgcttctccaggcaaggcaaactgctactgcgaacgaacgacttcttaccgagtgtttcggtaccaaatgcgcatgggctgcgctcagggtcatctcccctagcgacctggtgcggagagcgcggagcaaagtgtttcacctgaactgcttcacctgcatgatgtgtaacaagcagctctccacttggcgaggaactctagatcatcgacgagaataagttcgtctgcagagagcaggtattaccgtaagtgacagcagtgttgccaagagagaagcagccttcagctcggccaccactgggcagtgagcccagtgt

SEQ ID NO: 548914 - DNA, 1358 bp, Homo sapiens
gtagctgggattacaccgcatgcgccatcatgcctggctactattatgtattttgaatagagacagggtttcttcatgttggtcaagctggtcatgaactcccaacctcaagtgataccgcccacctacggactacccaaagtagctggtgatatacagtgcatgagccaccgtgcccagccctataaatactacatatatttaagaaaccctacacctaatatactagtaagtacagctaaagcttattaataaacacttcaatatataaacgcactatagaacgcaattaaaatagactagccattataatacgatacccaagtagtcaacacaattaaacaaaccctacaacaactggtaacctactactactacacgcttgacgcgtacactacctgcgcgcttagcactaaaacacgcccactgacggcgtaccacctactagacaccactaacacctactggctacacatccaacactacacctaaaccaacgaacttaaataattctaacaaacccctagctaacacgacacgctcactcacctacgccttacaccaggatgacccccataccactaaacactatacatggcaaaactaattagagatacaccactaatggcataccacgcccttggcccacgacatccaaaaactaactactatcgcgaaccacagtttcatctacacaccaactacaccggcccaccccagggcgacccggcctatggaacgagggccccatactgcccgcttagcgacgcatacataatttatacaggaggaaccataacttaggccttcacacaccacacaatgcacaccgacgggcatactacaaccacacacccacattaaccctatagagaaacgtataccgacataatctatacacgctattcatcatacagtaataagtggctcacaccacaccgctactcggcgagaatcaactaccttcacctataacactactcaccaccataacaacactaaagccccacatatacaacacgagcgacatctcaccccaagcgctgggctgctatcaccacacagacgactgcccccaatactaccagccgagcacgctaccctatccaatacccacacataagagacaacaaccaccaactcacctataagagcacctacatatctcatcgtacatgcgtgggcatcacaagccgcagcatttaataaagagtgcacccgacaagcatactacacacctcaaactggtggagctgcacaaccccacagtcgacaaccaaccacttgtctcacaaacggcggaggaactctagtctcactcatgagtgcgcaccaacccttctgcacctcttaggtcc

SEQ ID NO: 548915 - DNA, 332 bp, Homo sapiens
agttcatccaagtgtttcatgggtcgtgagcgccgccccatgttcccatctccagctgtccgctcggccctgtgtgagctttgtttcgataccagggggctcagatggtgcggactgagcgtgcggcctgcgggctttgggatggaccgctgtatggtgggcggcgtgtgtgccgaggcctaattccatctttccaccatgacagagatgcccttgtgaggctggcctccttggcgcctgtccccacggcccccgcagcgtgagccacgatgctccccataccccacccattcccgatacaccttacttactgtgtgttggcccttatcgag

SEQ ID NO: 548916 - DNA, 815 bp, Homo sapiens
ctatcacgaacaaaaactctacctctctatactaatctccctacaaatctccttaattatagcattcacatgccacagaactaatcatattttatatcttcttcgagaccgcacttatccccaccttgggtatcatcacccgatgaggcatcgaggccagagagcagcctgaagtgcatggtcgcatacttcctattctatcaccctagtaggctcccattcgccctagtcagtctgccctgtatttatcactgcacaagagcacctaggctcatctaaaactaagttctactatcgtcactctcactgcccaggaaacttgtgcagaagaactgcctagagccaacgaagcttagagttatgcacgagcttacagcaagttgagcttgctagtaaataaacgatacgctccttaacggactccatttattgactccctaaagcgccatgttctgaatggccccatcgctggtgtcaatcatgtacttcgccagagtagtcttagaatcaggcggctatggtataatacgccatcagcacttcattcgtcaatcgctcctcgtgacaagaacatatagccgtatccccttccgttgttactatccgcgtatgaggcatgtattatggacaagctccgatcttgcctacgataaacagaactaaaaacgcgtcattgcatactcttcaatcaggcacatagccctgcgtagtagcagccattctcatcctagaagcccctgtaagctgcaccgcggcagtcattctcgataatcgcccacggacttacattctcattgactatgctgcctagcaaa

SEQ ID NO: 548917 - DNA, 118 bp, Homo sapiens
agcctccagaacaaggtggaatattccttgatttgaaggggaaaatattcagtcttttaccattaagtatgttaattcttatatttattttggttccccaaactaggcagcttgtaga

SEQ ID NO: 548918 - DNA, 968 bp, Homo sapiens
  misc_feature (588)..(588): n is a, c, g, or t
ggccatcttcatcatcatcgtgtggccgtgcatgcgaacgtggctctgatggccagcgaccacatccgagtggggcaatgctcaacctcgatggagctggtctgtgctagcgagagtgctagaacaaggcaggccccaatgcagcgggaggggcggccttgccatcctcgggtggcggtggtgtgcggtgcgacggcaagtggtgcgtggtgctggtggtgacgatggcctacatggaagctctcctgtggtcagtctctctcttatcttggcctgggtcaacgtgattgcgtgcctgggcggagcaaacaggcattgtcatcccagcattcaccctagcgccggagactccgaaggcgtgaccccggcgtgtctccaaggactcccatggcgcgcgcgtgaattgccagagtagccatcagtggtacgcacagcaccttggtagccagactttacctcatcagactaccggagtagagcaagcctcgttcatcccacgcattgtacgcctttttgtctcaacacgctgtaagaccacagggaaaccacttcaaagtgaaacaaacgtcccccagcggttgaaccggngtggaaccccccatatgggacaagcaaccttggcatggccgcgggaagatttccacatggacgcgtaagtagttttggcctcgactcgttgtaggaggcaccgatgctgttgtgcaaggagaggaagtgcgcgggataggcctgggcgtggagaagtggtttgcgcccttggaacggagaagaagcaggctaacgccggtctccgagcaattgtcatggcacagcgggcttaccggccctcggtgccgttgcggtctacccgggttgcaggaggcctcggagggttgtacttgcgcgtgaccatggcgttgggccgaagaaaggaggcgcccgagaatgatttaaccttggcagaaaaagaggtaaccgggaccgtccct

SEQ ID NO: 548919 - DNA, 166 bp, Homo sapiens
tgcagcggactcggagctggtgcttaatgtgaagacggcgatcgactgcgggaagtgaagcactgccttcagaccgtttggaacaagccaacagtgaaacccctttcctgcgacatatgcaatgacgttgtcaccgcagctggtgatatgccgagtccgctgcatt

SEQ ID NO: 548920 - DNA, 363 bp, Homo sapiens
tcgatacgactttatttcaatattatgtcgtttttttttttgagactgaatctcactccatcgtccaggctggagtgcagtggcgcgatctcggctcactgcaacctctgcctcccgggttcaagcaattctcctgcctcagcctcccgagtagctggaactacaggcacacactgccgcgcccagctaattttttgtattttttagtagagacagggtttcactgtgttgcccaggctggtctcaaactcctgagctcaggcaatctgcccgccttggcctcccaaagtgctaggattacaggtatgagccaccatgcccggctggcagttgtattttttaaagcccttctgtcgtcttctc

SEQ ID NO: 548921 - DNA, 456 bp, Homo sapiens
  misc_feature (44)..(44): n is a, c, g, or t
aattttggttagaaaaatgctatatgagtgcttttcttttaaantgctaagggcagagaatgaaaactacctgtgtgtgggagtgatatgatttggatctgtgtctgcacccaaatctcatgcccaaattgtaatccccattgttggaggtggagcctggtgggaggtgattggatcatgggggtggtttctcatgaatgatttagcaacatcccctttggtactgtcctcacaatagtgagtgggttctcatgagatctagttgtttaaaagtatgtagcacctccctcctgtctcttgctcctgctcctgccatgtaagacatgccagctccccctttgccttctgccatgattgtaagttccctgagacctccccagaagcaaagcagatgcccacatcttgcttcctgtatagtctacagaactgtgagccaattaaatctattttctttat

SEQ ID NO: 548922 - DNA, 101 bp, Homo sapiens
taagatgcctgcctcagttcatcctggaatccaccacaggtacttgctgctgttgagaacgcctcgggtacaactagacactcctaggttgctgtgtggag

SEQ ID NO: 548923 - DNA, 1214 bp, Homo sapiens
tccacacaacagtccatttttttgatgcccactccaggctgtcttagggttgagggtttgtacaaaaggaaaaccagaattcagttccagtgccgtggaggttctagctcgaggggggccggcgcggaaattggacacacagacagacacaatagattcgtggcatcgtgatagccagggcataacagtcctcagtgttaggggcactcgtgggccacgaggtatagctacagaaagagacttccatagaagaaatgtcctcacagggggtggtggagacgcaattggacgcaagtggcacgccattcaaaaccttacgccatttggtacattttgtaagcgcatgtgtcgactcttggaacaccatgtgagacaccagggttgacgcaccacaaggcgctaggagtgcatcgtggagacatgtgcgcagtcgacagccaaaggggcttcacccctgtcttgcgccatcgataaatccccatatagtgtgggtgacaagccaattcattcccgccaaacaccgcaagaattctctgaggcccgtgataacattgagaccattatgttgccaaacatgtggggccctttttctccagtgagtaaattccaaacctctacgcgagagggaattaacaaaaggggctattcccacgttgaaagaccaaatttcctactggtgagcacccagagggtgtgctatatatacccccgatggtgcctgtgggacaacccttaaaatatcaaagcaaaaccaccatatttccaaaatgagcacacatttctcttggtgggtccccaataaaaagggtggctcaaactaccatagggggggaaccaataaagtccataacgaaaactcctgagggaatcaccaaaaagactccagttgaaacgctgtagtgcgcaacaaggcgggagatccagtagcaaaagcgccccccaaggagtaaacaaggaggccccccatataaggacaaccgtgtcaagaacagcttacctacagaaaggaaacgcgccacataatggtgaaacccccatctcaatcgttggcactactgtgtgtataaaatcaggagcaaaagatacacttgtgaggtcccccacaaggccaaaacgcactccacaagggggatttgcggccaaagctcttagggcagctttggtgcctatgtcctattcacacaatgtgaatcacacagttagggaccccattg

SEQ ID NO: 548924 - DNA, 159 bp, Homo sapiens
cccgaatggaatcattcaaatgtggttctagatggcgatcaactctggaactgcaaggggattttgtagcgaagctggaatgtggcttacatctggcagttgtgacagttctccccgctgcaatctgaatctcaccctggtaaactctccccatgggac

SEQ ID NO: 548925 - DNA, 429 bp, Homo sapiens
attttaaaatttattctgattagtttgtgtctttttttttggttttttgaaagagagagtcctgctctgtcactcaagctggagtgcaggggtgctatctcggctcactgcaacctccgcctcccaggtccaagcaattctcttgccttgtcctcccaagtagctgggattataggcacacaccaccatgcctggctaattggtgtctcatttccaagagtagaaaccctaaatattttattttcatccctttcccaaatggctatgaatgggattaaaggattacagattgtaaagtctattattggtgaattctaaatgtagtcctgctgttgtccctgtggaacacatcttaaagaagtcacatatttggcacgtcctgcacgtgtaccccagaatcttaaatctataattaaaaagaatagtttc

SEQ ID NO: 548926 - DNA, 473 bp, Homo sapiens
cccacagtgagagatatctgcacaaaacgccccttttgcgaagagacactcaagaccaaacgagcgcatgcctattatcatgtgaaaaacagcccaggaaccaccgcaggggccctctcagcccaactaatgacgtccatcctaaggccgtgactacacttccactacataacgctcctcataccaagcctgctacccaacacactaaccatatgccaatgatggcgcgatgtaacacgagaaagcgcataccacggccaccacacacgatctgtccaagaaggcctaaaatgcgggataatcctatttattacataacaagttccttccttcgcaggatttttctgagccttttaccactccagcctaacccctaccccccaattatgagggcactgccccccaacaggcatcaccccgctaaatcccctagaagtcccactcctaaacacatcccgattacccgcatcagg

SEQ ID NO: 548927 - DNA, 392 bp, Homo sapiens
gtgcaggtggactcgagaggcccggatggagccgacgatccactgggtgtacttgcgctcatgaggatcaatgatcttgcagtcttcagttgtgctgggtgccatcggcagtgatctccttctgcatccttgtcgtgctatgccatgctacatggtggtgccgccatgactgaactgtgttggcgtacaggtcttcgcggatgtccacgtcacacttcatgatggagttgaaggctagctttcttggatgccataggactccatgcccaggaaggaatgctggaagagtgcctcagggcagcggaaccgctcattgcccatggtcatgacctggccttcaggcagttcgttagctcttctccagggaggagctggaagcagtcgtggccatc

SEQ ID NO: 548928 - DNA, 323 bp, Homo sapiens
cgagcggccggccgggcaggtacgcgggacctggaatagtgtttgaccaaacacgtgtaaggcatacttttaagcaccttatcatacacattaagttattggatgatacaaacagaattttaagggccaggcatggtggctcacacctgtaatcccagcactttgggaagctgaggccagaggatatcttgagttcgggagtttgagaccagcttggttaacacagtaaaaccctgtctgtaatcatcatcatcatcatcatcatcataattaatgaaacgatgttgtggtgggtgcctgtggtcccagctgcttggagggct

SEQ ID NO: 548929 - DNA, 555 bp, Homo sapiens
gcatcggtatagagtgtgtatacttacctatctggagccagagggagtcagcaaggtggttctgtggaggtcagctgagcttactcataaccatagagaggtttccctgttgactggctttgcaatgctgcaggttcctctaatccttgagtagaccagtattgggactcagaaaatgataccccaaaacaaaggcctcagaggcagcctcaaaagcaaaagtttctctctaagtttatctcgagtgagtgctgtgctattatcaataacctatcggcatgctgctgctgcacaacaagccaaccacatggctcagggggaagacaagagtgtgtattacttacctatctggagccagcagggagtcagcaaggtggttctgtggaggtcagctgagcttactcataaccatagagaggtttccctgttgactggctttgcaatgctgcaggttcctctaatccttgagtagaccagtattgggactcagaaaatgataccccaaaacaaaggcctcagaggcagcctcaaaagcaaaagtttctctctgacctc

SEQ ID NO: 548930 - DNA, 165 bp, Homo sapiens
tactgagaagcagttatgatgaccaggtgatagatccaaaataatgccacatttgttaacatttgtcgcatttctaaaccatccttaaagaaaatcatagatggggtctcaccatattgcccaggctggtctcaaactcctaggctcaagtgattgttccccgct

SEQ ID NO: 548931 - DNA, 212 bp, Homo sapiens
tataggtggtcttgaacctcctggcctcaatgtgatcctcccacctcagcgtcccaaagtgtttggattacagatgtgacccaatgcacccaaccaaacttcttttttttttttttttttgtgaaaagaaaggtctcccctttttggcccaggttggtctcaaacccttgggcccaattgttcctcctgcctcagcgggcctctatatttca

SEQ ID NO: 548932 - DNA, 576 bp, Homo sapiens
acatcgaaatatttcagctagccggtcgctcgcaaaatattccaactatgaaatcatggtatgtgacaacaacaaaaagagaggtgttttctcctgtaaggagtacgccacgagagactcactctattagtccgcatgcgcgaatacacgcggtgatatccaccgcgccctaaggtaatggtggataatttggtgcctaaatgagaaccaaccaggcgtggtacgccagttatatatgttctagaaaccagtgccctgcggtgaccaactccaaggtgccatggccaattgaatgcgccccttcgcctcgcctggaattaaggtgggcataaggaacgtggcatcctagcatcaacttattaatccttatcaaagacctcgttttttttcacaaaataggcttttcaaagcaattgaggtgatctggcagtaggcacgatattagacaaggaaaggtatgagcaaattcaccacgggcggcccatttgaacagactacatagatgcaatccttcttttcaggcaggccactccattctcaaaacaacccaacaaccaaaaaaccgtcaaaaaaaca

SEQ ID NO: 548933 - DNA, 1172 bp, Homo sapiens
  misc_feature (352)..(352): n is a, c, g, or t
ggtcagtcgcatcttctgttgcgtcgccagccgagccacatcgctcagacaccatgggagaaggtagaaggtcggagtcaacggatttggtcgtatggggcgcctggtcacctagggctgctgttgaatagcatcttggtaacagtggatattgatgccatcaagtgacccgctttcagttgaccttcaagcaatactagtggcttgtacatgtcttccaagtatagatgcctaccacatggacacaattccattggacacctgtcacaggcatgagcaactgggaagcatatgtcactcaaatggtacatcccattcaccagtcttccagagagcgagatccctcacaaanatcaaagtgagggcgtatgcttggacgactgatgtacgtctggtgagatgtccagcatggacgtcttcaacacacgcatggagaatggtcttggagggctcatgttgcaagtggagtggacgtcccacagaggtggtcatacatactactgaccctcctctgtctagatgcaccgccattgttgcgtccatgggatgatgaacgcaatgacgaagtatgaacaatcagtcgtcagaagatgcaatcagacaaatggccgtcctgcatccagcaactgtcgttagcacccctggacaaggtcatccaatgacgagcttagagtaatcgtggaacggactcatgactcacaggtccatgcccattcactgcatccaggaagaacttgtggatggtccctccgggaaacgtgtggccgtgatggccgcggggcatctccagagcatcatccctgacttctactggcgctgcaaagggtggtgggcaaggttcatccctgagctgaaacggaagctcacttggcattggccttccgtgtccccaactgcaacgttgtcagtggtggacctgaacctgcgtctagaaaaacttggcaaatatgattgacatccaagaaggtggtgaagcaggccgtcggagggccccctcagggattccggggtacaactggagcaccaggggcccctctgacttcacagcgaaaccaagtctccaccttgacgcggggctggatggccctcaggaccattggcagcgcactcggatgaacacaatggtcacgaacaagtggggccctgccaaaggcccagaaaaccggacaagc

SEQ ID NO: 548934 - DNA, 601 bp, Homo sapiens
gcacgagcgataatgaatatttatatatagattataatgatatgctacatctattagaacactacgtataagtcctacatggacctttgtatgttttatcactgtgactgcctatactaacaacattatgatctcagtggttacaagacatcagtaagcctgaacaacaaattcatagcacagctgattacattactattcataggatgactggaaaggttgaatctataatccaatcgaggagtaccacatagaatatcttcaattgactatataggtagcacatataatagatatggtacatgataagtcatatacttaatatacaactatctggacctattaatctcacttatggacacatctaatttaaacgataatactgtggcccattattaaaatatccatgttaattcaataattgcatactaaattttaattactatatcactataaacttcattctttttttagtgtaattcctaatgtattttaatgctttatatatatttttactgttcataactttgaattattcaaaattgtatttatattgattatatctatatggttccaattttgattattttaatatatttaa

SEQ ID NO: 548935 - DNA, 485 bp, Homo sapiens
  misc_feature (107)..(107): n is a, c, g, or t
  misc_feature (136)..(136): n is a, c, g, or t
  misc_feature (318)..(318): n is a, c, g, or t
  misc_feature (343)..(343): n is a, c, g, or t
  misc_feature (349)..(349): n is a, c, g, or t
  misc_feature (359)..(359): n is a, c, g, or t
  misc_feature (411)..(411): n is a, c, g, or t
cctaagcccgtaaaagaatccagaagacctcagatggtaaaggacagaggtctacgtctactgctgttagcgctcaggtatccatcctgttttccctaatctcctgnattctgatccaagaagtctttgagacctnatgtcctagtgccactcctttcatctagaaagtggaaacctatgtgctgtggcaccatggcatggtacacaccctgcagtagattcacgctgcacaaatggggtagtccacgagcttagatatgctgtctgatgctggctaggacacacactgtcattttatgagaataatgttaaaacaanacattagatatcacagacaaacaangaaacntgagatcacnttatatatctattgtaatagttaaaactgtctataatgtatttttctccagnaaactgaaaataccatagacataattttattaatcctcacaacacatctgtgaggtagtatggggttaggtctg

SEQ ID NO: 548936 - DNA, 230 bp, Homo sapiens
gaagtcatgaactcgatgcatacttaaacatgactcagtaataatctcagaatataacataaacaatgtgacaaggctgtcttaagaacggctctgctataaatagtatagaatatacagaattacaaagtcaagtattttattatcaaaatataccccctccctgaaactaacacaagctaagtgttaagagttcacagctcacctacctcaaaatgtgtttccaaatt

SEQ ID NO: 548937 - DNA, 114 bp, Homo sapiens
  misc_feature (4)..(4): n is a, c, g, or t
gtanagaaaaactttcagaattgtttaatgcaagaaaaaaatcatatttaacaattaaaaagcaaacttcatattacagtccaaacactaaacctacctgggtctgattgtatg

SEQ ID NO: 548938 - DNA, 327 bp, Homo sapiens
  misc_feature (19)..(19): n is a, c, g, or t
aaaaaaaaaaccccccctnccctttttttgaagaaaggaaggggttaaataatttttttccccaccccttttttgaagggcgggggctttttttttgaaaaagtagtaaatagttttttgtaccctgggggaaacaccacccccccttaaagtggcccctttttggtaagggttaaaccagtgaaaactaggggaattgtttgggcggcttttagttttttttaatcaaaattactaaatgataaaattcaaaaccttgttccatgttttccttgggggatcgataatcttttaaaaggaaagactttgtccggcctttttccccca

SEQ ID NO: 548939 - DNA, 368 bp, Homo sapiens
ggatgatgaggcgtaggacggagctcgagaccgtctctgcccgcagatgtggcggcaccggcggatccagccttatcggttcctctatgggcagcagcggtggaggctcgattgactccttctccgaacatctgatcactcgtaagcccaggacggcgcttgctcttccatccgcgctccccgaaggcggccgcctgttcatggatcacacgggccctgattatcagcctgacgtatctgtacagcgacgggtagaagaatcggaataaattgcataattattacgtgcacaacgacaacttgaacatgcaatcattagagatcatcatataaggagtcatatgccgccccacgacgatcgtgcgggc

SEQ ID NO: 548940 - DNA, 172 bp, Homo sapiens
ttggtgggcatacagaaaatcaagtgtgatgggaggtatgggcctctctatacgtcatgaaagcctggaatgggtggggtgggtgaaatagaagaatgaggtttcaatgtgattacatttttcacgtgtagtgatgatttgggggttttggagagacctgtaaccatgaaaa

SEQ ID NO: 548941 - DNA, 900 bp, Homo sapiens
ggctggcacctgagacgctggcgcgcacgctccggcctgcgcccggtccggccatggacggccccccgacccgtctccctgcgatctccgtttcggtctcgtgctccgtgctttttacgccccgcagaagaagttctggccctgtggtggccccaaatgcccaaatgtgaatcccttccggcccggggacagcgagcctcccccgtgcacccggggcccagctgcgcacagatgggccgggtgggcgagattcacaccgatcgtcccgggaaggaactatcacccattgtcatccaatcatccaccattgtcgtggggcgactgcgcagcacggcatagacaggcaggggtgcgtctgtttgagcgttgacctgtacccggaatgaggcgcgcagtataagcgtggatcagacggaccagtcgatataaagtcaagatgagtaaccatcatgtaataacgtggatcacaacctcatcccagtcatccccaccgtccagactcaaccccgaccccggaactaccccactccccagcacaccaccacctgaaatcgcatcctcacccatcacactagatacaacacacaatcatatctcgtgctcccgtcgcctacccacgctgcagaccgctccattctcccctcctcgctaccccctcataccagccactcatggcgtcactcgaacagacatatgcccggacgcgtcagcgcaacttagcctccatccactctcgtatcgtcgaacgccagcacgggagaggacgatggatatacgagtgccgaagactatgtagctgccagctagtaccggacagagaattagacaggagcactaaggtcctagtcgtagccgtcggagcaatgcgcatcctcatatctcgtccatagcagacagcgg

SEQ ID NO: 548942 - DNA, 129 bp, Homo sapiens
  misc_feature (95)..(95): n is a, c, g, or t
tatctaaggatcgcggcgagtgaggtcagatataatgctaaagtaggggaaaaagtaaaaggctgtgagttctgttgcagagtcatttgtagacnttgcaaaatctaactaattttatattatagcttg

SEQ ID NO: 548943 - DNA, 709 bp, Homo sapiens
tcacaagctgtgccccctactttgctgggaaccagaaacagctggagcgaccctgcagcagttcaacatcaactgcggcctccaggactgagaaaccctcctggctagaggaccatgagctgctcccagcccaacttggctatcacagaaagaccttgggaagggcagcccccgggtgtgggagattggacctggtaccacctgttgtcaccgttgccctctggcttgggctcctttttctgctggggcctgacacccgttttgcccccccttgctatggtgggaagaggcctggaggccccgaagttgctgccccgtctatcttcctggcccaccgggcttcattccccgatcttttccttccacttcacagcccacggctatgaccaaaccactcctggcccatggcatcactcttcaggctggggtgtgctccctgacccatgacagagcctgaaatgccctgtcagcccatggcagctcttctcggactcccctgggcccatgatgttgcgtctaataccctttgtctctcctctatgcgtgccccttgcagagaaggggactgggacccaaggggtggggataatggggagcccccttgctggccttgcatctgaataggcctaccctcaccccccccccccgtttaattgtgcttagagccccagaagattgggatctagccctaggaataaaccctttcata

SEQ ID NO: 548944 - DNA, 105 bp, Homo sapiens
agtagagaccagagatgaagcaggaaacagagagaggaagatggggacagacaggggacggcagaggggaggggagcaagacagagaacagcagagaaaggggac

SEQ ID NO: 548945 - DNA, 723 bp, Homo sapiens
gtgaaggtcggtggaatcctggggtcctccaaatctaccaggccatctccccagtatcccagttcttcctgcgtgcgggcagagagtggtttgggccctcgggaacccactcagagcgaggctaaatttactgtagatgtggacatttcttgttagcatgcatgatgtggcctgtgtgttagacctatagatgtgtgactggaaccagtgtggcatgtgatgtccatgggtcattggcctttctccaatggacctcaacactgtcacctaatctatgtgtgcccagcatcatgtgttccctctgtgcatccttggtgacatacacattgcatcccattagtgccataaccgcattgaagcccagaatgcacctgaacttggtgtgccccaccccaaatgctgggactgcacatctgtgaaatgcattgggtgacctccaactgggaattgtgcctgtgaccctgcaaacgctttgacagaggggtgttgagattccattgtttgccagcgattatagccgctgcgaagaccctgaaagcgatagcgccagaccttccatgcccgagagctcctggctaactgtagcttaggtcctggaaggttgggtggtgactcagggcgactttgggacctgctgattgcgcctgtcgttgggattttacaatcaccatgaggcggatgtggccccgatacagagcacctcagtttgggacactaggttgg

SEQ ID NO: 548946 - DNA, 446 bp, Homo sapiens
catagagacatactatatatatgactaggaagactcataaaaatatctgtctcttcaaactctacaaattccatgtacgtccaatgagaatactaacaggctttttcctggaacctgatggttgcaatcacaccaatttcatcatggcaagcagtcaaaggcaccaagcaaaagttcaaagtgcatttttgcatggcatcaagcaagcagccaggcacagcaattgaccatcacaacatgagtgccaggccttattcaaacaaccatccagtgcacacgcaggccagtgctggccacctagctaccagggaatcacacacaaccagcatcacacagggcaggcagcacttggcagcaaccccatgtcaaccatgcttcacgcttatcctggcacaaggtcacagcttgttcactgcaccaattacacaagtcacaggaacaattgc

SEQ ID NO: 548947 - DNA, 306 bp, Homo sapiens
ctgctgccagtactggatttctggaaagttgtcagccaggtgcattggctcactcctgtaatcccagcactttgggaggtcgaggtgggaggactgcttgaggcaaggagttcaagtccagcctgggtaatataacgagaccttgtctctacaaaattaaaaaaaaaaaaatagccaaggatggtggtatgtgcctacagtcccagctactcgggaggtgaagcagaaggatcacttgagccggagttcaggctgcagtgagccatgattcgcactgcacctagtctggcaacagagtgaagaacc

SEQ ID NO: 548948 - DNA, 112 bp, Homo sapiens
caaccgcagccatcgacttctacaagcgtgcgttcaatgcgagcgaacagtttctgcctggcgatgcccgacggccggctcgcgcacgcgtgcctcgtgattggcgattcga

SEQ ID NO: 548949 - DNA, 109 bp, Homo sapiens
aactgagcttcaatgaacactgagtagtatacaatggtggtgaaggaaggccgagaagcaccacagcagcaggatggggaagaactgggtaatgatacacaagccgctt

SEQ ID NO: 548950 - DNA, 479 bp, Homo sapiens
cccggtcccatgcacagttaggtagtagatgaaggcagtttaactaagctccattcagggcccagtgttgtagatgttcaatgatgacacttcatcagggttatggatgctgtgtctcagccccatgggactgcttagggaaagaacacacaggaggaagctaaggcacagaactgaccccgtcactgagcctagtgcctgctgagtgctcacgcacactgacagtaaaaatgccagtatggcccagttttaacggaacccacacactttcatgagctttacctcctgaagccataacaggttctcacagtgaagatctaagaaaaaaaaaatcccttcatgcttccagcagtgggagggggaaattagccattctgaaatatgcccagagcgtatggttcttcataaagcccaacctcaggagaaactattttaccagagctgaggttttaccagagacaaactgacctggggaaagg

SEQ ID NO: 548951 - DNA, 195 bp, Homo sapiens
  misc_feature (78)..(78): n is a, c, g, or t
aagccacagacattgccatccaggcagggggagatcatgaagctctaagaggcagctctattaacatctacgccaagnacaccaaccaggcctccaggtatcgagtccgccatggagagggcccctacatgagcccaatggagcccaggaatttgcactttagcaaggtcttggccacctcccaggacgggtagg

SEQ ID NO: 548952 - DNA, 103 bp, Homo sapiens
agcctgcccgggctccaaccccaattgtggacctcaggcaagagactgcttctctgtgcctcagttaccttgtggagtgggccatcggaaatagtatctgtgc

SEQ ID NO: 548953 - DNA, 1083 bp, Homo sapiens
  misc_feature (862)..(862): n is a, c, g, or t
cctgagcagttggtctgaccacggccggacctaggtcggtagcgtgacacttcagatcaactagcagcgctggccatatgtgaggacttactgggttttcgacctacgctgtgtacgtcagtactctaactcaacttgaatcgaagacctgccacgtgcgtcggaccagagatgctctgaaacacatgtctggagtgagtcgttgcacggagggcttcactgttgcctcgcgaaatccattgtccaaggctatgggcaaggtgctcgattgttctgcgatgactgctggaatctttgcaatagacgtttcatcgggcacccacaactcccgtggtcgatttctcgcaacggagcaaatttttaaagggcaaagttggccctggtttcggaaaggcgccttggcgtgtgctgggttagaggtgggcgttttcccttggctccaccctacaacctgatcaaagcaagcacatttgaggccaacgctagctggctgcacagacacccgtgacacttggcggcacaatttcggctacccaaatccggaaagtgcgtacttttgaggcagccttttctcgtagacattggtcccataatctccagggggacttactggagcggctgtgtaggcttaaatctggtgcaacccaattggacaaggtccgatatgcgaacgttagttgacaacttgaaccctccctgaaaacgtccaaaggaataagtgttgaagtcgccctcaaggggaattgtgcagttgcgtcctcgggggcatttttgaaacacacggtcccacatccttggcatggggcctggattccccgggcactgtgtggctcgttaaaaggtaaaaagcgccagaagttantatgaacgggaattggaacacacaaggttggatttgcgttccccaaagggcccgtgtgctttggcaacagggaagaaggcgcgacaatcattttgagccgcccatataggggtccttaagttgactttccgggaacgcccgaaccgtgatctttttacgccttgggttatgggagaagagattggcaggagggagttccataaggagaaacggggagttgg

SEQ ID NO: 548954 - DNA, 143 bp, Homo sapiens
cgatgaatatcagtgccttcaggctgcggtccctggcccagcgagcatggggcagcggcccgatggggctcgacggggtggtcaagtattggcggtcacccaggccccgtgctccagaagggtgaggttcacagtccatgcag

SEQ ID NO: 548955 - DNA, 370 bp, Homo sapiens
actaccttacttaaactcacattatgattatttgttaggatccatgaatcactgcattttggtatctagagtttttgtcttcgaacgccaattgggtcgctcatcgtttccccggtccccagaggctcccttaactatcgcaaaatgccaccccatgggaagagcgttccttgaaactgtcccggtctggtaattttttcaaaaaggaagccgttcggggacaagtcaattcgagtcaatgacgtacatttagacataaagtcctccccaatttgagatacttttgatagtccatgtaagtcgacactgaccaggctgtgacaagaagagaggaacctgtctccaatagtttccacattcaccaatggcc

SEQ ID NO: 548956 - DNA, 207 bp, Homo sapiens
ggtttagggagagaaatccaccaaccagatccttgctagttttgaagatgcaggaaggtgggcatgaactaaggaatgcaggcagcctcgacaagctggaacaaaggcaaggaaacagattctttcccagagcccccagaaaaaaaatgaagctttgcagatccattttagacttccgacctccagaactgtaaggtaatacatttg

SEQ ID NO: 548957 - DNA, 92 bp, Homo sapiens
gtcccaaaacttttttttttttaaaggcatttgtgggctcaattttaatttttttcttttaaaaaaaacagctgggcccatcccaaaagcca

SEQ ID NO: 548958 - DNA, 983 bp, Homo sapiens
ggagccacggcgtgcgagtacggggctgaaggcatgcagcagcggacagagggcgccctctgtctagtcgctgcttgggtctcggtgataccccgtatctgcctgtaggtgtgggacgtgcgtgcggcgagatggacactcccccgctctcggattctcgagtcgggaatccgatgaataccttggtcacagacagagcagtttggcaggatgcgttttcccgaggagtcttctgtaagccaggcctcacagtgtcgtgctgtaagggggcgaacaagggcgtgaacgacgtgaatggcctgaatcgcggttggcagaattcaagcgggatctggaagtgggtctgcaaggctcgcatgtgacactgggtccggtcccggacatcgggggatctgaggcgccaggcacctcagaacaaggaccagaaatctgttgatccatgacgacgacttcctacgcgagagatgagtttctatcggcaaggcgaggccgtagtgctctgcgagttcttacacccgtctccatcagctcaaagtccctacgaagcgagccgagtgattgatagtggcgcaaatggcaaatctgatctgcagatgcggacggattcgacagaagctgcagagtaaacaggctggcatggacgaggtctgaaaaaggctaagcaatgccgaggcacttaggacatacgggcagaaggtgcaacggaggttctgcagaagaggcagcatgagaaagccagtactgatgaggggcatcagagagtatcagaagggtccgctgataagcggattcctgagggagaatagaactctggaagccaagaaggggacaaggccgcgattggcgggcccgtcaacacgggtaaacccagtggtggcggcgccaaggcgccggacccgagacagggcaccccagccatcggcggccgcgggcaggtaccgcagcggaggaacacttcacgagagaccctggtgacaaatatt

SEQ ID NO: 548959 - DNA, 717 bp, Homo sapiens
  misc_feature (679)..(679): n is a, c, g, or t
  misc_feature (701)..(701): n is a, c, g, or t
  misc_feature (708)..(708): n is a, c, g, or t
gatatattcttacttcattattttcctgtttttatcacagattcgaatcttgggccatggcataatggtcaaattcaaacattttttaaatgtgacagatggacttcatgcaagttgcagtgggttctggtactaaaaatgtggttgttttttctgtttacgtaccctgcttagtattgacacttctacccaagagggtcttcctaagaagagtgctgtcattatttcctcttatcaacaacttgtgacatgagattttttaagggctttatgtgacctatgatattgtaatttttctaagcatattcaaaagggtgccaaaattccgtttatgtcctaaatccaatcaggaaagtaaggcaggaaaagttgatggtattcattaggttttaactgaatggagcggttccttatataataaccattgtatagtagggataaacccctaacttaatgtgtgttcattttaaagtgttctgtatttttaaattgccaagaaaaacacctttgtaaatttggagatattttccaacagcttttcgttttcagtgttttaatgtggaagttaacccttcccaaaaaaggaagttggcaaaaccagccttttagcccccttttttaaatgaataatggtagcctaaacttaatatttttataaagtattgtaatattgttttgnggataattgaaataaaaagttntcattgnatgccccta

SEQ ID NO: 548960 - DNA, 922 bp, Homo sapiens
gcccagccagaggtgtagccaagtggtccagcgtcactccagtgctcagctgtggttggtaggagctggcctgtgtgcacagcccttagtgtcccaagccgggagccaacgaagccggacacggcttcactgaccagcggttgctcaagctcgcaagctctcatgcaagtgcccatgtggagcctgctcgtcacccaccatgtggcacctgggagcccgctcacactatcccagtggtgccctggagaatccttgatgaacgagtttggggacatcaaggaccaggatgtcctgtcatcgtcgttgcttgatggaatgaagacctttattcagcccttgaccctgttgcattcccgatgacacatggacagacttcacagcgtctgctcataggacctgcatccttcctggggacgaattccactcgtccaagggacagcccacggtctggaggccgaggaccaccagcaggcaggtggactgactgtgttgggcaagacctcttccctctgggcctgttctcttggctgcaaataaggacagcagctggtgccccacctgcctggtgcattgctgtgtgaatccaggaggcagtggacatcgtaggcagacacggagcccgggtccaggagaagtgctccctggaggcacgcaccactgattcccactggggcccggctggggcccacgcaccgacgtcagcctcttaccttccccacctcaggtaggggtcctcggggatgccgttctgttccaagccttctgcttcttgggcaggtggacattgcctcaaaggcatccagggagcccggcggcatctcgacgggcaccgctcttgccctgtagcgctgcttgaagttgtgggcgaagcatagggggcttgcaacgtactgtaggcgcaacagtagctgtagtgacactg

SEQ ID NO: 548961 - DNA, 453 bp, Homo sapiens
cgtcagacaccatggaggactgttgaaatgggagctgctatggagactgagagagaggagaagacagcaaggactctcagagcgactgtgtgtctgctccatgtcccaattcagagggcacagatgccttgcctgagctagaatgaagaggaggagcacaggatggggagtcagtacgcgcaaggaagcctggctgtgggttgcgcctctggagacacttccagtctgcaatcataggacaaaactagaatctgcagttcagtgcttatgcgtcacgagagactatgtacacatacacgaaaacaagtcattcaccatcggtgtacaacgtctttaccccttgggcatttccttccgatgtttacaaaggaacgctagccggtcgcggtggctcacgcctgtacttcctgcacagtgggaggcctcggaaggctgatcacctgaagtccggac

SEQ ID NO: 548962 - DNA, 963 bp, Homo sapiens
  misc_feature (241)..(241): n is a, c, g, or t
ggcttaacttgttcccttgtatgttcgggtcttcccaggcgggcaaccggcgggtcccattgtgaacttcaagcggagctggcttccaaggcctgggcggcggcgcgaaggggaagcgctcgtgggcgcgccggggtggtgggttgggggacagggggttggtggcgcggcgcggtgctgtcgttctggtgccccactccaaaagggttccggtgctgcgcacggagaggaacgagggagntggcccggacaactctcccctggacgaattgacgagaacgcgggccagggagggcacgcctggtgtgagtgacactgtgaacagacttacaacactcctccacgaatggtcttccaggtaagtggtctgaaaggtttttaatctccaggtggtctacaagggtaaactaccaactgtggcttctcccggcggacaggctttccaagtgtaactgtaagtggactttacgtgtgaaggagactggtggttacaggtttttcactatacactcttggctatctgaggttcttggaagagatggcgtttcataacgttggttcgaacaaaccagattgacgaacagaaattattattcgacatatctaatggtgatccatgtaaaccgtgtgtctctaacggccattcgtgtggaacccacagagttggagggcaaatctttcggttatttagatgtcttagggtgggagggagaagattccaggttgagttatcttggagaatgttctgatttaatgtgtagcacggggaacctggctaactttcaactgtttattcaggggtacgtggttcacgatgctgttggtatgtgggactctgaggggtacagaacacttaagttcttcagagagtttatggttgtagaactttagtattttgtcgaagtgtataggtaataagagtatgttgatagtgggcaacggttagaatatcggttttggggc

SEQ ID NO: 548963 - DNA, 132 bp, Homo sapiens
tgggcggatcacttgaggtcaggagttcaagaccaccctggccaacatggtgaatcctcgttctactgaaaatagccaatattggtctgcaaccggtgtgcaaccaatattggtctgcaacggggatcctct

SEQ ID NO: 548964 - DNA, 626 bp, Homo sapiens
gcacgagaaattaggcatagaaggaacatatttccacataacaaaggccatatatgacaaacccacagctaacattatactgaatggggagaagctgaatgccttacttccaagaactggaacaaaacaaatatgctctctttcaccactcttattcaacacagtgctagaagttctgactaaagcaatcaggcaagagaaagaaataaaggttttccgaattagaaaagaggaagtctaattgccccctctttgaaaaatacgggatctaatatctagaaaaatgtagagactccaccaaaaactctcagaactgatcaacacagtaaagttgcaagatacaaaatcagtcaacatgcaaaagtcagaagcattactatacaccaacaacaaggtagctgaaaaagaaaatcaagaaagcaatcccatttataaaagcttcaaaaaaataaaatacctaggaatgaaattaaccaggggagtgaaagaaatcaaaggaaaactgcaaaacattaatgaaaagaaatggaagaggacacaaaccaagggaaaaaccatccaatcggaaggaaagggaaaaataatatgggtaaaaaaatccaactacccaaaggcaaaatttggaa

SEQ ID NO: 548965 - DNA, 246 bp, Homo sapiens
tacacacatatgacaaaaaaattcaaaaaagagaaagaaaaaaaaaaacccagaaatctggcaggctgaagaattcaatgaatgaaataaaaaacacaacagagagcttcaacagcaaacttgatcaattagaagaaagaatatctgaacttgaagaagggtagttggaaattacccagccagaaggaaagggggaaaacaaattgaaaagagtgaagaaaaccgtgcagggggaattcgcgaatg

SEQ ID NO: 548966 - DNA, 537 bp, Homo sapiens
ccgatgaaaagaaaaatcggatcccgatataaaccattcgtctagatgcactcacatttatactccgcatgtccactatctcgccttcctgcgctcaatggaggacgtgacgattgccggatgccgcactggggctaagttgagcctcttctcatgcactgagagttggatgctccatgccctctcccagcgactacagagaacgtggtgtgtgccctgggcctgagctgtgggtctgttgtccatcatttattgggaccatcttcatcatcaatggattgtctccaggcactgcttcttaatgcagggggcctctgtaatgctcatggaggtgatggtgtctcttagagagaagatcactgtagactcttctgctttaatgtcttgactgcgctggccctatttctttcctttacctcattgagggccttcctcttctgcatgtccccgccctttagccaccccatgtgtggatgtttctcttcgtttgcgccgtgccctctcctctaactggtttccctgtctaaatgctggcat

SEQ ID NO: 548967 - DNA, 854 bp, Homo sapiens
  misc_feature (82)..(82): n is a, c, g, or t
  misc_feature (104)..(105): n is a, c, g, or t
  misc_feature (119)..(120): n is a, c, g, or t
  misc_feature (141)..(141): n is a, c, g, or t
  misc_feature (144)..(144): n is a, c, g, or t
  misc_feature (161)..(162): n is a, c, g, or t
gcatagtgggcttgctgggcgggccggtctcggagaagaggggagagtggcgggccgctgaataagcttccaaaatgatgcncacaccagttatcctattgaanngaggggactgatannctcccgagggcatcccccagnctngtgagtaacatcagtgnnctgccaggtgattgctgaggctgtgaacgtaccctgtggtcccctgttggcaatggacaaggcttattgtagactgggatgatggctaaaagcgaagcgaattttcataagtgatggggccacaattctgatagacttcttgatgttgtccatcctgcggcaaagcacgtatgggtagacatagctcgagaatccgcaagatgctgaggtgggtgactggcgacgcacctcagtgaccgttggcgggcgtgccagaagttgtactgaagctagggtggaaagcccatatgtggcaggaatgggtgtgactacgccccaggatcgatcaatttcgagcatttctcgtcatcgagagcgcaccctagctggcagggttaacatacgattcaaacgtagtattggcctgtgtaacccgttgaaggaaagtgcatggatatacacgtcgtgggcatgatggtaacgctgactggtgaaactgttgttgcgcatgaccgttctgaggtccaagctgatctcccagacagaaagctttcttgtgctaagatggtgggtggatgctagtgaatgattgctcgatgattagggtggcagcttagaagctgattggaatcaaggaaaggtacacgggtggaagcctcgtcgaggaatgctcaagttgggttagcatgggagtttggcgttcgaagaaagag

SEQ ID NO: 548968 - DNA, 700 bp, Homo sapiens
  misc_feature (82)..(82): n is a, c, g, or t
  misc_feature (104)..(105): n is a, c, g, or t
  misc_feature (119)..(120): n is a, c, g, or t
  misc_feature (141)..(141): n is a, c, g, or t
  misc_feature (144)..(144): n is a, c, g, or t
  misc_feature (161)..(162): n is a, c, g, or t
  misc_feature (447)..(447): n is a, c, g, or t
  misc_feature (451)..(451): n is a, c, g, or t
  misc_feature (607)..(608): n is a, c, g, or t
  misc_feature (639)..(639): n is a, c, g, or t
  misc_feature (648)..(648): n is a, c, g, or t
gcatagtgggcttgctgggcgggccggtctcggagaagaggggagagtggcgggccgctgaataagcttccaaaatgatgcncacaccagttatcctattgaanngaggggactgatannctcccgagggcatcccccagnctngtgagtaacatcagtgnnctgccaggtgattgctgaggctgtgaacgtagactatcccctggcgtccccgctggacagtaggcatcacatgcctatatatgtacgtatggtcaggaagcgtcaaagggcaaccgaatctattctatatggactcggggccgagcagaattactagaatagcctatctctagagtggtctgttccgatcgctcgactaggctacaagagcatttggtgttagaacatgttgcgcagaagtacccagagactgactgcatggctgcgggtggaaatggcaaccancccntgcaggtgaacccttggctggtgcgtgacagcagctctgtcgtgaaagacagtcgtgaaataccctgatggtgcgacggacacggttatatcacctgcccagaagtcattcagttgcgaagcgttgtccgcagcaaggcagcctcaggctgtgcanngttaacacagagtcaagagagagttgcgtgntgaacccgntgaatgaacggtcagaatacaaggtggcagaccagagtgaaacgcgtgactg

SEQ ID NO: 548969 - DNA, 168 bp, Homo sapiens
  misc_feature (37)..(37): n is a, c, g, or t
atcagctcggtactagatgtatgtctcgcatcaaggntagacagtggcaatctggtggaggcgtttcgggatttgactgctggggccaggaaccctggtcccagtattgaaggggattggtatccaccgtagtcgagggatgcacatctctcgcacagtaatacatag

SEQ ID NO: 548970 - DNA, 405 bp, Homo sapiens
ctcttgtatgctcagtgtcggcgactgcagcggccatgagaagtcaatgatgcacgggcagagagaggccattatggacgggtggataaagaacaatgacatcaggagcatagggtctagaacaaaatcagtggtgtacagtgacaaagagtggggctgtagtgacaggcagggactacctggtagtgacagacttgggggagctggtgcttacaggtccggtaatgatgcagcatatcgggaggagtcagtaacaagagagtggactatagccggtagggaagctgcgagtacacagagtggccggtcccgggacagtacggtgcatgggggaaggtgacaggctgaacgacgagatgattccgatggaagcaacagggcagtgcggggtaaggtgaggttaga

SEQ ID NO: 548971 - DNA, 367 bp, Homo sapiens
ttccttgtggcaggggctgggtcttatccacttgttttcccagagccaaacagggtgtctgacatacggtcctggctcggcaactgttgacttgcaatggcaatgataagatgaatgatttcaacaaaaggaacatttacattttaagagctgaatcaagaactcgcttatgtcaaaggaagagactagtgagtatccctcaatgtcttgggcactggaaacaggccagggtgtgttttccaactcagctactttctataatagctgtgtgacccaaagtggaattttcttttttttttttgagacggagtttcactcttgttgcccaggccagagtgcaatggcaagatctcgactcactgtaacc

SEQ ID NO: 548972 - DNA, 762 bp, Homo sapiens
tggaaaacgtcatggaggccatggggttggtcttgaacccagcttgggggggtccgatatccttcctttgtggtctaaatttatgtatacgggttctatcgaatgtgtggtagggtggggggcatccatatagtcactccaggtttatggagggtccttctactattaggactattacagcattcgaagcgagggcttctcaaatcatgaaaattacttaatattacggctgttagacgaaatgacttgagcctacagatgataggatgttcatgtggtgtatgcatcggggtagctccgagtaacgtcggggcattccggataggccgaaaaacgtgttgtgggaccgaacagttagattttacgccgatgaatatgatagcgcaagtaggtctacaacgacgctatttcccctatcataggaacgagcttatcacctttcaggatacacgccctacaataatcattaccatctaatcggcatccatagtcccggatagtgcccttttgccttaaagagttaccaccagaccacagacttaaagctaactacgttaactgtgtccagagcgcctcgaggaaaagtagcaaaacccgttgtggaatatactccagtgccggggcccaatccataccatagtccttccagtcgggccgtccccaagtgctataggcaagtcccattttacatttacccagacgacgggtcaaaagactcccttcccttttaggcataagaaatcaattgtggcccccacacgg

SEQ ID NO: 548973 - DNA, 120 bp, Homo sapiens
caatctgcccgcctcgacctcccaaaatgctatgattacaggtgtgagccaccacgcctggtgcacacacctcctttagagtttgttagaccttcttttgggagcagcctctgtctcctt

SEQ ID NO: 548974 - DNA, 211 bp, Homo sapiens
gaatgaaaatagatgtgcaaacagtgaaggtctgggagcagtaatggattgaagggattcaccgtgctagaatttaagagaactacacaaaatgtctagtgaatactctggataaattttggtgataataaacatttccacccagaagacccttgggaacttacatttgcatggcacattaaaacctaaaaactgtagcactaaaaatgtt

SEQ ID NO: 548975 - DNA, 273 bp, Homo sapiens
  misc_feature (54)..(54): n is a, c, g, or t
  misc_feature (65)..(65): n is a, c, g, or t
tttcttatagcgattgatccgggaaatccgacacatcctcagcttaaccctggnagccccattancgcagctctgctgatgcagctagaccagctccgaagacaccataggaagctttggaagcacaatacactttgagaagaaatttgaaaactacagtgctacttagcaagtctcttggcattagcagatatacacggactcccaacgggtatctacccagctggagaaagaaaatcccaaccaggaaggaagaaactctccaatcttact

SEQ ID NO: 548976 - DNA, 133 bp, Homo sapiens
gctgaggtgtcaggccccgctctgggccgctgctcacagacatgcgttggtgcggaaccaagtatcgccccgctacggaggagcaagtgtcagcacatcaagaggcaggcagctcccaggcagagctctattt

SEQ ID NO: 548977 - DNA, 102 bp, Homo sapiens
tagaggatcccctctctcaacacatggccctcaaaaaagtgatgtaatcttaatgattttgcaatgtgtataggtatacttctgatacgaccagattaactg

SEQ ID NO: 548978 - DNA, 262 bp, Homo sapiens
aaatccctggggatttccccccccaactaaactatttcccttcttttaaaaaaataccccacccagattttaatggaaaatattttgccttaattggattttatgccctgattaatggaacatgggaatattgattttccggtttgggcccctgagggacccatctttggttggttttgggaaagcccctttttttaacagatacaatattgcccccacaatgggcagaaacccttttgataataaaaaattggtttttgga

SEQ ID NO: 548979 - DNA, 343 bp, Homo sapiens
cagcaatccagaggctggaaggaactgcccaaggcatgggagcacccctgcattacatgccctggatgtgaaacatggagacaaggagattattttaaagctttaagttttaatgactgccctgctgggtttcagactttcatggggcctgcatcccctttgttttgactaatttctcccatttggaatgggagcatttatccaattcttgtaccctcatggtatctaggaagtaactaacttgcttttgattttacaggcttataggccaaaacgtcttgccttgtctcagatgagactttgaactgtgggctgttgagttactgctgaaatgatttaagac

SEQ ID NO: 548980 - DNA, 169 bp, Homo sapiens
caacaagcgtgtacgtcgttcttatactcatacaaaaactcgcacacaaatgttcatagcctaccaagaaataactgtgcatgtccctaacagatgaaaggttaacaaactggtacatccacactatgaaatataactgagcataaattatctgtcaggtcatcaaaat

SEQ ID NO: 548981 - DNA, 113 bp, Homo sapiens
agtatcaaggactacattttacctcttaatagaaaagatgcggatgacaaaacacgaagtgtaaaaatattcctgacgctatgctcatatgaccaaacaaaaagctaatacta

SEQ ID NO: 548982 - DNA, 711 bp, Homo sapiens
tcagccttaagggaggattataatttggctcccaactgatggtcacttaaatgaaattttaagaaatgattaaaaagactatacttctcagctgcaaattattatggagatatgggggcacccacaggaatgaagagagaaagcagctccctaatcttcaaaaccatttgggtacctgacaacaagagctattttagagtaattaatttaataaagtaaattagtatggctgcaaatagctaaattatattttattggatttggatggtcaagagatttcccattttttttacagactggtccagtgtttggtcaagcttccgggcataaatatgtactcaaagggcatttccgcttacaattggtagaaacacaaattgcgtttcccatacagcagtgcctatatagtgactggattttctacctttcaaggtccatctttcaagggaagtaacaccaggttccacgtgttcaaggaatattcactttacctagcggcggaaaattcacacaaaaactgagatacttaatatagccattttacctggtatacctgtgtgacttggcggtctaataaatatgcctgtaagatactggaaaaggtgtgtcatgtaatgtgccaattcatgtattcttggaccctgatgggactcaaaacttgtggcaactctttttcgaccaggacttctccggtttcacgcacagttcacg

SEQ ID NO: 548983 - DNA, 1220 bp, Homo sapiens
ggccacaccaactttgccaatcccacaacctgttgcgtcgccaatgtgaacctgcatgatgctgctcctgtgggcgtttcggggattgccccctagtaccgtcaccgcttgtccgtccgttgtgctacgtttctggcctgttcgggtgttgacctttctctcgtgaatatcgttctcaacccccccttttccgttgcaaagcgcactctttcccttggctttttcactgcttctgtatcggtgtgtttgctcctctcttaactccccttttgtcgtactgtctccttgcttaaggcctgcggaaccttatctaactgagttctgtgggtttggttgtttaccgtcatgttagattccccgtctatgtgttagaaggccgactcctatgctatcctcttcctagcgggtccatattcgcgccgtcttcttaagtttggccctcttgttattcgggtgcccaatacctagccccttagctagcgtctcaaacagggaagcttggctagtggtaggatatggtggccaaaggtttttcaacaaggaacattgtgcccaatgtactagggtgctctctacctaccaagaatggctagccagacgagcgtacgggcctaaatgccatgtttaatcgatccttgcctggtatggctaaatctattcggactcctcaggcgccctgtccaacgggccttcttgtccataggacacagtaactactgtgatccattttatccttggccaaggccaggtactgcttcgtctgctacagtgactcatccatctgcattctgcacggacttggtactaaaccttcaagctcctcagatccacagtggttctgatagtgaatctttgccaatgtgaagtaaacgtcctttgacacatggacacagacacatgcaacaccacagcccaactcagttctcctacacgatgtactaaggaacaacagagttcggcagagcagagatgactagatagactcgtggagaaatcagaagggggaacagtctgtgttagttaagcgatggaacctgggaaaggccatccatttccttgccttgtatggggctctgatttgactcttgctcaagtggtatactaaccccgatggtcttcttgacatgattcttgatctgttctccactgagacacataataagtgatgatccttacaggactgacattaatcagcgctataaagtgctcatatgctctta

SEQ ID NO: 548984 - DNA, 205 bp, Homo sapiens
aaagcaaaatttttttaattttccccctaaaacctttttattttgttttattttgaaaaaaaaaccttggggcccccccttcccccttttttgtcccccaacttaaaaagaaaaaaggcttttggtttccctgggaggggggggaggaaaccaggggttacctgtaccctgcctttaaaccagttgaaaaaaagggcccccctta

SEQ ID NO: 548985 - DNA, 1233 bp, Homo sapiens
  misc_feature (1)..(1): n is a, c, g, or t
  misc_feature (266)..(266): n is a, c, g, or t
  misc_feature (269)..(270): n is a, c, g, or t
  misc_feature (273)..(273): n is a, c, g, or t
  misc_feature (275)..(276): n is a, c, g, or t
  misc_feature (278)..(278): n is a, c, g, or t
  misc_feature (286)..(286): n is a, c, g, or t
  misc_feature (335)..(335): n is a, c, g, or t
naatacaaaaattagccaggcatggtggtgtgcacctatattcccagctactcaggaggctgaggcaggagaattgcttgaacccaggaggtgaaggttgcagcgagcttagatccagcgactgcattccagcctgaggacagagtgagactctgtctctagaaaaaaaaaaaagaaaggaagatggaattagctgggtttcatggctgcttgggaggttttttgcagacaaagactccctctctcacccagactggagtgcagtngcnngancnnanctcactgnagccttgaactcctggtctacggtgatcctcctgcttcagcctaagtanctgttattggcatgagccactgcccctggctcacatggctgcttaaatggaagagttagcagttgagactgagaaacatgaaggactaggtagtatggggctcccagatagagggcagcccacaaacgagataagcagagctgccagaggggtaggaagacagccagacagtgatgtaagagagactcaagcaactcagggtttataaaaggagctaagctctctttagtcattcaccaagcatatgtattcagcagctgccctgtcccaggtactcctttggcatgaacaaaacctcccatccccatcctattggagcttgcatttttagaggggaggaggcagacatataaaataagtacagggctgggcaacatacaaaaaatttaaaaattagctgagtgggccgggcacggtggctcacacctgtaatcacagcactttgggaggccgatgtgggcagatcatgaggttaagagatcgagaccatcctggctaacacggtgaaaccctgactctactaaaaaaaaaaacaaaaaaaaataagcgaggaggatgaggctggggaccaaatgacccagaaaacacaggaacaggtcagggcagagaaaggcgagtcaacccccacaaacgaaagacttagacgcgagcccggagaatgccaccagggacgcacgctcggggaaccaagcagacacccgaccccaccggcgctactatggaacagccgagagaaacacggacacaaaagagacaagaacagggcccaataacgcgacgcaaacagacacggacacagcggcgaccaaaaacagagcaagacaccgacaagcaacagaacgaaacgcagacctcaacgagcgagccagacaaccaccatcggagcaggcaaaagcgg

SEQ ID NO: 548986 - DNA, 123 bp, Homo sapiens
cccttcaatcagtggcatgatcttcatgtgaacatctcttgccctgattgaactttgcccacatgctggaatgcccctcccaggaaaatgtactctcgaaccagcgtctgggtctcctcgctg

SEQ ID NO: 548987 - DNA, 272 bp, Homo sapiens
cagcggatccgtattggatgcggcgtatgtgggtaagaaacgtacacacttctggattgacagaaggtaacagagtggatagcaaagatgagggggaggagagggaagcatctggacagcagagtaaaataaaaggggtagaattgcaggaggctagtcatatgggggcctggaatttactcagtatattccaccccaagatcggggtcggacactaagggctcactaagaaggagtggctgcagggggtcttgactcggccgcatccaaag

SEQ ID NO: 548988 - DNA, 411 bp, Homo sapiens
agcaggaactgtcgtggaatggtacgttgtggacgtgaaacgggcggggcatccacagcaccatggtggatgtcatcgatgatgtcatgaggaggggggccatcaacataacagcccatggacggggcagcccccaggatctcttaaagggtcccggagagtcctcgggctaaggatcggtgccgcatctgtcgagcaaggtggacaatctcatcaaaggtgatatccccacggtgttcaaggtgttccggtatctttctgtctctggggggtcccttgagggcttggatgatcagggcagaggcagagggcaccacctcaatcggggcctgtctggtcctgaagggtcagttccatggtaatcctcaggcccttagggaaccaccaagagatttcccgtatggatgcaag

SEQ ID NO: 548989 - DNA, 394 bp, Homo sapiens
gctcgtactctagacgctcccccgtagtgggtccctgcctgtgcatgcggactactgcacaccaccgcgtccaactggctgcctcttcatccccctagaacgctcgagccacctcaagcgcaccgtgtagaatatcagcgtatcctttgttcacgttctttgagagagaacgtgaagatcggcgccaagctgcttcacgacgttcgccaggaccttgcagatgtcgtccaggtgtgcgcccgagcgaagaagcagaccaactacttgcgcacgctgatcaacgagctagtgaaagggatcttgcctcggagctggtcccactacacggtgcctgccggcatgaccgtcatccagtgagtgtccgacttcagcgagaggatcaaacagctgcaga

SEQ ID NO: 548990 - DNA, 1273 bp, Homo sapiens
  misc_feature (867)..(867): n is a, c, g, or t
  misc_feature (877)..(877): n is a, c, g, or t
tgcaatggctcacacctgtaatcccagcactttgggaggcagaggcaggtggatcacctgaggtctggagtttgagaccaacctggccaacatggtgaaaccctgtctctactaaaaatacaaaaattatctgggcatggtggtgggcgcctgtaatcccagctacttgggaggccgaggcaggagaatcgcttgaaccaaggagtaatcccagctacttgggaggccgaggcaggagaatcgcttgaaccaaggaggcggaggttgcagtaagccaagatcatgccatttacagcctgggcgacaagagcaaaactctgtctgccccccaccccccaaaaaaagtggtcttcaataatgagattgtgagcaatttttaaatgtcctgctttatattttagtgttttccaaatttttttcaataaaatatactattttcctagaaaaacaatttttaaaaagagagttgcttcaggttggtgaaaaaacagctaaatttatttctagtcttgtgaagcaagtatagaagtagagttagcctggaggtgaacaggcagagctggcctgaaggtgaataaacggactctacctacgtggagaggtagtcctctctgaatagcatttccgtttatgaattaattaccagcagctctccttaaatattatgatctttctcagggtagggatctttctgtgatatatgcaaaaaaaggaggaaaacatattttaatggaaggaaggaaagatgatttatgataggttttatccatctaatttagatattttaggaagaaaatcactatacagctcttattttaaatttttgaataggtaacacattcatatcactcaaaaacaaaacatgtnacagtgcttntagtgaaaagcttcccacctgctgatcctgtctcctagccaccaactgtgcaacctgttattagtttgtatgtccttctggaaacaatttattcatatataagcaaatatattttgttccctcctgtctcattttaaacactgttctgcaccttgcttttttcatttaacatcttggaggtcaatacataaacacatcttcatgttgtcaatggctgtatgctattccattatgtagatgtaccaaaattatttaaacattcccttactgatgaacattaagttatagaattaagactttgataaaacgatgtttaaatttagcttaagtattctgttcccattaagaactgcaagccttggccaggcacttgggatcacacccgtaatcccagca

SEQ ID NO: 548991 - DNA, 113 bp, Homo sapiens
  misc_feature (7)..(7): n is a, c, g, or t
cctctcngatcgacggtttctcaatgtcaggtttttcattcaactacaaaacacttaaaagtccagctcaggtgagaaacagcagcctgggtgacagagcaagacactatctc

SEQ ID NO: 548992 - DNA, 798 bp, Homo sapiens
  misc_feature (309)..(309): n is a, c, g, or t
gtccgaattgataaagaaggtgtgatagaaccagacactgatgctcctcatgaaatgggagatgaaaatgcggagataacggaggagatgatggatcaggcaagatgataaacacacagtggctgctattgaaagccctaaatgatggtgaactccaggaaagccagttgacgttatgtcacatgagtgccattcaagctgaactccatcgcgtggggtcatcttaggtagtgccaaagagggccaggtgatctgtcgatcaacagtatacagcaagaccgaaactgtctgcccatccggagtgactgntggagcagatgccagtatgaacataaattccgtgcattcagcttccacgcgccttacgaaagttgggcaggggggacaaatgcaacgaacatggacttttcctagtgctcgactgtgcgtaacgcaaggccaaggccccaatgaatctatgactcccgtgtgcactgttacaaagtatgggacttgagtgaatagaacggattggcctacgtagccacacattgcctagaaaacgccacgagcgtatccaaaccataggggcggcaccaacgtaagagacaaatattggcaaagcaaaacatgttcggcgggaagaaaaaaaggctacattggaagccgaaacaaaacccgggtgggaaaagggaaggcgggaacggtacggtgaaatctcaaatagtgcaaaaaggacaaacttacgaacaacccggaaggcttaaaatacggcaaaaaggaggcctaccgaaaggaaaaacggagggccattggacg

SEQ ID NO: 548993 - DNA, 747 bp, Homo sapiens
tgcaatggctcacacctgtaatcccagcactttgggaggcagaggcaggtggatcacctgaggtctggagtttgagaccaacctggccaacatggtgaaaccctgtctctactaaaaatacaaaaattatctgggcatggtggtgggcgcctgtaatcccagctacttgggaggccgaggcaggagaatcgcttgaaccaaggagtaatcccagctacttgggaggccgaggcaggagaatcgcttgaaccaaggaggcggaggttgcagtaagccaagatcatgccatttacagcctgggcgacaagagcaaaactctgtctgccccccaccccccaaaaaaagtggtcttcaataatgagattgtgagcaatttttaaatgtcctgctttatattttagtgttttccaaatttttttcaataaaatatactattttcctagaaaaacaatttttaaaaagagagttgcttcaggttggtgaaaaaacagctaaatttatttctagtcttgtgaagcaagtatagaagtagagttagcctggaggtgaacaggcagagctggcctgaaggtgaataaacggactctacctacgtggagaggtagtcctctctgaatagcatttccgtttatgaattaattaccagcagccttttcttaaatatcatggacctctctcaggtcacggaaccctttctgggatacaggcactacaaggcggcctatctaaatgtaagggggctgttct

SEQ ID NO: 548994 - DNA, 176 bp, Homo sapiens
tggggaaccgtgccctaggaaactctatgtgcctcgggttcagccctaaaaacaagttccaggagttcctatcatgactcagtggttaacaaatctgactaggaaccatgaggttgcagattcgatccctggctttgctcagtgggttaaggatctggcattgccgtgagctgtgg

SEQ ID NO: 548995 - DNA, 1305 bp, Homo sapiens
  misc_feature (1305)..(1305): n is a, c, g, or t
tcacaagagggggccgaaagcgaaaaaggaagctccggccccgcctaaagtctgaagccaaagcgaaggcttaagggccaagaaaggcaggtgtttgaaggggtgtccacagccacaaaaagaagaagactccgcagcgttcacccacctttcgcgggggccgaagacacgtggcgactccggagaacagcccaaattatcctcggaagagcgcctcccgagggagaaaacaaggctttgaccacttagtgctattcactcaagtttcccgggtgaccacgtggagttcgtgccaggaaagaaagaatagaagaacaacaacacacttgggtgttccagtgggtggatgtgtttaaagccaacaaagccaccgagaattaacacgaggcggggtgcacaacaaagcgtggttgtgacctttggagtggtggcccaagggtcaaccaccctgtgagatccgggccgtaagtgggagaagaaagaagaggcatagtgtttcgagagaggggcctccgggattataacgagtgcttggggggattgttgtgccaacaaaaagtggggggatccactcataagacgtggagctccaggcgtgccataaattcgtgaaataatatattatttttattattattcctttttcaccctatttaaaaacaaaaaacacaaacaaaaacacgaggagggaggagacacaaaaaggagagaggggggcggagaaaacacacagggggaataggaaagggggcgacggggccacaacaagcgggcccccgaggaccccaaggttccttgtgggaccacaagggggggaaacaatgcaggggggggcaccccataataagggaggcgagggaaaaacatcagcgaaaaaaaccccagtgtaacctcgtgtatgagatttcgctctgccaccacaaaccacaagcaaagaaccaaagcaacaaaccaaaaaacgacacatacaaacaaaacagcagaagaaaaacacaacaaagcaaagaaaaaagacagaaggcagcacgcgcaaggacaaaacgaacagagcctatacactaaagaccaacaggcaacaacctgcgataaagatgcaaggcgcagtaaaaaaaacaaacacaagaagacgaaaaaaagaccgagaaaacaagcaaaagaaaaaaaaaagaaagaaaaaaaaaaaagaaagaaaagaaaacaagagagaaggacacagagaacaacagcgagaaaagaaagaaaaagagaacaacaaaaaaccaagaagaacgaggaaagaaagaaaaaaacagagagaagaagaan

SEQ ID NO: 548996 - DNA, 349 bp, Homo sapiens
  misc_feature (77)..(77): n is a, c, g, or t
ggggaggaagaaaaaccgtcgggttttcccttttaaagtggggaacccttccaaattccaggtctgggtggacctgncccctttaagggtgcagtgaattatggtcccctggttccggaccatcctcggggttaaaaactccattgaatccgccaactggggatttttgggggcataagccccccccggggttttttttcccttatattattttgaaggggggggtttaaaaaaaaaaaaaaattttaacccttcctgggttaagggtttctgttccctgtgagtgaaaattttttcctttctccatatcccttttgttagttcttttctttattaatttttccgtgga

SEQ ID NO: 548997 - DNA, 342 bp, Homo sapiens
attttcttcttttttatttttatctaagtaatacatgtacatgacttaaacaaatcaaatgagccgggcgcggtggctcatgcctgtggtcccggcactttgggaggccgaggcaggcatatcacagggtcaggagatcgagaccatcctggccagcatgatgaaacctcatctctactgaagatgcaaaaaattggctgtgcgtggtggtgcacgcctgtggtcccggctgcttgggaggctgagacaggaggattgcttgagccttggaggtggaggttgcagtgagccgagatcgcgccgctgggctccagcctggcgacagagtgagactccgtctca

SEQ ID NO: 548998 - DNA, 348 bp, Homo sapiens
tgttttttgtggggttttaaaaataattatttttacaaattctaaaccttctcaaccttccaaaaattctgcaagtccaaagaccattattttcccctcaaccttctgccagtacacacacataatgcccctcacccccagatacctcagtgtctccagtacaaccaagcacactctctcacttcttccgagtccaaccactgaactcgagaaaattaccagtggcatcttactcacagtatatcttcagacctcatccaagtgtgcgcaaagtgtctcaacatatgtcttatatcacaaacacatcctattcagtctcatatggtgtgccctagtgtcacgcgtgcc

SEQ ID NO: 548999 - DNA, 278 bp, Homo sapiens
gttgcgaacaagtaagtgaaccatggttgtactgaagccacttagttagatacagctgatcataaccaacccgtgtgtaatatttattcccaaaaacgtagcacccttcagcaggaccctataaaactttcctccagcccttgcctctttgcaggtagccccttctctgctgagctgcccactgcaacatattttcacaatttctctaataaatctgcccttctttacctacaactatcttgataaacggctttaccacctgcaaaactgaccctagg

SEQ ID NO: 549000 - DNA, 292 bp, Homo sapiens
  misc_feature (193)..(193): n is a, c, g, or t
  misc_feature (207)..(207): n is a, c, g, or t
  misc_feature (240)..(240): n is a, c, g, or t
  misc_feature (244)..(244): n is a, c, g, or t
ggttttgggggaaacctgttttgacattcaaaaccttttttttcccgatttgaacccctggtgaataattttgcctgggtttgggtaggtttgcaggaaggaaggctgaaaaaacggacgaagattttgacttaagtgggactttgtgatttaatttttttttttttttaagtggggaggaaggggaagctanatggactaggaaanacttgattttgggggtaaagttccccagttcanatgngacatttttttaaaaaaaataaccacaaaaaaaaatgagagaaaaggt

SEQ ID NO: 549001 - DNA, 882 bp, Homo sapiens
  misc_feature (59)..(59): n is a, c, g, or t
  misc_feature (71)..(71): n is a, c, g, or t
  misc_feature (97)..(97): n is a, c, g, or t
  misc_feature (152)..(152): n is a, c, g, or t
  misc_feature (172)..(172): n is a, c, g, or t
  misc_feature (181)..(181): n is a, c, g, or t
  misc_feature (186)..(186): n is a, c, g, or t
  misc_feature (190)..(190): n is a, c, g, or t
  misc_feature (203)..(203): n is a, c, g, or t
  misc_feature (207)..(207): n is a, c, g, or t
  misc_feature (225)..(225): n is a, c, g, or t
  misc_feature (255)..(255): n is a, c, g, or t
  misc_feature (271)..(271): n is a, c, g, or t
  misc_feature (307)..(307): n is a, c, g, or t
  misc_feature (319)..(319): n is a, c, g, or t
  misc_feature (324)..(324): n is a, c, g, or t
  misc_feature (330)..(330): n is a, c, g, or t
  misc_feature (336)..(336): n is a, c, g, or t
  misc_feature (339)..(339): n is a, c, g, or t
  misc_feature (341)..(341): n is a, c, g, or t
  misc_feature (370)..(370): n is a, c, g, or t
  misc_feature (375)..(375): n is a, c, g, or t
  misc_feature (424)..(424): n is a, c, g, or t
  misc_feature (427)..(427): n is a, c, g, or t
  misc_feature (443)..(443): n is a, c, g, or t
  misc_feature (447)..(447): n is a, c, g, or t
  misc_feature (452)..(452): n is a, c, g, or t
  misc_feature (585)..(585): n is a, c, g, or t
  misc_feature (770)..(770): n is a, c, g, or t
  misc_feature (845)..(845): n is a, c, g, or t
ttctccataaatgaaagcttttaagaaaaaggcacgttttccttgaattaggtaagatntagcttccccantcatgttctcccttcccttttttttnggagcagcccctattgggaactcgtattggtaccccagaatacatttcagcaaanttaaccatttagtttccctnacccctctncccgnttcnccagcagctaggntganggcaacatattcctcacngggtcatttgatcttgaggtccttcaaggntgactccaagctcttnttatcccagatactcatgccgccatccatgccagtngtgcagaactgngagcncttggncttgcngcngntgagcaccgagatctggctgacgctgttnttgtncagcgagtttaggcccgcgcccgcagccgtgccaccctcggggctcgcnttnttgtccaggttctggnagcnctcgngggcggtcaagccacgctgcgagctctgcttaggaacgtccagccgcccgccgaagctcagcatccccgcggcggcgtcataggtgaacagcaccgggaagcagttgtggcccgctgccaccaggctgttgtntgtgatgaaggtcagcgccacagttggtagtgtttcagaggccagagtcgcgacggccatcttcttgtcggcatcagccaggcagacggtgctgtcgtggcttacccaggccacgcggctcccgctggctgagaaacagacgccatgtacccagccgcagctactgctggattcgaacatcagtnccccaaagggcatcttgggagccccacggggtgggtgccggccgttcctccacttctttgatgtaggctggaaanatccgaacatttgaagtcacaggagcgggcagccagc

SEQ ID NO: 549002 - DNA, 141 bp, Homo sapiens
ttcccccccttttttttggggggggggggggggccccccctttttttcccaaagaatttcccccccgggggggggcccgtttgggcccctttaaaaaggggttttttttttttttttaaatttttttttgccccggtttta

SEQ ID NO: 549003 - DNA, 432 bp, Homo sapiens
atggcagagtatgggagagagaaatttggaaagctacataagcatcctgccatgtagaaaagaggtctcaggcctggattttggttaaaactatgtatgtgtttttttaatttagttgcccaaagttgaaaagtaaaagatatcatataaaaacctctgggttttgaaaaaattttaaaagtttggcaaccaatggccctgtatttttaatggggcaacaatcagctggatttaccccctttagacaagacctgtgacctcatgttcacccctgccccaaccgttttttcaattcattcattttgcctatttggcctctatatgcatttgaatttttagttcctaatttagggccctattgggtatggctttttaaaagtggaattttatcataaaataaaggatagcccctggcatttttttagccaggga

SEQ ID NO: 549004 - DNA, 1052 bp, Homo sapiens
tgggctctagaagggggtaaagggggtgctatagggtaaatacgggccctatttcaaaaattttaaggggaattatttctaggacagatggggcttagaaactggtgtgtttggctccacagatttcaagagctttggaccggtagtatacccccggcgtcgtgtacgcgggtagaaatgtggtttgggttataacactgtcccggagaatcggcatctggttttataacgcctaatggtggggacacgctcatgagtgcaaagacggtctgggagatggtcaattattaatacagaattggggggcttacaatctcgggagagtacatactcagaatggtcaacggtcaagggattccgcaggtcgccgggtccctaggaaataagggggaggagtatttgtagagaagtgggaaaatttatgtccggccgatatctcgggtgtgtactccgtaagggttccatgtcaccccttggtggtggcgccaatttggatttggatggtgtacacgcggacggggcatctgttggaccctccggtcgggtatatgtgtaacagggatcgcgtaagggagattgggaacgcgcgcgtagtgagacgggacatagagattgaatggcccgggcaagagcattagttctccagaaagcgggctttcaataatgttcccctgaagccgtttcgggagaaactttccaggatcataaggtgcaagttgcggggtcgtcagaacggtgtttagcgaacaggggggcctatacccagggaatactacgagaacgcccaaaatcagaggcaaccacgcgcactacctagcgacagggccgcatcacccccctgcaaacacgggcggaccaacggcctcctgtcctaaacggaatcagcaggcaacaagcaacgcccggcactccgcacacccccacaacccctcgcggcccgcacctccgggcaacaggctctggcctccccaggcagaaccccggcctggcactcccagaactagacgccggggacacaccctgtgcccccgtgtctccaccagagacagaca

SEQ ID NO: 549005 - DNA, 299 bp, Homo sapiens
ccgggggccctttttaaaaagctggccttttctgagcgggggttggataaagcccgcctggcaggcaaggagctgcgcttccccaaggaaaagaaaaatatttttgtggtggctgctgggcagttgggcaatatgcatttttccaactgttgggcatccccccccataactccccgggctttccccacccttttttttatgtcccctttttaagatttaggatgattttttggccaaactttttcatttttatcctttaaaaaatatatatgggtataatttttccccctagattccta

SEQ ID NO: 549006 - DNA, 619 bp, Homo sapiens
gcatgagaagatctggttcgacagagttctagatatgacgacgcagaaaggatgtattctacggaggcagatgaacgggcctgtggtcaggctgcgctcccgccaggagaacggcgccagcgtgatcctccgttgaggtattgcgagcagcccatataggaacatcgcagtagaactcctctggactggtaagcatcagagcgcccgtggggcctccagtcggtgcaccatgccggtgaggaacacgagatgacgctcgttcagtccggcattgccagatctggcacgttggacgaacgcagtagctctgtcgtggcgtgtgtacatgtgagctgcatgcaggccgatctccaatgtctggagagcccagtgcagtgaaccgtagctggagatacgatgctctgccatggccaacacgaggccacgagcgcccagcagaacccagcactgtatctcccattgacgtccaatgtggagccccctagccaagaatgccagaccaacaccaggcagaaggaatgacgacggactgatgaccattgacctgctatggcagtgacgatgaggacggaggaccacggaggcggcacagcctgcgtcgaccgagcggctacaggca

SEQ ID NO: 549007 - DNA, 1149 bp, Homo sapiens
tttttcgtttttttctttgtttcctcttctgcttttcttcctcttctcttttttcttcttctttctttcttttgtttttttcttttttgttttcttttctcctcttttgttgtctcttctttctttttttctttttcctttttctccttcttttcgttctcttttttttcttttcttttgttctttgtttctctctactcgttctccctccctcccccttttttctttctttttttcttctcttttcttgtccttcttttcttttctttcttctttgtctcttccttgctttctctttttcttgtttccctttctcttccttcctcttgctttccctctttctttctctctctttttcctttttcttcttttcttcttctccttttcgtccttttttttctttttttctttccctttttctttttttttttcttcctctcttgtttttttctcctttttgtcctttctttcctttttcctctctttctttctttgtttgttcctctcttttttttttcgttttttttttttttttcttcttcttgttgtactttttcttcttattttcttttagtgtatggccgcccgcggcgggggtttctaataaattccagtgttctctttttgttgtgccccctctatttttttctccttgttagtccctctctacccccttttttggttccccctccttggtttagttccccgcgggggtccaattacaccctttctggtttttttattccttttgtgtccctttggggccgtggttatacattgttttcctcccggatgacccttttttgtcctttttgcgccttttttgggtgccccctatagtgaacacgtgttgtcccaaaaaacagccggtttgttatccccgttccggtattttccgcggatatattttgtccaccccggtgttccccccccgggccgcgcggtattttttggttccggcgcgcccccccctctttttttttttttttttttttttttttttttttttttttttttttaccattttgaggttctttcgtgttaaacggagaagctattatattttgttaagaaagtggggagaaaaaaacccagaggcccccgtgcctttgtaaagaaaccaaataaagtttgtactttgctttttta

SEQ ID NO: 549008 - DNA, 142 bp, Homo sapiens
tactccggggacgattgttaacgacggactagctacttacgaacggacttactggactgcggttgcttgcgtgacggacctaccttgactggcagacttctgtggaaccgagggttacttttatttggttagaccctggaac

SEQ ID NO: 549009 - DNA, 383 bp, Homo sapiens
gtgttagcgtactcctatctttcattgacatgggaggcatatcagaatcttaatttataacatataccaggattatatatggtcgccccagatagtaattcccggaaactacaaaaagtgtcaagatccataattcgcgacatcaaatgcttttctagctcgtctcaattcttcattcatagtaagcaagtctttaaccctggcacacttccttgggtcctttcgaatcaaaaagacgatatcttcaacttgtactcgaccttgtataccaattgatattgccttgtgagtcatttcagtgataaactctatgacaagatcttcaagaatatccactgactcagaataaggattctggtcatccccaaagccatacatcatac

SEQ ID NO: 549010 - DNA, 285 bp, Homo sapiens
caactatttgaggtgaggcatgagaaccaattgaaacccgataggtagaggttgcagtgagctgagatggcaccactgcactcctgggtgacagagcaacagagcgactctgtctcagaaaaaaaaaaaaaaaaccctaagctgggcgtgggggaggggccctgtaagtcccagttactcgggataactgaggcagaaaaatggcctgaaacccaggaggcggattagatcctaaaggaaccagaagacacccctataactacataccctatcatcttgttattc

SEQ ID NO: 549011 - DNA, 215 bp, Homo sapiens
acagagtcgtgacacgcggatgtttataaattccaataacgaaaacaacagattcacaaggtacaagttattagctcttggttaactcatgatacaaactacactatgaagaaatgactggagatatttgagaaagaatttttaatgcttccgggaacttttcattggtatctttatatcgaaggtcacatccagaaatacttagagtggttatc

SEQ ID NO: 549012 - DNA, 155 bp, Homo sapiens
caggagttgtagggttacccctttgacaagcttccatagttttcaaacacgcacattgatggcatccctacagtttttttcacttgaactttgtaaaacggcaaatggaccggtaatcaacttttgatattttttaataaaggcgttgaaaatca

SEQ ID NO: 549013 - DNA, 106 bp, Homo sapiens
tgaagacagaggaagaggaagtggagagggaggggggaatggccaagcggagagaaaggtaaaaaaaggtggaataaacagagggagacggaatataagcaaatca

SEQ ID NO: 549014 - DNA, 188 bp, Homo sapiens
tgtatgccctgtcttgatctgtctagctgacacagtcttgacaagcaggactcatagatgttatgactgtgatacataatatgttatctagaaatgacgattctatatatgatagccatcacggtgacatgatctagatataatctatgtgacagagtagtgcagctagactgagctgagccattcta

SEQ ID NO: 549015 - DNA, 147 bp, Homo sapiens
  misc_feature (81)..(81): n is a, c, g, or t
tgaaatatacgctaggacagctggtgggaatggcgaggctgatacataggctggtgggagtacaggactcgcctctcaggntccctgtgctgccacttttcagccaatgggccaagcaaggttgaacatgcagttatcgtgccaaag

SEQ ID NO: 549016 - DNA, 193 bp, Homo sapiens
cggccggaatcccgggtcgaccacgcgtccgggaggattgattgacaccacgagtttgagaccaccctgtgccacatagcaagaccctttctgtactcctcactacttggaggctgatgcataaagatcacttgtgcccaagagttcaaggttacactattccagcctgagtgacagagtgagaccgtgtctc

SEQ ID NO: 549017 - DNA, 855 bp, Homo sapiens
  misc_feature (536)..(536): n is a, c, g, or t
agaactaagtctccacacctaaggctaactacagaaaccaggttggtgctagggacttaaccttggtaggggcacctatatattacctcttggtatctttaacgggacacacttcacgttggctggtctggaaaggtaattaatcctacccaaatcacaatctcctgtgctaaataaatttggttattggtaaggggcaggtgtggctcactggggaaagaggccttctaggtttggtagtatctttaacaaatgttactattagcactaatttgttgttaatataacaatggaacacgagctaatatccgtataagagtataacatttcacggtaacttgtcacaatggcacgacattaactcaattattgtaactaatattaacttcacttaactcaattaagaagaatctattaatgcttctaagtatgaatataaaaatttgggcacgggcggtataaattctggtagcacttccacggaaagtgttagcaagacttgccaagttggagtcttgctctactatgacaaaatncttactatgacttacgaatctttcacccacagctgggaaaggaaaggttgagagaatattttaatatgaaggcaaaatgagggtatttaacttttggctggtttttaaaaaaggtggcacgggacggattgaagaggccattaactctggtatttatggatggaattaggacataaccaatttacagggagaggttatagggtaattaaacggaactgggtctaggtttcccaaacaaggaggaattaaaccaaaaccccaagggatttttggacgggaacaaccttttcccagggggcatctccggcccttttccctc

SEQ ID NO: 549018 - DNA, 170 bp, Homo sapiens
agccgtgtagcacgctcctatgtggaaatgcacaactaaagttcacgtcaggtcctaggaagggcatactgttgagtctagccatcaaaacagttttcccctccaagaattcctaacatggtttcaagttttttaaccattccattaaagcttttactgtaagtatgcca

SEQ ID NO: 549019 - DNA, 350 bp, Homo sapiens
ttatagaggctactagcttcaccaccagcggaactagcgggaaatcgtgcgcgacataaagggagaaagctgtgcgtacgtcgccctggacttcgatgcaggagatggccaccgaccggcatcctcctctgtctctgcgatgaagaagctagctagcatgcccggatggtcagagtcatcaccgatggggaagtgagctggttccggatgtcctggaggcgctgttccagaccttccttcctgggatatggaatcttgcgcgcatacacgagtaccagcttgcaactccatcatggatgtgtgacgtggacatccgcaaagacctgtacaccaacacggtgctgtcgggc

SEQ ID NO: 549020 - DNA, 278 bp, Homo sapiens
gtccattatttcttctttattgagtgtggttgctttgtttttagacaggatcttgctcctgttacccaggctggagtgcagtggtgcaaccactcacaacgttgcagccaccacctcccaggcttaagcaatgctgtcaccttagcctcctgggtagctgagactacaggcatgcaccaccatgcccagttttttttgtttttgttttttttaatttttttttttattgatcattcttgggtgtttctcgcagagggggatttggcagggtcatagga

SEQ ID NO: 549021 - DNA, 241 bp, Homo sapiens
tcacttcagatcaggagttcaagacaagcctgggaccttgtctctgccaaaaataaaaaacaaaaatagccaggtgtggtggtgcacacctgtggtcctagctactcaggaggctgaggtgggaggttctcttgggcccaggaatttgaggctgcagtgaactgtgatcgtcccactgcactctagcctgagtgacagagtgagaccctgtcttaaaaaagaaaagcacaaaccataatat

SEQ ID NO: 549022 - DNA, 418 bp, Homo sapiens
accctctgcgtcgcattacagctacaccaaaaagtagtttaacattttatttaaaaactaaacatgcaactaccatgtgacccagcaaatgcattcctggatatttatcccagaggaataaaaacacagccacatgaaagccttcacctgagtatttatagcaactttattcataatggctccagaatgaaaacaaccaagatgtccttcaatgggtaaatggttaaacaaattgtgggatatccaaaccatggaatactatttatcagtaaaaagacataaactattaacccacacaatagactctctgcatgaatctcaggagaattatgctgagttttttttaaaagccaattccaaaaggtgacatactataattccgtttatataagattcttcaaatgccagaattatagaa

SEQ ID NO: 549023 - DNA, 125 bp, Homo sapiens
tagcttgggtgtcctccacttcagtttggatactatctacctagaaatagcatcaaatcccacagatggagggctcagtcccacatgactattccccgtcttgccgctatcagtggtaattctgg

SEQ ID NO: 549024 - DNA, 146 bp, Homo sapiens
  misc_feature (16)..(16): n is a, c, g, or t
caggaccaacttggancctgagcttgtggagaccagacagcaggagatagaacttccagaagtgggcagctgtggtggtgccttctggagaagagcagagatacacatgccatgtacagcatgaggggctgccgaacgccctcacc

SEQ ID NO: 549025 - DNA, 130 bp, Homo sapiens
agcacttcctaccaacttctcatgaagcagccatatatgcaatcttcttgttgatgaaacatctctgttctgatcaatcatgtttgaagggctctttgaactcctggatctgtgactgggtccaacatag

SEQ ID NO: 549026 - DNA, 111 bp, Homo sapiens
cagacgactctagaggaccccacatattcgttaactatggatggggacagagcaaaggagcagagttaagtgtatgctattagacacttctcaaaactagcggggtaccga

SEQ ID NO: 549027 - DNA, 348 bp, Homo sapiens
  misc_feature (45)..(45): n is a, c, g, or t
ccttgcgtgaaatggctgcggtactagaaggcatggtccgtcatntgacatgtcgtcagatggcatggtggtcgcgatatgacggcacgtatctaggtcataaccagcgtagaggagaaccgtcacctctgttgagcgtgtggccaatagggatccataatgcgtgcaaagtgtgattcggcacgtcgtgggtggaacctggctgatgatggcctggtggacgcgtccagatggtgtccggtccgcggagagccatgtctgtctgcggtggtgtgcgacggcggtgcgtggggacatccagggcagttgtccggtcaccatggtcgtcagttcttgaacaatcagagg

SEQ ID NO: 549028 - DNA, 348 bp, Homo sapiens
agcggaagataccttatcgtgcagaagatacgtcaagatcacctctccttccggtgccagcagcttcccccgttcaactggccagcgagaggactattcgcagaaggacgggccgggaggccaaaaagacggtgtgttttacacgcagctgactcagagcgcccgcccgtgtgccgtcccagacgctgcctgcagcccacatcggagtccacacctccgtagctgcctcgcgtagtggagccacaatgaagcacagatagttccttaagccaatacagaataggcagccccaattgcagcgtgttcccattagcgtggagccatggcaggtgatcttctggcacgcat

SEQ ID NO: 549029 - DNA, 862 bp, Homo sapiens
  misc_feature (608)..(608): n is a, c, g, or t
ggtgacacaaaaaaattaatcattccatgcttatggattggaagggtcaatattattataatggtcaaactgcctaaagcaatttacagattcaatgctattcctattaaactacatatgtcatttttcaaagacttagaaaaaattattctaaaattcatatgaaaccaaaaaagagcctgaatagagaaaaaattattctaaaattcatatgaaaccaaaaaaagaccctgaatagagaaaaaattattctaaaattcatatgaaaccaaaaaagagcctgaatagtcaaagcaaattctaagctaaaggaataaagctggaggcatcacattacctgacttcaaactatactaaaaggctacagtaactgaaacaacctagtagaggtccaaaaacagacacatagaccagtggaacagaatacagaatgcagaaataaggcttcacacctacagctttctgatcttccccaaagttgataaaaataagcagtgaggaaagaactctctattcaattaagtggtgctgggagagctagctagccatatgcgaaagaatgaactggactgctaactagcacgtatacaaaattactctaaatgatnaagattactgtagattcaactatagaatctatgagaaactaagaaatgcttctcatttggctggcgatattttgctagtcccaaagatgaccaacacaatggcagtggctattataaagtttggcgaataatttcaggtgaagaactccggggggaattggactgtttgaaggttttggccaggtttaacccaaaaccttagagaggtttccaatagaaagagttttgggaacccactaaaagcgcagttgaga

SEQ ID NO: 549030 - DNA, 447 bp, Homo sapiens
  misc_feature (34)..(34): n is a, c, g, or t
  misc_feature (136)..(136): n is a, c, g, or t
aagcgcaacatccccgcagctgctcatcaggtangagtgcttccatatccatttaccccccattggcaatttgaaagggccatccagacccccataggatccccatggaacccccaaagggctttccaaaagttgnctactcccaaggtggtccccaagccgggccatttctttaaccccataaaagcaaaaaaggtgggctcccggttttccccaaggtgggccctgtttgtcatacaaaggaatccaaaacgaatccccccccgtcccaaaaaacagctgaaaaaatgctctgtaaattgagttgctggaggagtgccacccaggagccctgacttcccttcctttggtccagtttttctttgaaacaggggggattccaaaacgggcccagtccattgcaggtagttaagcccccttttaaaaataaaggcctttttttttcta

SEQ ID NO: 549031 - DNA, 680 bp, Homo sapiens
  misc_feature (36)..(36): n is a, c, g, or t
agtggtacccgcgtgcgtagtgggaggaccacaaanaggcttttggaactggcaattgcacctaaacatggagcaccttctcacctaataaagatatagataggtttattttgcagagtcctccccgttcccaggcccccgccctgcagttaccactgctctgataaacaggttggcacttgtaccctcgcaggggttttgttgaacaggtgtcttttgtgggctggagcagccgagccacacagcactgataggtatcaggtccaagagcagcctgggcaccctgatgggcctgaactaggctcactgcaggtttgacctcagaagggtggctaacaattcctacctcacagagccgatagatgaggggacaggactaacagaaggtggtgtctgtcctgagtcgtctaaagtttagcaaggaggtagaccatggccagaatcgtagtcagtgctcagagggggctggtgtctgtttgactgagacaccatgaacagagcagcaaattcgagctatgtttactgcagcggtaactgctgtactcaccaaaacagtctgtagggccagcaatcacagtagaatatactgtttgcacagttacagggttaagagaccccagataaggtgatcctgtttagcaatgtagtagtgagaaatttgtttatttcctttggattaa

SEQ ID NO: 549032 - DNA, 750 bp, Homo sapiens
  misc_feature (1)..(1): n is a, c, g, or t
  misc_feature (3)..(3): n is a, c, g, or t
  misc_feature (5)..(5): n is a, c, g, or t
  misc_feature (38)..(38): n is a, c, g, or t
  misc_feature (135)..(135): n is a, c, g, or t
  misc_feature (142)..(142): n is a, c, g, or t
  misc_feature (159)..(159): n is a, c, g, or t
  misc_feature (216)..(216): n is a, c, g, or t
  misc_feature (218)..(218): n is a, c, g, or t
  misc_feature (271)..(271): n is a, c, g, or t
  misc_feature (287)..(287): n is a, c, g, or t
  misc_feature (306)..(306): n is a, c, g, or t
  misc_feature (308)..(308): n is a, c, g, or t
  misc_feature (343)..(343): n is a, c, g, or t
  misc_feature (352)..(352): n is a, c, g, or t
  misc_feature (390)..(390): n is a, c, g, or t
  misc_feature (394)..(394): n is a, c, g, or t
  misc_feature (419)..(421): n is a, c, g, or t
  misc_feature (423)..(424): n is a, c, g, or t
  misc_feature (427)..(427): n is a, c, g, or t
  misc_feature (433)..(433): n is a, c, g, or t
  misc_feature (452)..(452): n is a, c, g, or t
  misc_feature (458)..(458): n is a, c, g, or t
  misc_feature (481)..(481): n is a, c, g, or t
  misc_feature (521)..(521): n is a, c, g, or t
  misc_feature (552)..(552): n is a, c, g, or t
  misc_feature (576)..(576): n is a, c, g, or t
  misc_feature (612)..(612): n is a, c, g, or t
  misc_feature (632)..(632): n is a, c, g, or t
  misc_feature (641)..(641): n is a, c, g, or t
  misc_feature (661)..(661): n is a, c, g, or t
  misc_feature (665)..(665): n is a, c, g, or t
  misc_feature (715)..(715): n is a, c, g, or t
nananttgaccatcaggtatattggggaagggagaaanggaggcaccttcatgagttcctcccaagggcagtagcctctgcaacttgctgggggttcaggggaagcagggagttcatggggctcctccagcaaanatgagcnccagggctgcttggatntccccaccggtggcctgcagggcccgcaggctcagctcatcgtcctggatgcccatntnacgtagctgctgcagctggggctgccactggctctgaaggctgggctgcccanaggcctgaagggcatnctgtagggcttggctgaananatcattggtgatgggcgtcccttactggacaccanaggacattngtgaggtccctgaggaatgaccctgggtgccaggagtnggtntgtgaaaactgctctccggagttcnnncnnggncaaggnggtggccagctcactcttngttatnggccggggccaacagctccactntaccccagggaggctgggcgggagctgggagttctgctanagggtgtggacctggtgtttgggtgaaagtnatcctcatcatctgagagcccttnaaacaggaagccacctggcatatcccggtatgagcnggagggcatgctccgggaanaggagttanttccaggcattggggcactncctnctacggagtgcagaaccaggacaatggcatttacgagggctgggtgagcnggcaccaacgtatcaagcatattgggatcagcgaa

SEQ ID NO: 549033 - DNA, 868 bp, Homo sapiens
cagcgtttgggtcaggggtcctatagttcgctgctatgaagatgcatctccatgtccgcgtgcccatcctcccttagctgttgcaatgtcttggactaataattgcaacacgtgttctttcttggcccccttcgggtgcatctctatacgtggtcactcacaatgcgtcgaagcagtagagatattgctcctcacactgtctcccctctcgaagagaaggcaacgcatatgtaggatatgcgctgagactatgccaaagatggataagcacaagaattctttgccatttgtcatgttagtgccttctattttaataaagtgcggcaatggggatagaggttctgcattacctgggagtcattagaccctcatctctgctgtgaccactcgcgaatggcatagtcatatacgacctactgtcgaccagagaccagggcatgatcagattaccacgtggtcatgccagttcgatactgcaagcaacacaaaagcgcgccatcgccaatctgtgacttcgatacaagatctcctcaaatgtaacacacactgtcaagcggcaggtgccccaaagtctaccgatgagccatatgagtgagctaaatagcgttggaaaccagaaagtcacatcatgtcaaggctgtgcgtgacaagccaaaagcacagttggcgaagaataccacacatacagaactccttgtagaatgtgcacctcccaaattggccattggctcacgcagaagaagccacctacttcgccaggccataaaagctcctctccggtaagtccctcctcttcggacttccacagcgatcgtaaagttgaaacttcctccaatgttcaatcactaggattcttctcgtccatgga

SEQ ID NO: 549034 - DNA, 245 bp, Homo sapiens
ctagaatccaggaaacacagcactggatgctcaaaaacagatactcttcctacacaagactgttctctaatctttcaggtgccgaacttattaaaactagacaaaggaggattaagttacaaatatagtggtgcagccgatggaattcggctctataattcactgaagtccagggcaggcccagatatgatgcatgcactgatgaggtgcagcaggtaagactgtaagactaggtaaagaactgc

SEQ ID NO: 549035 - DNA, 483 bp, Homo sapiens
tgccaaattcagtggggactcagtgcccagccctggccacgagctttggccttggtctacctgccaggccaggcaaagcgcctttacacaggcctcggaaaacaatggagtgagcacaagatgccctgtgcagctgcccgaggtctcgcccacccggccggatttgatccccccaagtcttacaggactgcatcgggtttctgcgcccttttctccagcctaaatgacatcatctatggactgagccgccactctctgccgaagtggcgcagctgtgcccccagctgcccccacccctcacaggtccctcagattataggtgcccaggctgaggtgaagagcctggggccctgcttccggcgctcctggaccctgggcaaaacctgtgacccttttctactggaatagaaatgagtttatcatctttaaaaataattcactcttgaagtaataaacgtttaaaaaaatgggaaaaaaaaaaaa

SEQ ID NO: 549036 - DNA, 447 bp, Homo sapiens
  misc_feature (14)..(14): n is a, c, g, or t
  misc_feature (39)..(40): n is a, c, g, or t
  misc_feature (321)..(321): n is a, c, g, or t
  misc_feature (438)..(438): n is a, c, g, or t
accctaaaacctantaccttttctctctaggaaaatccnnaaggtcctaaacttgacttttttgaaggtcttcctcaacttgaactacagttgtgcctcataattgtcccttgccctttcccagcttaattattttaaggaacaaatgaaaactctgggctgggtggagtggctcatacctgtaatcccagcactttgggaggctacggtgggcagatcatctgaggcccaggagttcgagacctgcctggccaacatggcaacaccccgtctctaataaaaatataaaaattagcctggcatggtagatgcgcctatagncccagctgctcaggaggctgaggcatgagaatcgcttgaacctaggaggtggaggttgcattcaactgagatcataccacttcattccagcctgggtgacagagcaagactctgtcncaaaaaaaa

SEQ ID NO: 549037 - DNA, 416 bp, Homo sapiens
atattaggttttttttttcccttttggaacatggattttgggacattagcagtagccttattttaatgctttatgtcctaaacatactaataaaaatgaaaagacgcaaaaagagcctttcggaaaactgaaggactagttttaaaaatgagactttcagcccaccatttataaaaaaaattttaagggccctcctggttttaggtatttaaaggtgatgttgttcaaatgggtaaatggacaaaaaaaaaattttaaagtaaacttggaactttggatataactaaaaaaaactagattataaaattagtcgggaacccctggtaatggacattggcattcatttcctttttcctcctaaggggaaggatgtgttttaaaatttttgttttttccattaaaactgggaaccttga

SEQ ID NO: 549038 - DNA, 1097 bp, Homo sapiens
ttgtctctcaaacaaggtggttgtcctccccttcaccttggggggggggggtttgccccctcctgcccccccccacattttgttggtagccgattttttgtgccccccgctttctcccgggcgggtttctttgagaagaccgctccctccacatagtggtgggggtgtgccccttcagtagcacagggtgttcttcatctccgcccggcgggtcatcctcatcagtggtgcgcacccccctctaatatatggcgcgccttcctcctttatagagagggcgcaccgcggggctatatcgtcctgtggtgggagacactctctgaaaggggccacccgcgcgttttttttttgcaccagagcccgtgggagacagcacatgttttttgcgagacgccccagaggggtggtttgtgcgcgttttctcccccacggagcgcgcgccctcgtattttatacccctctcgactgttctttcttgtcgcgtgtattaccgcgcggagccgcggggcaccaccccctctgggcgcgaggcggagggacccccccgcggggccgcgcttcgcgtatatccgccttggggcgagaattcttctgtgacacgggccgcgggggggccactctacaggggcacgcgcgcaactatcccgcgagagcatcgatctgcgctctggagaggggcgccccgaaacagcgctggaatcccccgctggtgtggacacccgcccccgagagaacaagagggtgtacgcggcctctctttgtgtgaaaaaagcagagagcagcttgggtttcgccgccctgtgccagctcccgagagggcggcagaagaggtgtttacacatcccaccataccagatcgctaccccacgatgataggtggtgacattttcgcagagagagggagcaccctttttggggccccgatggagtgggggtgagagggaaaatataagatggcctggtgcgaagatgggggaaaatttggggccccgaacccccgaggccccccggccagtggggaaaaattaggggactttttgtgtgaaatgatttttggtgaccccgaatgggaaaaaaaaaaatggaaacctttctca

SEQ ID NO: 549039 - DNA, 308 bp, Homo sapiens
  misc_feature (27)..(27): n is a, c, g, or t
gtcaaatccagcctgccacctattttnataataaagttctattggaacacagccatgcccattaatttacaaattgtctctggatgcttttgtgcattgacggcagagctgagtagttgtatcagagacttgaaaactcgaatatggctcaaaagcttaaaatatgtacagaaatattttgccagcactgattttaaaaactgtacagtgatcaaacctggccgttttatcacaaaacaatttttatatttccagtacgtgatggttcaagacatgctctctccatcccccatgggacggcctgaagg

SEQ ID NO: 549040 - DNA, 370 bp, Homo sapiens
agacaacaaagagcatgtcagtatagagacactgtcaagattaagttataccagcaaaagtgcttactaatgtcacgtgataacctggtcaatataggtgagactactaagatcataatcatccttttattaaaaaaaagaatgtaagaaagatggatttgatcacactcaccatttaatcatttccagcaaaagtatatgtttggctgaaattatgtcaaatggatgtaatatagggtttgtttgctgcttttgatggctacgttttggagagagcaatcttgctgtgaaacagtgtggatgtcaattttgataaggctgactcttactaaccaccatttcccctgtggtttgttatcagtacaattct

SEQ ID NO: 549041 - DNA, 80 bp, Homo sapiens
aaccgcagataagtttttttctcatttgacaagatagagcattaatacaactacttaaaaaatagtccgtcaataggtta

SEQ ID NO: 549042 - DNA, 175 bp, Homo sapiens
tgggggtcctccagggagttgacccaaaggtggaggccacggaggcagggtttttggggactgtcggggggtacaaagggaaaaggctttgcaaaagctccctggcaaaacccccttggggaattgctttgtgtgggacagggaggaagtttcaataaagcagcaccaaggttca

SEQ ID NO: 549043 - DNA, 109 bp, Homo sapiens
  misc_feature (22)..(22): n is a, c, g, or t
  misc_feature (29)..(29): n is a, c, g, or t
  misc_feature (64)..(64): n is a, c, g, or t
tcatgctctggttgtttctgtnccaaatnattccatccacctttcccaatcggccttacttctnactaatttgtaggaaaaagcaagttcgtctgttgtgcgaataact

SEQ ID NO: 549044 - DNA, 289 bp, Homo sapiens
taagtagaagatcaatctcttaaggaatcatattcctataggtctctcgaacgacgtatcatactataataacagagaacatactgcattacttaacagacaagctccacgtttactagcccactaacaatactttataggaaacagaaattgccgtttacatgctaaaaatatttctatcattgatatcacatatgactttgacaactatacaactaaactgatctgtggaatttttcacggcgtcatttttataattatgtgttctcacctatactgtccaaatgtg

SEQ ID NO: 549045 - DNA, 134 bp, Homo sapiens
ccttaccccatgcacgttcgggtcctggatggctaggcagctggacgagaacgcccagaagatccagcgtcgggcagacttcccagccaaatatgttgatggaccaatgaattctccagagaagctcgagcatg

SEQ ID NO: 549046 - DNA, 215 bp, Homo sapiens
ctaattctgccccatggtacagatttgtgtgtgatgaaaacctatgctttaagttctagagagcatgtttaggaatacctttcacctatttcagaaggtactttaaaattggacctgggagtcatgacagagcttcctggaacaaccaagcatctttctccatccttgcaatagtagttgacttctgaagtaccagaaacagattttctaaaata

SEQ ID NO: 549047 - DNA, 438 bp, Homo sapiens
accggcatacccaggacatgttcacttaatctctctgaagctcattctcctcatctagtaaatatggacataataccacctgcacctcacagagtgcctgggagaattaagtgagaagtatggcacaatgcttgcaaagcagtacaagagagatgctatgattccagaacggcatgctgattcattcagtacacatatgctatgagccaattatggcatacagcttctcaccctgagtccaatcagaggagcatgaagcacatggagagactgtcaggaagtcagtgccaatgggcacgttattgtcgctaatggagagggggcagacagtcctcagaggtacaggaactctttcaagccaaacatttccaattcccaattatatccacccctcaccagaagcattcgagatgtcagtcttgtccttagggactaggg

SEQ ID NO: 549048 - DNA, 131 bp, Homo sapiens
gcaggttaacaatcacagcgaaacgaagatacctggcgcgtttgtcccacagccgtcgacgcaatatcctgacgcaaactgcgcagccgagaagcgttcggaggtaggaagtcctggtacactggcgatgc

SEQ ID NO: 549049 - DNA, 1557 bp, Homo sapiens
  misc_feature (23)..(23): n is a, c, g, or t
agcggatagaaagtgagcttctngacaagtgccaaaatggcgatgcctaccacctagaactggattgtgcgctccatttctttcacctcaaagctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagatggtgtcctactcttctgtcctcacagccatcagtaagtttgatgacttttctcgggacctgtgtgtccaggcattgctggacatcatggacatgttttgtgaccgtctgagctgtcacggcaaagcagaggaatgcatcggactgtgccgagcccttcttagcgccctccactggctgctgcgctgcacggcagcctctgcagagcggctgcgggaggggctggaggccggcactccagccgctggggagaagcagcttgccatgtgccttcagcgcctggagaaaaccctcagcagcaccaagaaccgggccctgctgcacatcgccaaactagaggaggcctcattgcacacatcccagggacttgggcagggtggcacccgagccaatcaaccaacagcttcttggactgccatcgagcattctctcttgaaacttggagagatcctggccaatctcagcaacccgcagctccggagtcaggccgagcagtgtggcaccctcattaggagcatccccacgatgctgtctgtgcatgcggagcagatgcacaagaccggcttccccactgtccacgccgtgatcctgctcgagggcaccatgaacctgacaggcgagacgcagtccctggtggagcagctgacgatggtgaagcgcatgcagcatatccccaccccactttttgtcctggagatctggaaagcttgcttcgtggggctcattgagtctcccgagggtacggaggagctcaagtggacagctttcactttcctcaagattccacaggttttggtgaagttgaagaagtactctcatggagacaaggacttcactgaggatgtcaactgtgcttttgagttcctgctgaagctcacccccttgttggacaaagctgaccagcgctgcaactgtgactgtacaaacttcctgctccaagaatgtggcaagcaggggcttctgtctgaggccagcgtcaacaaccttatggctaagcgcaaagcggaccgagagcacgcaccccagcagaaatcgggagagaatgccaacatccagcccaacatccagctgatcctccgggcggagcccactgtcacaaacatcctcaagacgatggatgcagaccactctaagtcaccggagggactgctgggagtccctgggcacatgctgtccgggaagagtctggacttgccgctggcctacagcacatg

SEQ ID NO: 549050 - DNA, 229 bp, Homo sapiens
aggatcttactaacctaatcgcatttataaacttcccatccagaacattatagtatccatctttacgacgtcagctagtgaaaacatttaacttcataaatatgctaccctgactggtcaagggctttttagtatttggctgtctcttcatgggaaagggaaatcagccgttcaaggaacgattcctttttcctttgtttttttttattttttattataggggggggca

SEQ ID NO: 549051 - DNA, 1000 bp, Homo sapiens
  misc_feature (23)..(23): n is a, c, g, or t
agcggatagaaagtgagcttctngacaagtgccaaaatggcgatgcctaccacctagaactggattgtgcgctccatttctttcacctcaaagctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagatggtgtcctactcttctgtcctcacagccatcagtaagtttgatgacttttctcgggaccgagacgcagtccctggtggagcagctgacgatggtgaagcgcatgcagcatatccccaccccactttttgtcctggagatctggaaagcttgcttcgtggggctcattgagtctcccgagggtacggaggagctcaagtggacagctttcactttcctcaagattccacaggttttggtgaagttgaagaagtactctcatggagacaaggacttcactgaggatgtcaactgtgcttttgagttcctgctgaagctcacccccttgttggacaaagctgaccagcgctgcaactgtgactgtacaaacttcctgctccaagaatgtggcaagcaggggcttctgtctgaggccagcgtcaacaaccttatggctaagcgcaaagcggaccgagagcacgcaccccagcagaaatcgggagagaatgccaacatccagcccaacatccagctgatcctccgggcggagcccactgtcacaaacatcctcaagacgatggatgcagaccactctaagtcaccggagggactgctgggagtccctgggcacatgctgtccgggaagagtctggacttgccgctggcctacagcacatg

SEQ ID NO: 549052 - DNA, 1500 bp, Homo sapiens
  misc_feature (23)..(23): n is a, c, g, or t
agcggatagaaagtgagcttctngacaagtgccaaaatggcgatgcctaccacctagaactggattgtgcgctccatttctttcacctcaaagctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagatggtgtcctactcttctgtcctcacagccatcagtaagtttgatgacttttctcgggacctgtgtgtccaggcattgctggacatcatggacatgttttgtgaccgtctgagctgtcacggcaaagcagaggaatgcatcggactgtgccgagcccttcttagcgccctccactggctgctgcgctgcacggcagcctctgcagagcggctgcgggaggggctggaggccggcactccagccgctggggagaagcagcttgccatgtgccttcagcgcctggagaaaaccctcagcagcaccaagaaccgggccctgctgcacatcgccaaactagaggaggcctcttcttggactgccatcgagcattctctcttgaaacttggagagatcctggccaatctcagcaacccgcagctccggagtcaggccgagcagtgtggcaccctcattaggagcatccccacgatgctgtctgtgcatgcggagcagatgcacaagaccggcttccccactgtccacgccgtgatcctgctcgagggcaccatgaacctgacaggcgagacgcagtccctggtggagcagctgacgatggtgaagcgcatgcagcatatccccaccccactttttgtcctggagatctggaaagcttgcttcgtggggctcattgagtctcccgagggtacggaggagctcaagtggacagctttcactttcctcaagattccacaggttttggtgaagttgaagaagtactctcatggagacaaggacttcactgaggatgtcaactgtgcttttgagttcctgctgaagctcacccccttgttggacaaagctgaccagcgctgcaactgtgactgtacaaacttcctgctccaagaatgtggcaagcaggggcttctgtctgaggccagcgtcaacaaccttatggctaagcgcaaagcggaccgagagcacgcaccccagcagaaatcgggagagaatgccaacatccagcccaacatccagctgatcctccgggcggagcccactgtcacaaacatcctcaagacgatggatgcagaccactctaagtcaccggagggactgctgggagtccctgggcacatgctgtccgggaagagtctggacttgccgctggcctacagcacatg

SEQ ID NO: 549053 - DNA, 1864 bp, Homo sapiens
ggtgcgatctcggctcaccccaacaacctccgcctcccgggttcaagcgattctactgcctcagcctcccgagtagctgggattacaggcatgcaccaccaagcccggctaattttgtatttttagtggagacgaggtttctccatgttggtcaggctagtctcgaactcctgacctccggtgattcgcccgcctctgcctcccgaagtgctgggattacaggtgcgagccactgcgctcggccgatactttcttagtgccccagtttaaggaagggcggttcaggagcagagagtctgacaggatcttactttatccctttagctctttttctttcaaattcctctgtctcgcttaaatcttcccgcatcttctcctttctatttaattctgccttccccggttctccttagaacctcatgtccttttctttagctccatttctttcacctcaaagctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagatggtgtcctactcttctgtcctcacagccatcagtaagtttgatgacttttctcgggacctgtgtgtccaggcattgctggacatcatggacatgttttgtgaccgtctgagctgtcacggcaaagcagaggaatgcatcggactgtgccgagcccttcttagcgccctccactggctgctgcgctgcacggcagcctctgcagagcggctgcgggaggggctggaggccggcactccagccgctggggagaagcagcttgccatgtgccttcagcgcctggagaaaaccctcagcagcaccaagaaccgggccctgctgcacatcgccaaactagaggaggcctcttcttggactgccatcgagcattctctcttgaaacttggagagatcctggccaatctcagcaacccgcagctccggagtcaggccgagcagtgtggcaccctcattaggagcatccccacgatgctgtctgtgcatgcggagcagatgcacaagaccggcttccccactgtccacgccgtgatcctgctcgagggcaccatgaacctgacaggcgagacgcagtccctggtggagcagctgacgatggtgaagcgcatgcagcatatccccaccccactttttgtcctggagatctggaaagcttgcttcgtggggctcattgagtctcccgagggtacggaggagctcaagtggacagctttcactttcctcaagattccacaggttttggtgaagttgaagaagtactctcatggagacaaggacttcactgaggatgtcaactgtgcttttgagttcctgctgaagctcacccccttgttggacaaagctgaccagcgctgcaactgtgactgtacaaacttcctgctccaagaatgtggcaagcaggggcttctgtctgaggccagcgtcaacaaccttatggctaagcgcaaagcggaccgagagcacgcaccccagcagaaatcgggagagaatgccaacatccagcccaacatccagctgatcctccgggcggagcccactgtcacaaacatcctcaagacgatggatgcagaccactctaagtcaccggagggactgctgggagtccctgggcacatgctgtccgggaagagtctggacttgccgctggcctacagcacatg

SEQ ID NO: 549054 - DNA, 1144 bp, Homo sapiens
atggaacccatacaaagcaccgttagtcacagtggaagtgctcccaagaagcaggcgaaagtcatgacattacaaaaaaaaaaaaagatgctgaattgcttgataggtactatacattgaggtctgcagctgtggatttctttgccatatcaagataaactgaattccagtgtaagggccatgtgtaaacagctaaaggacaatttgtggagctgtcactgaagctgcatcagtaggcatgaaaaccttgttcctttccacgaaattacctttataatctggtactggaaaagggcacgctttaaatgctgaggtgtaggacctacctattaaggaacagggcattacctattagacctctaattattgatttcgcaggatattaggggacagctcattcactactggataaaccctataaacggcaacaacgcgacacgggtagaacggaactgttacaaacgccttgcgcacgacaaccttctacctggcacacattttacacacagggactgcccaaacacggcggtgggtatgggactaacacttttctacgaccacgcaagacgctatatgtggggaccctttacacagaaagatgtgtcttcagcaggtgttctaaaaactcaggcgacaggacaaaaggccgaaaacattctaccgtggaccaccaaaacccgaaagtaaggcagcgaaggccagacgacttgaaagtgatcgtcgccgaaaacaacactttcgatatcttgaaagagaaacagccccgccaaattgtgcaaggggcaaaacaccagcaggggcacgtcgattccgggcccggttggaaacacccaagggggctactaatcaacaagcaccgtccgccagcggcaagttgcaccacacaggtgttcggccgccgcgttagcaaccccctgtgaggaggggggagcacacaaaacagcaagagtgtggcccccacagcaacaaagcaggcgggaaaagtcagcgatgcacaagcataaagcggaagaacgcggggaacacgacaaaggcgccacaaacgcccaccaccacaggaggacacactactcaaaaagcgggcgcagcagcggaacaacagaacggcaaagttaaggcaggcagtaaaagcgactccatagta

SEQ ID NO: 549055 - DNA, 310 bp, Homo sapiens
  misc_feature (72)..(72): n is a, c, g, or t
ggagaagggagtccttgcccctgtcacccaaaggtggagtatagtggtgcgatctttgtggctcaccgcccnacctcccgcctcctgagttcaccccaggtctcctgcctcagcctcccaagtagctgggactacaggtggtccaccaccatgcctggctaatttttgtatttttagtagagatggggttttgccatgttggccaggctggtcttgaactcctgacctcaggtgatccacccgcctcggcctcccaaagtgctgggattacaggcgtgagccaccgcgcccgcccttctgtcgtcttctc

SEQ ID NO: 549056 - DNA, 1440 bp, Homo sapiens
tgcatatgtcgaccagcgtcgctggattgtgcgctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagatggtgtcctactcttctgtcctcacagccatcagtaagtttgatgacttttctcgggacctgtgtgtccaggcattgctggacatcatggacatgttttgtgaccgtctgagctgtcacggcaaagcagaggaatgcatcggactgtgccgagcccttcttagcgccctccactggctgctgcgctgcacggcagcctctgcagagcggctgcgggaggggctggaggccggcactccagccgctggggagaagcagcttgccatgtgccttcagcgcctggagaaaaccctcagcagcaccaagaaccgggccctgctgcacatcgccaaactagaggaggcctcttcttggactgccatcgagcattctctcttgaaacttggagagatcctggccaatctcagcaacccgcagctccggagtcaggccgagcagtgtggcaccctcattaggagcatccccacgatgctgtctgtgcatgcggagcagatgcacaagaccggcttccccactgtccacgccgtgatcctgctcgagggcaccatgaacctgacaggcgagacgcagtccctggtggagcagctgacgatggtgaagcgcatgcagcatatccccaccccactttttgtcctggagatctggaaagcttgcttcgtggggctcattgagtctcccgagggtacggaggagctcaagtggacagctttcactttcctcaagattccacaggttttggtgaagttgaagaagtactctcatggagacaaggacttcactgaggatgtcaactgtgcttttgagttcctgctgaagctcacccccttgttggacaaagctgaccagcgctgcaactgtgactgtacaaacttcctgctccaagaatgtggcaagcaggggcttctgtctgaggccagcgtcaacaaccttatggctaagcgcaaagcggaccgagagcacgcaccccagcagaaatcgggagagaatgccaacatccagcccaacatccagctgatcctccgggcggagcccactgtcacaaacatcctcaagacgatggatgcagaccactctaagtcaccggagggactgctgggagtccctgggcacatgctgtccgggaagagtctggacttgccgctggcctacagcacatg

SEQ ID NO: 549057 - DNA, 1133 bp, Homo sapiens
gggccatgctgggcccggggggctgtgtgttgcgcagtgggctggcgtgacgcggtccggaaggctggcgcggtgacggcgttagcccggccctcgggccctcttgtgcgtgcgtccttcgcgctattccctccttgctcgagatggatctgcaccgtgggccccggagcgggtgagggccaggcaacagttcccggtcttccttgaacaatgatgtggacccatcgatgagctgaccacggacactgattgctgctcatcatgctggagtcccgagcaggagaacagcttgccatcgtgttcgaccagggccatgtttgccacaggaaggtgatgctccaagtacattcagtgctacatacaatccattggtccatgcattcgtgctggcgacgctcacaacatgtaatggcttccaggcaaagtggtccaacattcagagcagcggcaggcccttgaggtacaaggcccaagaagaaggacgcatggagcacgtgcaagtatccacgtcgatcccaatgtctatcccctgtcggtggggccatgcgcagtcaaggcttctctttgcaagaccacatactaaggcaggcaaaggtgaaaccaagttggtggtaccaacgctggagagcaccttgaaaggcacccgtaagacgattcccgacccacttgacacaggcgttcccccaaaggtttgctgaacgggcaccggtggcccacgctgcccctgaaacacggggggcaaggcacggaaagtggccgttggcaccgtacccatagggctgcctgtgcggcattgacaagcatctgagaatctgacgggctcctactagcgccgcgggacggttgggccacgacactgatatagcgagaagcaaagaccataggccgcatagcaaatcgacagaactagggccgagtccaacacaaaagggcgcttcaaatagacgagattacccgtggcagtcagcacacacttggtatgtcacagggatccacacatcggcagactcgctataggggagggacttacaagagcagagaaaggtatatcgggccgcgtcaacttgacgtccgcatggagatccaggtagggctatccgcgatagaactttcgaatgaaccgctaaagcaac

SEQ ID NO: 549058 - DNA, 1445 bp, Homo sapiens
actcccagggtttatactaaatggctgtacctcaaaggctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagatggtgtcctactcttctgtcctcacagccatcagtaagtttgatgacttttctcgggacctgtgtgtccaggcattgctggacatcatggacatgttttgtgaccgtctgagctgtcacggcaaagcagaggaatgcatcggactgtgccgagcccttcttagcgccctccactggctgctgcgctgcacggcagcctctgcagagcggctgcgggaggggctggaggccggcactccagccgctggggagaagcagcttgccatgtgccttcagcgcctggagaaaaccctcagcagcaccaagaaccgggccctgctgcacatcgccaaactagaggaggcctcttcttggactgccatcgagcattctctcttgaaacttggagagatcctggccaatctcagcaacccgcagctccggagtcaggccgagcagtgtggcaccctcattaggagcatccccacgatgctgtctgtgcatgcggagcagatgcacaagaccggcttccccactgtccacgccgtgatcctgctcgagggcaccatgaacctgacaggcgagacgcagtccctggtggagcagctgacgatggtgaagcgcatgcagcatatccccaccccactttttgtcctggagatctggaaagcttgcttcgtggggctcattgagtctcccgagggtacggaggagctcaagtggacagctttcactttcctcaagattccacaggttttggtgaagttgaagaagtactctcatggagacaaggacttcactgaggatgtcaactgtgcttttgagttcctgctgaagctcacccccttgttggacaaagctgaccagcgctgcaactgtgactgtacaaacttcctgctccaagaatgtggcaagcaggggcttctgtctgaggccagcgtcaacaaccttatggctaagcgcaaagcggaccgagagcacgcaccccagcagaaatcgggagagaatgccaacatccagcccaacatccagctgatcctccgggcggagcccactgtcacaaacatcctcaagacgatggatgcagaccactctaagtcaccggagggactgctgggagtccctgggcacatgctgtccgggaagagtctggacttgccgctggcctacagcacatg

SEQ ID NO: 549059 - DNA, 339 bp, Homo sapiens
  misc_feature (45)..(45): n is a, c, g, or t
gggtccttttttttttaaggggggggggatgggggaaaaaggganaggggggggggggggccccccccgggccaaaaaaacaaatttgttttttgccccccggggggttttcccccccttttttgtttttttagccaaggcccaaaccccccctttttaggttttggtggggggggggggggggggtaaggttttttccatcccttccggggggggggggaagtttttttccccccgggtttttttcaaaagggaggggggccccgggccccctttttttttttggggggggttcccccgggggccaaaatgccaataattttttcccccccccggtta

SEQ ID NO: 549060 - DNA, 1461 bp, Homo sapiens
  misc_feature (23)..(23): n is a, c, g, or t
agcggatagaaagtgagcttctngacaagtgccaaaatggcgatgcctaccacctagaactggattgtgcgctccatttctttcacctcaaagctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagtttgatgacttttctcgggacctgtgtgtccaggcattgctggacatcatggacatgttttgtgaccgtctgagctgtcacggcaaagcagaggaatgcatcggactgtgccgagcccttcttagcgccctccactggctgctgcgctgcacggcagcctctgcagagcggctgcgggaggggctggaggccggcactccagccgctggggagaagcagcttgccatgtgccttcagcgcctggagaaaaccctcagcagcaccaagaaccgggccctgctgcacatcgccaaactagaggaggcctcttcttggactgccatcgagcattctctcttgaaacttggagagatcctggccaatctcagcaacccgcagctccggagtcaggccgagcagtgtggcaccctcattaggagcatccccacgatgctgtctgtgcatgcggagcagatgcacaagaccggcttccccactgtccacgccgtgatcctgctcgagggcaccatgaacctgacaggcgagacgcagtccctggtggagcagctgacgatggtgaagcgcatgcagcatatccccaccccactttttgtcctggagatctggaaagcttgcttcgtggggctcattgagtctcccgagggtacggaggagctcaagtggacagctttcactttcctcaagattccacaggttttggtgaagttgaagaagtactctcatggagacaaggacttcactgaggatgtcaactgtgcttttgagttcctgctgaagctcacccccttgttggacaaagctgaccagcgctgcaactgtgactgtacaaacttcctgctccaagaatgtggcaagcaggggcttctgtctgaggccagcgtcaacaaccttatggctaagcgcaaagcggaccgagagcacgcaccccagcagaaatcgggagagaatgccaacatccagcccaacatccagctgatcctccgggcggagcccactgtcacaaacatcctcaagacgatggatgcagaccactctaagtcaccggagggactgctgggagtccctgggcacatgctgtccgggaagagtctggacttgccgctggcctacagcacatg

SEQ ID NO: 549061 - DNA, 122 bp, Homo sapiens
  misc_feature (86)..(86): n is a, c, g, or t
  misc_feature (88)..(88): n is a, c, g, or t
cgacagtgcggccagggctgctgggggatgggggttgctggaggctccacacctctcatccgcccgctcttgctcttggccccacnanagtcccctggggacctggccgctgccagcactgg

SEQ ID NO: 549062 - DNA, 1646 bp, Homo sapiens
gaggcaggaacagggcagtgcacagtgacagtgctctccttgcctgggttgaagagggctgtggcaggggttgaggttcaggagagctgcagcaacttgaagcatcagtgttgttcctctcaactgtgggagactagttgtctaaagattatctttcttccttctctccagatggtgtcctactcttctgtcctcacagccatcagtaagtttgatgacttttctcgggactagattggggatgacagacaaggccccgcctccttgacggccctgatgctgtgacccgtgaggctggataggcagcacatgatgcctctgggtggcatagctggacttccatgggagggggatcctggcaaggtaggggctggtgcttgggagccaatgtccagtgtcgaggatgctgagtctggaacccagggttggaggtgagaggagcaggagtcctgaatgcaccgtctgcctcatgtgagacctgggggtggatggaggcattccgtagcatctccactgtcctttccacagtttgatgacttttctcgggacctgtgtgtccaggcattgctggacatcatggacatgttttgtgaccgtctgagctgtcacggcaaagcagaggaatgcatcggactgtgccgagcccttcttagcgccctccactggctgctgcgctgcacggcagcctctgcagagcggctgcgggaggggctggaggccggcactccagccgctggggagaagcagcttgccatgtgccttcagcgcctggagaaaaccctcagcagcaccaagaaccgggccctgctgcacatcgccaaactagaggaggcctcttcttggactgccatcgagcattctctcttgaaacttggagagatcctggccaatctcagcaacccgcagctccggagtcaggccgagcagtgtggcaccctcattaggagcatccccacgatgctgtctgtgcatgcggagcagatgcacaagaccggcttccccactgtccacgccgtgatcctgctcgagggcaccatgaacctgacaggcgagacgcagtccctggtggagcagctgacgatggtgaagcgcatgcagcatatccccaccccactttttgtcctggagatctggaaagcttgcttcgtggggctcattgagtctcccgagggtacggaggagctcaagtggacagctttcactttcctcaagattccacaggttttggtgaagttgaagaagtactctcatggagacaaggacttcactgaggatgtcaactgtgcttttgagttcctgctgaagctcacccccttgttggacaaagctgaccagcgctgcaactgtgactgtacaaacttcctgctccaagaatgtggcaagcaggggcttctgtctgaggccagcgtcaacaaccttatggctaagcgcaaagcggaccgagagcacgcaccccagcagaaatcgggagagaatgccaacatccagcccaacatccagctgatcctccgggcggagcccactgtcacaaacatcctcaagacgatggatgcagaccactctaagtcaccggagggactgctgggagtccctgggcacatgctgtccgggaagagtctggacttgccgctggcctacagcacatg

SEQ ID NO: 549063 - DNA, 172 bp, Homo sapiens
agagtaggatgcaagaggctgaggaaaaaaggaaaacaaattagagggaaggaaggatggaaactcacagtattatcttgtcccaaaagaaaagaaggtccacgtgcagcaccagtggattacacctgtcagtatattcacataccccataccatggtatataactagaata

SEQ ID NO: 549064 - DNA, 87 bp, Homo sapiens
  misc_feature (81)..(81): n is a, c, g, or t
aagaatggagtctgtcagtacaggtgccgatatggaaaggcaccaatgcccagacctggctacaagcccaagagcccaatngtgcgg

SEQ ID NO: 549065 - DNA, 684 bp, Homo sapiens
  misc_feature (31)..(31): n is a, c, g, or t
  misc_feature (85)..(85): n is a, c, g, or t
  misc_feature (157)..(157): n is a, c, g, or t
  misc_feature (237)..(237): n is a, c, g, or t
  misc_feature (247)..(247): n is a, c, g, or t
  misc_feature (317)..(317): n is a, c, g, or t
  misc_feature (351)..(351): n is a, c, g, or t
  misc_feature (360)..(360): n is a, c, g, or t
  misc_feature (405)..(405): n is a, c, g, or t
  misc_feature (534)..(534): n is a, c, g, or t
  misc_feature (592)..(592): n is a, c, g, or t
  misc_feature (641)..(641): n is a, c, g, or t
gagtggtctgggcttttgtgggcactttacnctgggaagggggtatgaggtggctggagaagtgttcatggagagtgtttttttnctgcccccaaggccacggaatcttctattccttctttgtacccaaagggcaaagtggaggccagggtctctntgctaaggagctaagttggggaaagaggcagggggagctcccagcaggaccaaagggagaacaaggtttggaccccagancagagcaggnacccagagttctgttcagtaacaggatgaagcagggaggacggctgtggagtgaacttttctagggtttntccattactggctcttcaggatggtcttaatganatctttctnatagggaaagccccacatttttcagcttggagaacaacagcggtncatttatctttattttaaaggcacctgttcccccgaggagcgatttgatctagatgcccggatactgctccttcaaagcactggccagctccaggtaggttgcctcgaagccgcaggtttacagttctncaccacgatgcggaccccactgcccggctcgacctcctcgggagggggcgctacggangtttgccccggctccccgctcatcgcggccggctccgctcgggcccctnctttcgggtgttaagcgaacagcgggcacgttaaggggcgggg

SEQ ID NO: 549066 - DNA, 1735 bp, Homo sapiens
gacctgaagtacatggtgattcgaacggggcatatgactcatacgattggcattctggtagcgacactacgtcgtcgagggatcgaaagggtcctggacgcccttctcgaggaagggcagttccgtaagcgcctggtaaatcctcgcccgaaaccgtccaatgcacagtcgtgaattcgccgcatctcaatcctctggatcctatcgtcacgcatggccatcgactggtaacttccctccagcggctcgttcgcccgtgagcctgtggaccccatgcacctacacattgcaaatagccttcggagccctggcagccataaacgcaggcttgagacgccgaagataagccaaagcgaccgccctaagtcgcgcaatatgcggaggcccattcggtttgcatttcttacccgggttccacgaacaacgaatgcggcctcgccaaattcacaatgccaggttgccctaggaatcagtaagacactttaatgccggactggtatcccttatcaccaccccttcttgaacgtgcgttcaaaatacgttccgcttcagaccccttggtgcggactcctacgcggaagaccttccccgcttcttccttccaggggcggccgccgcctattcccgctttctcggccttgggcggcctagccaccggggcacccgctggaaccctttggtgccgccctaacccccaggtttggttgccttcccagggggaattccttacccctggtttccataatacccctcgggcccgtaggatcaccctacccttagggccccaaccgccctgagccctctactataattccccctgatccactcggcgcggacactgtgggcgcccctttattaacgggcactcttggaatagttgtcacaccctttggcggttggcccaactgcgaattactcccaatggtgcagtgactcccgttactctcaccggctggccgctttcttcccgtgccggatgctgccacgcccgactaggggcaacaggccaccgactggatatccccaacaagggccccaaacgaccttcctggttcctaaggttattgccagcgtataccgctcctaggcgggtaaaccgaaggtcgccccctctggggccaccacctcctgtccacacctatgtgggcatgccgcaccctttctcccccgtttgtgcacattacccccgactattcccagcctgcccttgagcggccacctttgccaacgcgcggagtcccttccctacggcggacctgtgcgcccctttccactggtgcttcccccctaccgacggcattcttggggcccccgtgcccccccgaatgaatgcgctcacacccacccctggggcaagccaccgggcaagggcgcccacagcccaaagcgacccccaggcacccaccccgcccatgcgccacacagaacagcggccccccccaaacccctggcgcccacgcgcaaacgcccacgcccaccctacgcccacaacatgcacggcccaccccccactgggtcgcagaaccaccccgtcccacgacgccccccgtccgcgcctacagcaacactgtcagccacacccccaaacgccaaaggcccaacccgcgcaccaacgcacgccccgcctctacaagagcgcacacgcgcgagcaaccactccgggcagcgcaaaatcttccccgaccacgccgcagttcgcccgcacagatgccataacccgcgggcccatacccca

SEQ ID NO: 549067 - DNA, 593 bp, Homo sapiens
tgagacagagtcttgctctgtcgcccaggctggagtgcagtggctggatctcagctcactgcaagctccgcctcccgggttcacgccattctcctgcctcagactcccgagtagctgggactacaggtgtctgccaccacgcccggctaatattttgtgttcttagtagagatggggtttcactgtgttagccaggatggtcttgatctcctgacctcgtgatctgcccacctggggctcccaaagtgctgggattacaggcatgagcccctgtgcccggctggtcaatcatttttgagttaactcattcccctgtcagaagaaccccatggaggtgtgggctcatgattactatgcccaggctggggacattgacagttctacctgcggtcacacacaaacatacgccacacacaccaaacaccatacacacacacactacacacatgcacacattgacacattgcaacacaccattcacaccacacacagctcgttgacaggacagaaacttacaatgccgaactctacacggatactcacacactacatcgacaacatctacacacttttgtcgcaaacctaaggataat

SEQ ID NO: 549068 - DNA, 966 bp, Homo sapiens
catgaaggtgttcgtcaaccgcaggatagccgccgaggctgtgaggtggagcagtgcggatctcggatagagcccgactcgcctgagcgaagggagactagagtcgaggtgtggctgggggcccaccgggctgctctgactcctctccgatcacgtggactagaggatcctggcatgcgtgcgagtggggaccaattctcaaagtcatcgagcgaccaatgatctggtgaggctatctgaccacttgggtctttgtgatggaaatcgacagacaagcgtgggatctctgtagtatggcgtacaccaccagatggtccctgaggagcagtagctaccgccgaacgtcgactaattgtcctctgataattgaccagcatgcacggcggttgtccgggaggccatcggaggaaattgacatgaaaatgggttggcgtgtgcacgcttcgatgagaacgtcgccccgtcctgggaatggtggtagggttgatgcgcactcaacagacaaagaagcgacatgatcagagtctatcatcgctgctgggggcgcataggccaggcacaatgttcggagtcctggaaaccatgttcggtgtcccaaagtattacttgtgacacagggcgccgaggacagggctgcagggaagcagcgggaaattccaggcagagtctgtgtgtacacttgaagctggttggcccggtctgttttcacttcgtcggtggccctgctcagttacagcacctgtggcgaggtacatctggggatgattgtacttctgccagcgaggatgggatggacacgggtgtggttcagcgagcttcagccgggggcgagaggtcgccgacaaggaagacctgtttccaaggcgttggcaggtggcagggattgggctggtggccggttttgaaggagcccggaggtgtgtaagcccctttctgggccgtgaactggggattgccccatggggc

SEQ ID NO: 549069 - DNA, 345 bp, Homo sapiens
tccaaatatgagatgcattgttacaggaagtcccttggcatccgaaaagcgcacgccactgcgtctctaaggaggatggcccagtcctctcccgagtccacacaggggaggtgagagcattgctttcgtgtaaattgggtaatgcaaaatttttttaatcttcgccttgatacttttttattttgttttattttgagtgatgagccttcgtgcccccccttcccccttttttgtgccccaactgtggagagtgatgaaggctgttgtggtctccctgggagtgggtggaggcaccagggcttacctgtacactgacttgagacgcgggtgaataaaagtgcacac

SEQ ID NO: 549070 - DNA, 185 bp, Homo sapiens
ccttttagggacccccaagggcccagggacccggggccccccggggttggggccagacaaaaactcggcaaaggggcgaaaggagggaacgagcgggccccgggcccctcggggttaaactgggggcgagcgggggcaggcggctgatgttttataaattgtaaaataaaaaaaaaagaattcta

SEQ ID NO: 549071 - DNA, 449 bp, Homo sapiens
gtgcctccccctttgaacactgccatgtagtgaccactacaacccacaagaccctgagaggctgccgtgctggtatgatattctacagaaagggtgtgcgcagtgtggatcccaagactggcaaagagacttactatgaactggagtccctcatcaactctgccgtgttcccaggccttcaggggggtcctcacaaccatgccattgctggtgttgctgtggccctgaagcaagccatgactacagaattcaaaatctaccagctccaggtgttggccaactgcagggctctgtctgatgcactcacagagctaggctacaaaatagtcacaggtggctctgataatcacttgatcccaatggatctgcgttctaagggtactgatggtggaagggctgagaaggtactagaagctgttctatcgcctgcaacaagaataccatgcttt

SEQ ID NO: 549072 - DNA, 210 bp, Homo sapiens
gttttaagggggggcccccccgaccaaaaaaaaaaattgcccccccttagggggttttcccaaccaaaggggggggaaaatttccctttaaaccctttttgaaaaagggttttaaaattttttaagtttggttttgttcccccctttgggggggggttttaggtttttgtttccggggggattaaaaaattgggcgggggttttttccca

SEQ ID NO: 549073 - DNA, 306 bp, Homo sapiens
  misc_feature (178)..(178): n is a, c, g, or t
  misc_feature (273)..(273): n is a, c, g, or t
  misc_feature (288)..(288): n is a, c, g, or t
gtatgattattatttgttaattaaaaaaataaaattaaaaaaatcatacatgggccaggcatagtggctcatgtttgtaatcccagcactttgcggggccgaggcgggcagatcacttgaggtcaggagtttgagagcagcctagccatcatggtgaaaccccatctctactatacanttagctgggtgtggcggcgggtgcctgtatccccagctcttcaggaggctgaggcaggagaatcactcgcctgggaggcagaggttacagtgagnccgagatcatgccantgcactccagctggcgat

SEQ ID NO: 549074 - DNA, 330 bp, Homo sapiens
tcgacacacgaaaggctgggcgtggtggctccacgcctgtagtcccagcactttgggaggccaaggcaggctgatcacgaggtctggagttcaagaccagcctgaccaacatggtgaaaccccgtctctacaagtacaaaaattagttggatgtgattgtgcgcatctgtgatcccagctacttggggggctgagacaggagaattgcttgaacctgggaggcagagcttgtggtgggccgaggtcgcgccactgcactccagcctgggcgacagagtttggctctgtttcaaaaaaaacaaagaaacaagaaaaagtcgacgcggccgc

SEQ ID NO: 549075 - DNA, 254 bp, Homo sapiens
  misc_feature (3)..(4): n is a, c, g, or t
ggnncactgtaatcccttctcccaggttcaagcgattctcatgcctcagcctcctgagtagctgggattataagcatgtgccaccacacctggctaatttttgtattttttagtagagactgggtttcaccatgttggctgggctggtctcgaacgctgacctccacctttcttggctcccaaagtgctgggattaccgtcatgagccactgcacctagccttcatagagaggtttttgccatcaggccacact

SEQ ID NO: 549076 - DNA, 387 bp, Homo sapiens
tggaaaaaccgctatgtggtgctgaaaggggaccagctctacatctctgagaaggaggtgggtgcctcttgcctctaactctccgttttctcataacccccaccccgggaaccccccaagggggcgccagaacaggacacccccggaaagttccaaaggcaaggacagtggtcgcctctctaaacccaactcatctgcagagaaaggccaccctttaatgagaagaccagagtgagaactagaagttgagttggccgcttactcagtgtatctctgtatgcaaatacctttctaacaacgataagcccctcccaagatgccccagaagttctaagtgtcccttgctgcctcccaccctaacctggcctcctgcatataggatttctt

SEQ ID NO: 549077 - DNA, 174 bp, Homo sapiens
agacatgagaggcagaagcaggaagcggcagaggcagaagcaggaagcgttttaagcaggaggtgtcagaaaagttaccacagggtcttgggtgaggagcagaagcaggaagcaaacattgaaagctatttcatgcaaacctttatctactttagcttaaaagtgaaagtggta

SEQ ID NO: 549078 - DNA, 699 bp, Homo sapiens
gacccaccgctgcctggagccttgcccctgatcctgcgcccgccccgtccgtgcggcgcgcgggcgtgagactgcctgtggccgcgccggagctcggtgcctggggtgccaccatcgaggctggggtgcctgctgcgatgtgtgcctggatgctggagcgtgctgcctgtcacctgcacgcactgcgcaaacttgggctcgcgcttccctgtgccctggcgctggagccctggtggctgccctggagcacccgcacatgtcgctgatccaacctggcagaaggagtacaaatgcggggacctggtgttcgccaagatgaagggctacccacactgtgcctggccctggattgacgcagatgcctgagtgctgcctgtgcaaatcacacagccaacaaataccaaagtcttttttcttacgggacccacgagactgtgcattcctgtggcccctaacagacctcttcccttacgaggacatccacaggcagaacgtttggcaagcccaacaagcaggaacacgggttcatgccgacggggccttgtggggcaagcatccgaagcacacaaccacattacatgttcacgtgcccttccctgggctaactcatgatgcctcccccagtacaacaacgacaggctgatgtcggaaagcaggccttgacaccacagaggcccgcaaagactgcagaggggttgc

SEQ ID NO: 549079 - DNA, 125 bp, Homo sapiens
tggcgtgtggcagttttaagttattagttttataaaatcagtactttttaatgggaaacaatcgtgaccaaaatatttggtgcacagatattttggagaccctattaaaaaatgttaatatggag

SEQ ID NO: 549080 - DNA, 794 bp, Homo sapiens
tacccctgatacgaaagatggaccgccatcaggcgcatactcggtcggagcgtccaattcgctcgatgagcgggagacagtcgctagaagacacggaaggcacagaaggcagacttcgctcagcgacaaagaagaattttctgataaccatactggacaaaatgaactgttttgccttcggagggtctgaattcttcatcccagaaggcattcagatagacttcgagatgcccactttttcagcaactatcacggaatggtatcaggagataaaggagggttggaggacgacgggaacggtctatagacgtgctcatctcttccctcctcgcaaaaagcaccttcccataattcaaaatagccttctacatctagtgatgatcttaagtcgaactttccatacgtatctcacatgggctacgagaacaagtacgatcaataatagtaagatgcggcgattctctagaaacagcgagagtcccaacgagatgacactcaacactcttgtattcgaccaacgggacctagtgcacacactcgactcctagcagcgtaactacacataaagacggtccttcttaatgtgcggccgagactgcaaatagggaacccaaggagaagtgctcctaaattattacaaactgggattataaactacagcctacgctaaccctaccatctcaatcaagatcacctaaggcgtacaatagcaaactaacccagagggaattcatatttaactaagtagtagcggacaacggaagacacacatccacaacaagcccaacagagcg

SEQ ID NO: 549081 - DNA, 970 bp, Homo sapiens
gttctaatcaaatttagaaagcccttcataacttatcataatgctgatgattttattatctcaggcaatctatatatgtgaaaccaactaagaaacttaaatgtattcagtggaaagaaggcatcatctgtgctggtatcttaacctgtaaaacaccaccagtgcaatagcagctgaggagcaggtcatgcatgttaagtcaggcagagcagcccggtgctgtgaacaccaggcactgtgcgtgtctgcacagccccatcaacttgatctcacagtaaatttaaaagttttttctttatattcctttgtccttcttttttctgttatgttttcttgcctgtggttttaccatttcagtttcctgcagacggggataatatgtcactcaattcagcatggccatgcattgctcctaaatgagtgtaatacggctagtactgtaataagtggcagtttaagatgcagtcatatttcatttcttcctgactgatttctacactgtgtctttaataactgcatctttagttctgcttttctatgggaagtaggacttatcacctttaatcatgtttcatcttagttatactaaaaaagtaagaatcctagggtatattattaccagatacacatgaacagaatttgagaaagattaaaacttgtaggcaacctctgaaggttttcgccaagggtctcaatcaggggaccggcatccgggctcctagaaatacccggggagacgaactttaaattatgggtccaggcagagtaccaaataatccgaataatcttcaaagaattcctgacctgggatgggtggcttggcatgaaggtgggggcctgtgtctcgctattttttcctccttctgctaaagaacataacatagaaacacacgtttacgggatcactgtcacaagaataagcaacagatggtatagaaataaaaatgagagaaggaacgagataagatca

SEQ ID NO: 549082 - DNA, 419 bp, Homo sapiens
ttttagatcgcatattatactgaactcctgatgttgatgagcagaagatgacatccctgtggtgagttcagtactaactggggataaactagaagaacctgtgattttacagtgcatcttgattaccatgccagggctcatctagccagtggcaatgtatgccttgaatggggataaccgcctttcttagttggatcaaatactactacactattacacttccacactatttatttggggatgggctgggagtgacagtagcctagtagttccgctacctgattactggcccattcttttcgaagcacatgtctgccaaggaatggtttgtactgctgtgtttggtacatctagtctttattctgctataagtattccttacctgtcctttactgtagattttattcatcacaggacag

SEQ ID NO: 549083 - DNA, 543 bp, Homo sapiens
attattctttcacaatttttcacttcccgaaaaaacaacataacaccattccccccttataaattttccactcctcctaatataccccccccccctcttcttttagatcatctttcaataattatattaaaattctttaattaacttaactctctcccacctatacttctgcactatattaccccgtgcttatcatctgacacatatttcacttacctgtctctcactataacttttaaataaactactttaatttatgtacacacactttctctatatctctctcatttattttatcactctattttcaccttttaaacttttcccttcttctatattaacccttcacccctacccaaatatctatatattaccatataaagagcgtctaactccttcatatcttatattcctatcctgtatacctctactcaaaatatactctatctcactttagtcccgccatctcacaacatcccttactctctctattacccatttcttttttttactacctctcaaatcacttacaatcattactac

SEQ ID NO: 549084 - DNA, 362 bp, Homo sapiens
  misc_feature (362)..(362): n is a, c, g, or t
agtgctaccacagacaactgctgtgtctcagacgtaagatacccatgttcttgtgcaactacctgtggcattgcagatatactgtgtacattatcaaatcaaagcggacagggatctacacgctttggaagacatcttacatcaaggtgagcaacaccacatttcaagtcacaacaggtgatcagactctgttaatttgaagtccaggaacacgccttaagaaattctgaaatatgagagcgctcgattttatacacatgactcaagcgttcgagatttgcgggaaatatatgattcaaatagtctcaagattggtaacctggagaacgtggaccagcttgaagcacaatgccggccttgtn

SEQ ID NO: 549085 - DNA, 198 bp, Homo sapiens
tcgtcgtcggtaagcctgctgcaagccaaccttcctgcctgcgcccacggtacatcagtttagctttgatcgacgccacaccttattcgcccttctgcacgagccgctacccagtcctcaccctggatacgttgcgactcatcagctgccctcttccatattcggacaagatgacgcccacttacgatgcgagagaaa

SEQ ID NO: 549086 - DNA, 1259 bp, Homo sapiens
  misc_feature (118)..(118): n is a, c, g, or t
  misc_feature (851)..(851): n is a, c, g, or t
aaggaagagagccttgaagatgaggaacgtgatatgggccatgggaagttgacaacgaccaattgagagcaatcattgaactaccatgcacaacacattcaccagcacagcacactancagcagttagcacatcattactcacgagtccattagtggtcgttccagccattcagcacagccaacattggacaaggtgcaaacacagcttgcataagtgggtgcctccatgcagctgcagcggaaatcaacaactcatcgttttgacagtgtcagtcttctatttcatgctcacgccaaccaaccaaacccatttctccaatcgggcattcgtcgcaccatcgtcagatgcacaacagtgcacattttcatcaccaacgacaccccagctcagtggttggaccaagaggcagctccaaagcagttcccaaagccaaacttgcaccaaaaaaaaggtcatggtcactgtatcggatggtctgcatgcccatctgatccactacagttttctgaatcctggtgaaaccgattacatctgagaagtatgctcagccaacttggtaagatgcaccgaaaactgcaatacctgctgcctgcattggtcaccagacagggcccaattcttctccacgacaacacctgaactgcgtgtcgcaacacacaggtgcttcaacacagttgaaggcactcgggctacaaagatattgcctcatccagcatatacacacctgaccttacggacaactgaactagcagtatctggctagccatcttgaacaaactagattgcacaggacacaacacttccagcattgtgctgacgaaagatgcatacacagaggttcgtcacaangcctacagcacggctttaaccgcatcacggacataaacagacacgtctaccatcggccaacacggctgtgcaatgcaacagcgaccagctcaggcacagacaggcacaacggcacacaggacgctcactaggcttaagacatcagcgagttggacaatgagaaatgagcgggtaatgcggatgcattgctacgttgcgtgctcgtcgtacgctgagtcagctcatatggcccgacgactgggtagcccgattaatggcgaaaacaaagaaaaaaatacagagggcagacaatatcaaagataagaaagagtgaacacgatagtgcagaagtagttacattataacaacgagggggtgacgagcatgatgtcgacccctgtctgcatctagagcaaaacatgaatgaaa

SEQ ID NO: 549087 - DNA, 84 bp, Homo sapiens
agcttctacatctgcagtgcgcgcacctgggacagggcaatctacgagcagtacttcgggccgggcaccaggctcacggtcaca

SEQ ID NO: 549088 - DNA, 230 bp, Homo sapiens
gtcgaccctggggccattgagttttgccctgccgtgcggtcaaagagcctaataacgctgaaacccaggtgttccaattctccctcggtcagaccttttaacggcctgcccctagataacgacaacggattttgtaggagtttattgtgcgtaagttgactcaactggttctgctggccactgttctggtagcgaccccggcctttgccgaaatgaaaatcgcggtcctg

SEQ ID NO: 549089 - DNA, 697 bp, Homo sapiens
  misc_feature (445)..(445): n is a, c, g, or t
  misc_feature (452)..(453): n is a, c, g, or t
  misc_feature (460)..(462): n is a, c, g, or t
  misc_feature (465)..(466): n is a, c, g, or t
  misc_feature (471)..(471): n is a, c, g, or t
  misc_feature (474)..(474): n is a, c, g, or t
  misc_feature (482)..(482): n is a, c, g, or t
  misc_feature (484)..(484): n is a, c, g, or t
  misc_feature (487)..(487): n is a, c, g, or t
  misc_feature (489)..(491): n is a, c, g, or t
  misc_feature (493)..(493): n is a, c, g, or t
  misc_feature (498)..(499): n is a, c, g, or t
  misc_feature (501)..(502): n is a, c, g, or t
  misc_feature (504)..(504): n is a, c, g, or t
  misc_feature (509)..(509): n is a, c, g, or t
  misc_feature (512)..(512): n is a, c, g, or t
  misc_feature (515)..(516): n is a, c, g, or t
  misc_feature (518)..(519): n is a, c, g, or t
  misc_feature (522)..(523): n is a, c, g, or t
  misc_feature (525)..(525): n is a, c, g, or t
  misc_feature (554)..(554): n is a, c, g, or t
  misc_feature (556)..(556): n is a, c, g, or t
  misc_feature (560)..(560): n is a, c, g, or t
  misc_feature (565)..(565): n is a, c, g, or t
  misc_feature (568)..(568): n is a, c, g, or t
  misc_feature (580)..(580): n is a, c, g, or t
  misc_feature (587)..(587): n is a, c, g, or t
  misc_feature (592)..(592): n is a, c, g, or t
  misc_feature (618)..(618): n is a, c, g, or t
  misc_feature (621)..(621): n is a, c, g, or t
  misc_feature (625)..(625): n is a, c, g, or t
tgactttgcattctgagatgtttgcttggttacagctgaatcaaagcttaaacgaccattaaagtcagcgtttggaaagtaatgtgtaaatgtacctgtacttttcttttattctttatgtctttctgttcattgggcaacagctaagagggcccagcaaggtaatttatggttgagctgatgtcaattggttcttgtcttgagtcgactctaatttagcccaagtgctgaaacaagtaatgtcattctttttcatcaaagacaccagggcagatttcttaagtaaagaaagacaattggacccttaagaatttatgcatttgtaaagttgctgttgatccaaatattttcaagccatgtaatccattggttttgtgggcagtttaataaacctgaacctttgtgtgttttctaattgtacctgagttgaccatcctttcttttnatagtanntttcttnnnatnntattnctntaaagctntnacntnnntnctctnnanngnacttntcnctnntnngcnncnccagtgtatttatgtgaaactttataagngnattnatttntcnatttgcatattnatatgtncctcnacacatgtaaggcacagtggctccgngtnttanaaaacagctgtattttatgtatgctttactgataagtgtgccaataataaactgtgttaatgaccaaaaaaa

SEQ ID NO: 549090 - DNA, 1228 bp, Homo sapiens
cccggacgacgctccggcgctgggtccccgaggcccggccccatccccgtggaggaggtgggcttctgagtcacgtgaccctgtgccctactggtgatggtggtgtgctgtgtcgtgggaccctggcatggatggctggctgagaagatgagtgacctgtgggtgtgctgttctgctgtggctcccatgcccgtggaccccacgcccctgctggacagttggggtgaaacttgagtgcctgatgctggtgcccagcacagtgaccatgaatgtgtgcttctccatcacatgggcttgggtggcccaatgttcttcgcctacttatttgggattgacagacttcctgacccaagtgtgacgcaaccattgtggggttagacgtggatggggatgaaacctggtgccatgcttgtccttgtccctcctggcccatgaagttgaccaacccctgtgctattgtgccatgacgcagcactccagggtacgctgctgatgttgcttgctgaccagggtgcccaagcggctgtggttgttggggtgacgagacgctatgggccctactacagcataacgacggcggatcttgggtgactccccaacacatggtgtggctacagcctgtggccgcaacaacttgatggggctcgttcccattgccacggacatcgggctggggcgcattgggcacgcttaccccatactgatggccttggaaaccagcaattctggggccgtggctgcgcccgctggtgcccctggggcaaacatgccagaaggccacacggcaaggacacgcgcgcagaggggacagacactccgggctttggggcatatcgactcggccacagtgataacgagcctattgtggttggacaggcttaagcgcgtggcaaaaacatgaccgttcaggaggaggctggctaggcacccaagacgccttggaaccggggagcaatggctacggggcctcaccgttgtgagtaggggattatgagattgatacacagttcggacctttggacttccagggacaccagctagttgacacccaacacgtgacaggtagcgtccgaacagttcacacataaaagtctgggaatgcggagcccgagagagtattgcgaggctaggagagagggggatattcatacagggcacacaccatgtctatgatggtgaccgactctgacctctttgcaacagggacaggtagacgaggtggagcgca

SEQ ID NO: 549091 - DNA, 270 bp, Homo sapiens
catctaccaccaccaccggcccctggccccactacacatggttcactctttccctcacctccgcccagattatttaaaagaaaatctcagacacattattttactcattaagcactggagccggtaactttggcctcttttggccagggcatctgtgaatctacatagataactgtagatttaaagtttataactagccaaagaaaagggcattggggatgatggaggggggtgagacggaaaacagaacaagtacataccgacgaagta

SEQ ID NO: 549092 - DNA, 330 bp, Homo sapiens
  misc_feature (19)..(19): n is a, c, g, or t
  misc_feature (61)..(61): n is a, c, g, or t
  misc_feature (236)..(236): n is a, c, g, or t
  misc_feature (250)..(250): n is a, c, g, or t
  misc_feature (295)..(295): n is a, c, g, or t
  misc_feature (307)..(307): n is a, c, g, or t
  misc_feature (326)..(326): n is a, c, g, or t
cgagtggaatggaaagganaggaatcaaccagagtggaatggaagggaatggaatagaatngaaactaatagaatggaatcaaccagagtgtaatggcatggaatggaacggaatggaatgagatggaatgtaatggaatgaactcctgtgcaatggaatgggaatggcaatggaaatgggaatgggattcaacttgaatggcatcaactcgattgcaatggaatggaatggaatnggaaaggaatagantggaatcaacccgagtaggaatggaatgggaaaggactggaaatnggagttggaatnggaattggaattggaattnaccc

SEQ ID NO: 549093 - DNA, 860 bp, Homo sapiens
cgccgattgtgggcgagaccaatgtgcgagtgggaggacaggcgaagcgcgcgtctggggcctgcgctctccacacttagccggcgctgcctcactgcctcgcagccacccctcctgcgtctccacaaatgtgtcctgacccgcaatgcaatgggcggctgggtcctggctttgaaaatgcctgtgcgggtcgtggccttgagtgtggaatggcgtggaaaatgtgcggattcctcgtggtgcgagtgcgctgggaagcctgcaacctggacccacaaattctagcagtgccaatgaagaacggataaacaggagttcaagcctttccaccgttggactgaaatttgggcttttaggaagcaacgtggctattgttcaaaaagacacggccgtgcgtttcctgtgcttgaactggagagtgtctcgttgactgatgctgactttcgtgggcattcctttcgctctaacacagcaagaatagcaagtggggtcgcgacaagggtgacctgcaggtccacgatatgctgggaaggggcatggcgacagcgtccagcatgaaccctggaatcgtctcgtgctaattaagtggacacaagaggccatcgtcacgaacaaggacgccaacaggtataggccaccgaagacaaagtatcaaatgacaacgcctgacgatcaaggcatcgatgttgacctggaccccgtccgaaagaaaagaaggcgcccgggactttatcatccttgacacgcccaagtggggcaccattgactcggacggtcgtcgaagaacgaagcctagcctggccttgcagccgcctaaccggtacatcccagataagcatggaattaggacgcacaccacg

SEQ ID NO: 549094 - DNA, 106 bp, Homo sapiens
atggaagcttggtgttcattaaacacacattggtatttattccctgacgcaatcaggtagttctcctgtggttctggagctcttgggtgggcggcacagggtgcat

SEQ ID NO: 549095 - DNA, 390 bp, Homo sapiens
tagattggtttgctgtttattcctctccttgagtgattattttcttcattgatatactgaattttccaatctgatttcttctttcatagtctgttaccccaatgctgccaagactgtgtgctcgttttcatcttagatttttagatcccaggggtagatgggcatcactgtatatatagcctctacccaaatcccaatgtacaacttgaaccttggttctgagagtgagcagttttcttggaagtatgattggagagctggaaaggcagcctgtataatgggtcctattgattcagaccaaaacccaattcagcttttccagaagacaagagtgtatgtaattgtttctctggttcagtttttccaacatgtaatagagctgcctcgtgc

SEQ ID NO: 549096 - DNA, 350 bp, Homo sapiens
gaaattttaaaaacccggggtattttttcggggggggtttttttgtttttgggggccccctttttaaaagtttaaaaaaatgttgcccggggggtcccgtttttcccccaaaatttgggggggaagccacccatttctttggtgggggtttaaagggttttattcccccccgtttgggggaatattttcggggaacccgttgggaaatttccccctgaaagaaaagggtgtaaaaacccggggttgtttctctgtttgggaaaaaccaattttggtgcgccagggccaaaaatataaatccctttttttcccccttcccgcccaaaaaaagtttgggtttttacccccca

SEQ ID NO: 549097 - DNA, 380 bp, Homo sapiens
tggacctggagctgacaggattggacattgagacggaacagattattgagataggactgtctgatcactgactctgatctcaacattaaggctgaaggtcctaacctgattataaaacaaccagatgagttgctggacagcaatgtcagattggtgtaaggagcatcacgggaagtctggccttaccaaggcagtgaaggagagtacaattacattgcagcaagcagagtatgcatttctgtcctttgtaacgacagcagactcctccagggctctgtaccacttgcaggaaattcagttacatgaagatgaggaagtatcttgagaaatacatgccccagttcatgaaacatcttcattatagaataatggcatgtgag

SEQ ID NO: 549098 - DNA, 140 bp, Homo sapiens
  misc_feature (11)..(11): n is a, c, g, or t
cggagtagtanttattcttgaatttaagaatgcctaagatacttcttcatcctcgatcttgggagccacgtagtacttttaagtgtcccatatccgtaattatatactctacaacaaggggtacatctagcagcacatac

SEQ ID NO: 549099 - DNA, 1064 bp, Homo sapiens
gcttgttgaggtagagtcagagtagggaaaacaactaatctgtttgccaaacaggttttcataatgtaactgacaggagatgggctgtttttatggaagtattaacccaaatgatgggtgttaatcattaaacctttttggtggtggctcgctgtgtatctctgatattctaatccgggtcacagaatggctagaggcagactttaacgtgcacgcgtggacttgttttggttgctcacttggccttgtgtttaccaccctgaaagaatgtcgtggctgctcttttttctggtgactgccattcatgctgaactctgtcaaccaggtgcagcaaaatgctttcaaacgtgagacttagtatcatgaaccagctctgggcagatacacagcatatgcctgggataccaatgaagaatacctcttcaaagcgagggtagcttgctccatgacgaaaagttcccaacgagagaagcaacagaaatttcccagtgtcctacttggcaagtgtaacccagagggtatcattctggtcaggaggatacagacccttcaaaaaatcaaacccttcctgctgttgagcgtgcactcagccataaggaatgagcgagaaccggatcaatatgacttctttcctaaatgacaaatctgggaactcttcaaaatcccttcacaacttgcacaaccatgtgacccatttgtgccattgggctctaacttagggcgcgcaaaaattagcactacacaacgtgcgccacagacacacgcgacttatcgcgggatcgccaccgtacacgagcgacacaacacacacttgtagcagagtgatgatagcgacaaaggggtataaacggttcccccatgcacagtacgacccacggttaccctggaaataagaggcggacaaaacgaagctctcagcctagaaaggcgcccccctatagatgttgggttgtcacagagatcatgtgtggttagttacatctgcacaaaccaattgtttgagaactcgaacaatatatttaacaaatgcatgcagaacattactcaataagcagtagtcgtca

SEQ ID NO: 549100 - DNA, 287 bp, Homo sapiens
gaatataagaaaagaacaagcatggaattagagccattacctgttttagcttaggcaaattatttaaactatctgatgccttatggcccttaaaatgcatcatgagaggattataagatttcataacttcatggttcatctgaagatattctacacattagagatataatacgttggattccttcttcatatgtctagaataactcatttcatgctcttttctgatagatacgtcatggtcttcaacacaacccttcggacccaagatagccctcctacatgacccc

SEQ ID NO: 549101 - DNA, 122 bp, Homo sapiens
ctcttttggggtctttgctcctgctactacctctgcttgaacagctcctcaccttccttcctccaaccctacccttgtataggtgaggagctgttcaagcagaggtagtagcaggagcaaag

SEQ ID NO: 549102 - DNA, 937 bp, Homo sapiens
  misc_feature (937)..(937): n is a, c, g, or t
gacaactcggtggtggccactgtgcggatcagacttcgctcgtactcgtgcgcctcgctttgctggtacctccgtcaaacatgtctgacaaacccgatatggctgatgagtcttaggaaacttccagtaggatcgataccatcttgacaagaacgatcattcacgtacgtcacatgagaacacatagtccagctggccgttccaaagtaaatgattgaatctaagtgaggaagcacagcacgagtcgagaactcgctaagtgagcgcgctgcaaggccgactctagtaatgcacgtgtacatttccacgaggcattgcctgtcttacttttagtttcttgtaaggctgtttaatctttgtcatgcatgcctgagacggtgttgagtatcaaagtcggtagaatggatcgttgtggctcgtcgcccctttgtcatcaatcataagtaaccttacctggagcaatgcggatggccgggacatgccttatcccaatcttgtgctggatctacttcgttggcttggcatgggcacgggagataggaaactttcgcgatcgttctgactcgcactggaacgaatacgatggagggctcgcgaaaacgagaagtcgcgtggatggtgggaacggatccgcaggttgcaccccaattccttcaggcaaagtttaggaattaccccataggcctgagtggcgcgccctaagggttgaggttccccatttgacgaatgcggcgtgggctccaaagttggcgctcaggtttttttagagtcccttacgcaagcttgggtcgcccaatctttggggttttcttttggcgcctctcccaaaagagggggaactctctctccaaaattccccaatctgggcggaaactttgtcccccctaagaattttgtaacgtccaacattttattcggcacaaccattcaaccgcgn

SEQ ID NO: 549103 - DNA, 105 bp, Homo sapiens
ggtttaccagaacagcataacaagggcaggtctgactgtcaaggctgggactgggagtgcatgagccgccgccaagggggcctcggttaaacactggtcgttcaa

SEQ ID NO: 549104 - DNA, 175 bp, Homo sapiens
gccgtcctgtgtaggtagcgcatgaaggcggtaatactggaacgtctgcgcaaaccgtggagctggaaggcacggtgcgcacccacagcgacgcggtgcgccgccaggtaccggacaagattcgccaggtgatcgacggcgttgccgccgcgctgggcgcgcaggccgaactgcg

SEQ ID NO: 549105 - DNA, 313 bp, Homo sapiens
ctttttttttttggggtttttttttgaaaaatttgggggggtttccgggtttcttgaaaaataaaccttttttccaaaaagggttttaaggggtcgctccccatttgggttcccattggccctttgtggcttttcccccctgaaaattggggtggcccaaattgggtttgcctttaaatttaaattgccccccggttttcaaagttttattccaaatttgggagttaagttcccccaaaaatttctttccggttcctttttcaaggtggtttttttgatttggggggttaaataaaattttcctttttattta

SEQ ID NO: 549106 - DNA, 138 bp, Homo sapiens
cactctgcctgtgggctcatcccgtgcctcgctctgagctgcgcctggacctggttctgccgttctggacaactctttttccggtgggagggggagccaataggttccgttggtccccccgttccttgcggctcccgc

SEQ ID NO: 549107 - DNA, 122 bp, Homo sapiens
tattagaggatcctagagactggagaaggagacaggagtgagaatggggcttactgggaacaaagaatagtggttctagcaataggctatggttagactactctccagaaaaggataaaaca

SEQ ID NO: 549108 - DNA, 744 bp, Homo sapiens
tgaactgcctttcagatatggagatcaacctttggagaattaagatctctctttgcaaacaactgaaaagaatgacacggttgccgggcaaggtgagcgggaccatctcatcactaagcgggatcttgccctcagtgaaggagatattcacactttgggttgtggagttgctcagtgcttgaagattgtctgccaagttgggagattagacagagaaaagagtgcaatcttgtccgtaaagtcattactgtgggctgagccttttatgaataaagaaaatcagaatcattcctattctctgaagtggtctgcttcatttaatgtcaaagagtttccttataagaattttccaattgaggatatccccaaccccccattggtaagtcattggtttaggcaaatagaataaatttcctcaattcaaatgcgggacaggtttttattttgttttttaaaaaacgccagcttaacttttttgaaaatttaaaccaaaggaggttaaatgaaagccttataccctagtttaatattatcattttactccttaccccgaagtgattaaagctagcccttttagtttagcatcttgtccagggtaaaaaattttttagtatatactaaattatattggagaaattttaggaattttcgtttccaaagttaaaaagttggaaattaactgcaccaagtgaggccttttgaaaatatttaaggagtaaaaatgggatcagcacatgcccccca

SEQ ID NO: 549109 - DNA, 866 bp, Homo sapiens
  misc_feature (5)..(5): n is a, c, g, or t
  misc_feature (88)..(88): n is a, c, g, or t
  misc_feature (117)..(117): n is a, c, g, or t
  misc_feature (127)..(128): n is a, c, g, or t
  misc_feature (155)..(155): n is a, c, g, or t
  misc_feature (162)..(162): n is a, c, g, or t
  misc_feature (169)..(169): n is a, c, g, or t
  misc_feature (175)..(175): n is a, c, g, or t
  misc_feature (197)..(197): n is a, c, g, or t
  misc_feature (199)..(199): n is a, c, g, or t
  misc_feature (210)..(210): n is a, c, g, or t
  misc_feature (224)..(224): n is a, c, g, or t
  misc_feature (256)..(256): n is a, c, g, or t
  misc_feature (259)..(261): n is a, c, g, or t
  misc_feature (264)..(267): n is a, c, g, or t
  misc_feature (269)..(271): n is a, c, g, or t
  misc_feature (293)..(293): n is a, c, g, or t
  misc_feature (297)..(301): n is a, c, g, or t
  misc_feature (305)..(305): n is a, c, g, or t
  misc_feature (308)..(309): n is a, c, g, or t
  misc_feature (315)..(316): n is a, c, g, or t
  misc_feature (321)..(321): n is a, c, g, or t
  misc_feature (323)..(323): n is a, c, g, or t
  misc_feature (329)..(329): n is a, c, g, or t
  misc_feature (332)..(332): n is a, c, g, or t
  misc_feature (339)..(339): n is a, c, g, or t
  misc_feature (343)..(344): n is a, c, g, or t
  misc_feature (353)..(355): n is a, c, g, or t
  misc_feature (389)..(389): n is a, c, g, or t
  misc_feature (402)..(402): n is a, c, g, or t
  misc_feature (442)..(442): n is a, c, g, or t
  misc_feature (445)..(445): n is a, c, g, or t
  misc_feature (471)..(471): n is a, c, g, or t
  misc_feature (553)..(553): n is a, c, g, or t
  misc_feature (639)..(639): n is a, c, g, or t
  misc_feature (767)..(767): n is a, c, g, or t
  misc_feature (770)..(770): n is a, c, g, or t
  misc_feature (778)..(778): n is a, c, g, or t
  misc_feature (835)..(835): n is a, c, g, or t
aggancctgcaccggggcggcggggtcgggcgggctgaggccgcgtgtcccgggtcgcaggtccccgcgcgttgtttccgccccggcntgcggcggggacgcctgaactgggctgancctgccctannggcccgcagaaaaacaggccgggcgcngcctgtntccagcnctcgcnctgctcgggggtccagggccananggggcggcgcnggtcgttgggactnggcccagctgccgcggccagcaagtgatcaangcnnnaannnntnnnggctgctgccccattggaaaantaannnnnaagnttnncttgcnncaaanantgagcngantggaatngtannccgggaggnnnctgagtctgctcagtgcctgtgcccttccctcancatcccaaatgcnaaggatgtgcttcggaagaggcacaaaaaaaggagccganagnaccaacggttcatggcccggaaggcnttgctgcaggagcaggggctgctgagcatgcctccagaaccagggtcctccccactgcccacccctttcggggcagcgacanaactgaagctgccagcagtgggaagcagtgtctgagggctggatctggcagtgccccatgcagcagaaggcctgctcccgggaaancctcagggcccttgcccagcaagtgtgtggctatcgactgtgagatggtgggcacgggaccccgagggcgggtaagcgagctggcccgctgttccattgtgagctaccatggcgatgtcctctatganaantacatcangcctgagatgcccatcgctgactacctacccgctggagtggcatcactcggcagcanatgcgcaaagctgtcccttccaggtggccca

SEQ ID NO: 549110 - DNA, 311 bp, Homo sapiens
gcttaaatagacgcactctaacaacgatgtgtaaatacttgcacgcaaggtctaggtcgtgctatccctgaccctgctccccgtttttatccaatgaactatcccctcttgtaaatatgaactcctactaattatttagggggcttccattctgcctctgcgcttcgctccaggcatctatagctgggattggagcccctaccatctttgacctgcttatttgcaagtcctagatgatgatctatctgtgccttatgccgtgcataaatcacagggacactgaagagtgaaatgagagccaaaatcagtag

SEQ ID NO: 549111 - DNA, 510 bp, Homo sapiens
  misc_feature (91)..(91): n is a, c, g, or t
  misc_feature (105)..(105): n is a, c, g, or t
  misc_feature (108)..(108): n is a, c, g, or t
  misc_feature (239)..(239): n is a, c, g, or t
  misc_feature (341)..(341): n is a, c, g, or t
actccgcgaaatgatccacggatttattgccaaattaaatttggctgttccccccgacccatattgatcttaaggaaggtgtactttaaanatgttcggactgcnaanaccccctgagcaatgtcattaatccatatgtggactagtgatgaatagatattttcataagagtttaaatgctgatatttggtggaagtagagagtaactcatattctatcaattcaagtattcttactanggttgctttccctatttgttcaatagactgataatactggaatttatagagtttgagccattacaacttttgtgaggatgtgtttcaaacatttctggacanatcttattttgtatttctggaagaatgtagtaatcttctagaccgcttaaaaccaatgctcccaagctgaatattcttgagaaatttgtttttattatgccatttgacatttcaaatcagtgctcatatacagtaaacttgtgatagaaattgtattttattgcttttt

SEQ ID NO: 549112 - DNA, 397 bp, Homo sapiens
tgcgtctgatgttagcccaggaggtcaagctgcaatgggcatcatccccaaaaacaagctggcagctgggcgtggtggctcacgcctgtaatcccagcacttttggggaagccgaggcggatgggtcacctgaggtcaggagtttgagaccagcctggccaacatgaagaaaccctgtctctactaaaaatacaaaaattagctgggcgtggcggtgggcgcctgtaatcccagctactcgggatgctgaggcatgagaatcgcttgaacccaggaggcagaggttgcagtgagctgagattgttgcctttgcaccctaacctggggtgacaggagcgagactccgtcttcaaacacacaaaaaaaaggctgggcaaaggtgctctttgcctaataa

SEQ ID NO: 549113 - DNA, 568 bp, Homo sapiens
  misc_feature (24)..(24): n is a, c, g, or t
  misc_feature (26)..(26): n is a, c, g, or t
  misc_feature (28)..(28): n is a, c, g, or t
  misc_feature (55)..(55): n is a, c, g, or t
  misc_feature (60)..(60): n is a, c, g, or t
  misc_feature (65)..(66): n is a, c, g, or t
  misc_feature (87)..(87): n is a, c, g, or t
  misc_feature (102)..(102): n is a, c, g, or t
  misc_feature (112)..(112): n is a, c, g, or t
  misc_feature (123)..(123): n is a, c, g, or t
  misc_feature (129)..(129): n is a, c, g, or t
  misc_feature (150)..(150): n is a, c, g, or t
  misc_feature (158)..(158): n is a, c, g, or t
  misc_feature (173)..(173): n is a, c, g, or t
  misc_feature (179)..(179): n is a, c, g, or t
  misc_feature (217)..(217): n is a, c, g, or t
  misc_feature (233)..(233): n is a, c, g, or t
  misc_feature (253)..(253): n is a, c, g, or t
  misc_feature (494)..(494): n is a, c, g, or t
  misc_feature (535)..(535): n is a, c, g, or t
  misc_feature (556)..(556): n is a, c, g, or t
  misc_feature (560)..(560): n is a, c, g, or t
atcacgatgatggacagctggtcntngnaggtcatgtcccaggtccaggtgctgntgtanttctnncagctggaggccatccctgcnccggacagcaagagncagagcatcntgttctccacngaagtntaaaggtcccagtccatctcntggaggcngacagatggcctggnaacctntggctaatcgggccatccgtagagcgggaaccttcctnaggtgtccttgggccncccccaagtgttgggccatntgccaagagacagcgacccaaagccgaaggacaggtggcctgggcagatttcgcccaggtttgggagccccaggctggcctcaaactgtggttttttatgtggccacccgagggggccccaagccagttcatttcagagtccaggcctgaccctgggagacagggtgaagggagtgatttttatgaacttaacttagagtttaaaagatttttactgggtcccttgtcaagatgggccctntttggggagaagggaacgtggccggattccctccctgttgnattttgaataaacgctggtgnttcntcctgtga

SEQ ID NO: 549114 - DNA, 1201 bp, Homo sapiens
taccaaggaaataaaaccggtaagggatcacggcactacagtggtccattaattatctgtggggccaacaccggggactcctacgtaaaacgcttcagcatctatgtggatgtggtccctcatacgtgccgtgggcaccctcgtggtgacagcttggaccacatttgggcccatggtcgtggtgaggcctcgtgcataacttggaatcgtgctcacgtgtctcacaacagctctttctcacatgagctctcaccgtggagggtggaacacacacgtgtgggctccacccaagaaagcgtgcgtaggtccacatacacctttgggcacacaggctccccatctggcttggcctgtggccacagtctcacatctagccccccttgtccacatctctcacatcaatatatccgcaacacagagaaatatgcgggaagacaagaacatttctatttcacaaaaccgcgtgtgtcccgcctctaaccgtgtggagcactcgcgagagagcatctatccactgaagtgggacacacgacaggtcacattccccagaggccacactctccctagagcacagagagcgtgcccctctctctaaataacaatatgtcatccccgagaacctgtctcactctgtgtgccccaaagaagccccataagagagagggggtgcatcccacagtggctatacccccgttctagacctctcgtggctgtggaaacctcctaaatacaccccctcctccaaagggggtatgacggaaacacccatactgtggagtagcgaccaaagcaacactctccctacacgtgggtgggataacacgagcacggccctcctcccgtgcggcgggcacaacaatattcaccccccatctccacggataataacgtgcgagaaaagcgccccccacaatacccataatctcccgccacactgatgcccaagtagccatccccgtgtgagcatactacaacgacacttcacgaccgttcgcagcaccagcacaatagactcccctttctttggtggggggccaacaacacacctcccgcagtggacctccgggtgatgttgctggagaagcaactcaaccaacgatcctcctccttgcccccaaccatgccggagtgtgctcccccgccactcacgggtggtaccgtgaaaacacacacgacgatgggcacccccgccccattcggg

SEQ ID NO: 549115 - DNA, 873 bp, Homo sapiens
tggtattttaagtaaaaacagggtttcaccatgtgggccaggctggtctcaaactcctgacctcaggtgatccgcccacccgggtctcccaaagtgctgggattacaggcgtgagccattgcgccggggccccctccgggactttaaggatgtgacttccttcccatccagcctttctgtctgagcactacccacccagctagactgactgggtaacgggatctaagaaggaggcgatatggctgtttcgaggtcgatgggccaggggcctgggctaaggcacttagacaagcccttgccttgcccacctggtcaccaccattcacagtgatcactcatctgtggcaagaggtgggcagcggaggaagctgactagagatccctgatgtataacttctgggaggtttacacacaaagcagatacagtggccaggggttcaaagaattggaatgagaacttgagccaggaacccggagccaggtatatctgagccctaagtccctctacaggccttcctgaacaaagcagacatctggggagcatgtctcaagctcgggtggggtcacagccagggagggctccaaaggccctgtgagcaggtttgatcctaccaatattccctctggggcctataaggtcttcttatgttacctgtaaactcatgtccttgttgaggcagcaatttctgaattcgtccttcaaaagctcagtggggctttccagaaaataccagaaattggtgtagctcggaacagaatccataagaggcattggcaggggttccgggacccagagctctactagggagctgtcctattcacaatgggcaggggcgtattcaacacaggcacagggagacactcgcgaagcat

SEQ ID NO: 549116 - DNA, 712 bp, Homo sapiens
aagtgtacaaccagcactttctgtggtactcctaattacattgctcctgaaattttaagaggagaagattatggtttcagtgtgactggtgggctcttggagtgctcatgtttgaagatgattggcaggaaaggtctcccattggataatggtgggaagctccgataaccctgaccagaaccacaggaggattatctcttccaagttatttgggaaaaacaaattcgcataccaggtctctgtctgtaaaagctgcaagtgttctgaagagtttcttaataaggaccctaaggaacgatgtgggttgtcatcctcaaacaggatttgctgatattcagggacacccgttcttccgaaatgtcgatgcgcatatgatggcagcaaaaacaggtggtacctccctttaaaagcaaatatttctgcggaatttgctttggaccacttttgattctcagttttactaatgaacctgtaccagcctcactcccagaattgcacgatgcacatttgtgaggaaagattggattcagtcttgcaatttgccaggttccgaggtactatcacatccctctttgaatgtctgcagaagaaattgtgtctgatcctcatttttcaaccaatgtatcctactcctgttgccatttaatgcatggataaacttgctgcaagcctggatacaattaaccatcttaaattggcactaaaaagaaag

SEQ ID NO: 549117 - DNA, 196 bp, Homo sapiens
taacagggcagaggggactagtgcggtgtgcggaagagcatagacggttgctgtagacgagacaaaggccacatctgtatgtttttagactcggagtttgatgagtccctttccctgtggtcacagtcatgtgttgattggccaggtttctcccttgtgttttatacaaaagtagaattgataaaacattttttac

SEQ ID NO: 549118 - DNA, 782 bp, Homo sapiens
ctgctgggccgtagctgtctgtctcgtttctgtcctgcgcgccctgcatcctggccccgggcgcccgctggaggtcgccgatggagccacagttgctgactggtctgctgcccgggcccaggagtgccatggtgtatgcatgtctgctggagccatccctggcgtctgcttgccatgacctgactctcccctcagagtgagactcttcctcagctggtggcatgcagatgacatgatgagctgtgcggctccgtgtgcctgcgtggacctgtgaggacgggtgttctgttggcctggccagtttagtggggagctgcttgcgacacacctgcacatgtcgccacctcctgggacttggtttcctttgtggcccctgggaagtgctctgctgtgctggtgcccttgccggtacttgctggcattgcttccctgcgtaggagcatgcttggcctgcctgtgcttggcgcgggagcgcagtggagcgggggggccttgcttgagcgcattcttgggccaaagtcatttgcctagctatccgtcactggtgccttgctgcttttgctgagcgctagcatagcaagacatgaattcggctgccaaggcttccttaacagtgctcagccctctttagcttccgagacgaggcctccacggacctgcatgtacatcactatcggacactggccatcttttggcagccctgtggatttgcaacaggtgccggttcccattggccaattccgctacttgccttatgattggctataggttaaggccaggag

SEQ ID NO: 549119 - DNA, 762 bp, Homo sapiens
ggacagtgctgacactacaaggctcggagctccgggcactcagacatcgatgagttggtccttgctagcccccgggaatttaattctctacttctatgctctttgtatttctctcgttcaacgatgtgtagcatatgttgcgtaccagagactaactgctgcatcttagatgaaagattcggtagttattgtccaacttacctgttgtgcattgcacgattgtcctggtctacttatcaatgaccaataggtagagcaaggatctacagatcttggggaagacatcttacatcaaggttgaacacgaaaacatcagaagtcaatcagcgtgaataaaagcaatccgaactcacgttataagtcctgatcgaatcatcgataaccaagatatgatagacgctgcgtacatttggagtccaggaaaatgttcgaagaaattatgaagatatgaagcgatcgattgtgaacgacgatgagtcacagatattcgactagtttgcaggaacatctactctagttcaacataagtcaaacaagagtggttaaccctgacacgaggaaggtagcccaagcttgaaagcacagtggccagggagccttgcgaagagacacggtgcaatatccatgatatcgactgggaaagattcgtcactgacgattggcccatcaagggagctacaagcagagcgggcttaacttcaattgacacctctgaaagctagcagacagttcttagtctacctgtggaactcgatgggtctg

SEQ ID NO: 549120 - DNA, 541 bp, Homo sapiens
ggaggtgatctccacatgacaccacaacatcaacatcaacgtcgtggacgaacacacgccgatgtgtgacgggcagtgtgccccctcccctggatcaatatgtgaagttcgacgccgtgagcggtgactactatcccatcatctacttcactgactactgcaacctgcagaaggactactaccccatcaacgagagcctggccagcctgccgctccgcgtctccttctgcccactctcgctttggcgctggcagctctatgctgcccagagcaccaagtcgccctggaacttcctgggcgatgagttgtacgagcagtcagatgaggagcaggactcggtgaaggtggccctgctggagaccaacccctacctgctggcgctcaccatcatcgtgtctatcgatcacagtgtcttcgagttcctggccttcaagaacgatatccagttctggaacagccggcagtccctggagggcctgtccgtgcgctccgtcttcttcggcgtattccagtcattcgtggatctcctctacatcctgga

SEQ ID NO: 549121 - DNA, 538 bp, Homo sapiens
  misc_feature (114)..(114): n is a, c, g, or t
tgtggtggcagatgcctgtaatcccagctactccagaggctgaggcaggagaatcacttgaacctgggaggtggaggttgcactgagctgagataggcgccaatcgccaatccnagcctggtgacagagcgcaatacttgggtctcaaaaaaaaaaaaaaaaaaaaaaaaaaaattttgtgggggcggcttgggccttgggaaaaaaagttttttaagaaccatattggtgttgggggcgcgggggcccccagagttaggttaatgtgtgaaaacattggctccatatgggcgctgtctccctagaggagaaaatccggggatcataggaaattagaggtgctgtggtgattttcttccaacaattttaaaaaaaaggccggcggggggggaagaaacggaaggtgttttttgaaaaaaaatttacaaagagaaggggagttcccgggggagaccatatcacgggtgtttttaatcaacgggggagtttcccaggcggaaagttgggaatttcacaatttgacgaccggggctgggag

SEQ ID NO: 549122 - DNA, 558 bp, Homo sapiens
aaagataaaaaacaaaaaaaaaaaaacacaacaccccacctctatattacacccacacagcgcacaaacacaatcataccttctcccacatctatctactcaatctcctcccctacctcttctctcctccctcccctcactctaactctgtcaataccaccccatcatctacctcatacctacctactctaacataacctacgctcatccactcaattctaataccccccccttcctctctcaaacatcaacctcatctcctaccaacccaactctttccttctatctcctccctcccaactccctaataacacacactacactccttcaatactactctcactcacccactccactctcaccctccatcacctctactctcccacctctctaactcacactccccccttttcaattcactctcccataccctactcatcttcccctctagacctccccaaaacctatcacttctcctcaacattcactcctacccacccactatttcctatctacatcaccacctactctctctataactctccatcccaataaccg

SEQ ID NO: 549123 - DNA, 602 bp, Homo sapiens
catgctgtactcccccggtttacgggatcgttgcggttgaccgtgacctcgcggcagacatggacttgcattgtgactgtgccgccgaaacgcctggcctgccgagccgccgtcgtgggaagatataataaatgctgccttcaaattattcaaagaagagtgaaatcgggtggcaccatgcccagcatttttgtgggtcaaaaacaaatgtgtgtgactgtggaaaagctcgtgtgtcctgactggtgtgctaggtgagtgatgctagtgacccactgactgtgacttgcctgagtgtgcttggatgcttggatgagctggcaggcaagttgagtgagcctgctgctgtgctgtgttgtgctgacatgctggtgcagtgtgtgctggcgtgtggtgtgctgtgcctgaaacccctgtggtgcccccccgagagacactgcagtgtgccctgtgcttgtggtgcatccccttcgccatgcagcatcgtgtgagcccaaaggtctgcacaagtattacttcttccgcttggatggaacgaacagaacgtggccggctcgtgaaaagctggaacgtggagaagccttgtgtgacgtcagcaaatg

SEQ ID NO: 549124 - DNA, 132 bp, Homo sapiens
ccggaaagccccccaaaaaaaaaaacttttccaacccccccccccgagaaatttggggatgaagggtttgaaaataaacccccttttgggggggattaaaagtgatgatggtttggggggagttttttttta

SEQ ID NO: 549125 - DNA, 664 bp, Homo sapiens
cagatgttgacaagacaggagcttcctactatggagaacaaactctacactacattgcaacaaatggagaaagtgctgtagtgcaattagctaaaaaatggccccattgtatgatgtagttaggaattctatgttctactgagttattgtgctgtatatggtattagtgcctgccaaagcgacaattttcaacttgaaatgtgatcctgtatttgactttggaactggtcctcgtaagtgcagccgtactatagccctcatggacatatattagtattagctggatttggaaatctgaggggacgaaatggaagtgtgaggatgtgaaaaatctatcaaacgttagtttctaaaccggtggcttactagattctacatattgtgcttggtgcccggatggtgagcatattttaacagctacatgtgtctcccaggttacgggtcaataagtggaatacaaaattgtggcattagtactggctctatcttgcacaaagtatgatgtgccatctaaatgcagaattatggcaggtttcttggcagccatttgaggctggaatatttccagcaaaaacaataacttaccaatgcagtgccaagtgaagtacccaagtgaggaacctacaagttgcgacagcgttatagacccccaggtttaagaact

SEQ ID NO: 549126 - DNA, 915 bp, Homo sapiens
  misc_feature (901)..(901): n is a, c, g, or t
acttgaccattcttgtgggataagagatcattaaaaaaatgctagggccgggcaccatggctcacgcctgtaatcccaggactttaggaggccaaggcaggtggatgacttgagctcaggagtttgagaccagcctgggcaacatgatgaaaactccgtctctaccaaaaatcaaaaaaattagccaggtgtgatgttgtgtgcctgtagtcccagctacttgtgaggctgaggtgggaggatggtttgggccccggaggtagaggttgcagtgagctgagattgtgccactgtattccatcctgggcaacagagccagaccctgcctcaaaaaaaaaaaaaaaaaaaaaaagggccgggcaaggggctcacgctttgtattcccactttgggggggcgggggggggaaaaacctgggggtccagacgttggagaccagcggggccaatcggggtgaacccccgttcttctaccaaaaataaaattaaaattttctcccaggccgggggggctgtgcctatagcccagttactcaggaagctaaagcccgagaatttgtgctcctgcaggtgacggtggcgtgagccagatcaaccattccatccgtgtggcaacgtgaaccgtgttcaaaaacaggaaggacgcaaggaacattgtttttggcgccggtcggggtcacccctatatcctggccttggggaggcgagggggagagatgctggggcgcaatttgaacgcgggttgtggaacccatctttaaaaaaagggggcgtaatacgcgggcgaatccgtcccttgtaagggcccagtgagtataaaaaagcgggtcaagaaggaaaatgctctaacatggtgtgtgatcacaaccgacatttgatgcttgggtagaataatagcaagnggggacgagatgtc

SEQ ID NO: 549127 - DNA, 131 bp, Homo sapiens
cgcaatacagttctgctccaagtccgctttgccccaatatagcgataacagacatatatttgaactcattctggtctgaggttaaaggtctccactaacccgctaggtctctttccgatcagtagcgtaaa

SEQ ID NO: 549128 - DNA, 825 bp, Homo sapiens
  misc_feature (5)..(5): n is a, c, g, or t
  misc_feature (68)..(68): n is a, c, g, or t
  misc_feature (71)..(71): n is a, c, g, or t
  misc_feature (75)..(75): n is a, c, g, or t
  misc_feature (91)..(91): n is a, c, g, or t
  misc_feature (97)..(97): n is a, c, g, or t
  misc_feature (103)..(103): n is a, c, g, or t
  misc_feature (107)..(107): n is a, c, g, or t
  misc_feature (121)..(121): n is a, c, g, or t
  misc_feature (123)..(123): n is a, c, g, or t
  misc_feature (148)..(148): n is a, c, g, or t
  misc_feature (153)..(153): n is a, c, g, or t
  misc_feature (171)..(171): n is a, c, g, or t
  misc_feature (215)..(215): n is a, c, g, or t
  misc_feature (260)..(260): n is a, c, g, or t
  misc_feature (267)..(267): n is a, c, g, or t
  misc_feature (269)..(269): n is a, c, g, or t
  misc_feature (280)..(281): n is a, c, g, or t
  misc_feature (286)..(286): n is a, c, g, or t
  misc_feature (337)..(338): n is a, c, g, or t
  misc_feature (370)..(370): n is a, c, g, or t
  misc_feature (421)..(421): n is a, c, g, or t
  misc_feature (428)..(428): n is a, c, g, or t
  misc_feature (468)..(468): n is a, c, g, or t
  misc_feature (471)..(471): n is a, c, g, or t
  misc_feature (473)..(473): n is a, c, g, or t
  misc_feature (481)..(481): n is a, c, g, or t
  misc_feature (483)..(483): n is a, c, g, or t
  misc_feature (495)..(495): n is a, c, g, or t
  misc_feature (509)..(509): n is a, c, g, or t
  misc_feature (516)..(516): n is a, c, g, or t
  misc_feature (544)..(544): n is a, c, g, or t
  misc_feature (555)..(555): n is a, c, g, or t
  misc_feature (569)..(569): n is a, c, g, or t
  misc_feature (575)..(575): n is a, c, g, or t
  misc_feature (584)..(584): n is a, c, g, or t
  misc_feature (596)..(597): n is a, c, g, or t
  misc_feature (612)..(612): n is a, c, g, or t
  misc_feature (620)..(620): n is a, c, g, or t
  misc_feature (666)..(666): n is a, c, g, or t
ggggnggaacccatccctctctgcttatacccagcacccctcatcccaggttcctttcttcaacctcngcntgcntctgggaacacagagnaccaanaactgntaanccgggaccctccangnccacagcgtggggcagagtccaggnttttntctccccgtagtgggagntttggggagttcagtgaacctcctcaccctcctgccagtatgangttgggaagcgccttctctgtcccccagaacagaacaaactcttnttctctntngttggggaaanngtgtngggggcttggacctaggaagaagctgagctgaattcctccagggcccaggnnaaacccccaggggagtttctgagactctaganttgccatttctccacttttccttcccaatgactccggtgagcagctcagantctgggntagggcaactggtaggacagtggggatttgccccagaaanatntntgggtttnanatgaaggtttcnccaacaccagattnatttatntgtacaaagggaagaaaccacctgaggnagggggaaaanccgttgggggctantaagantagccaccnttggggccaaanngatggggggggtagntagctctnggaggtaggcggggctctcatccaagtgggacaaagggactgtgtnctcctcactgacaggccggtcaaactcagccttgagagctggacgctgattgtccgggaaggccaaagagaagagggcctcgggctcacacacaaacttgtacacgtaacgctcaccagccaccttctgcatgatgcctttctcataatagtatcggag

SEQ ID NO: 549129 - DNA, 247 bp, Homo sapiens
  misc_feature (232)..(232): n is a, c, g, or t
atggctatcacaccccatccatgatgatcttcttccttaatcatactctgaggatctttctgtgtttgtctgtgaacgaatgtcacgtctctcgtgctaaggaagtagtgtagttagaatagatctctctctctctctccctttcctctctctctgttggatgcttctgtatctttttccacagcataatgtctggtgtgatggggagctatttattgaaattaaagattanttatttgtgccatgc

SEQ ID NO: 549130 - DNA, 1159 bp, Homo sapiens
agactcatatcagagcattgtccgtcatatgagatcacgtacgtattcgcggcagagataccacgcatcatatcatgcgaccaatctagagtctattaacatgtcagtgtggcatctgacacaacagaaccatatagaacagagaattcttgatgcataggagcatgtgcgtgtcctgcacggatgtgcgaagagggctcgcttcaaggtattgcctgggttctatgagagtaatacctgaagaggcatgagtctgtgcaacgctggtagtcagccactttgagtatctccttagtggccaatttagagaaccaggcacatgtactactgtgactatcattgatgccccaggacaccagagactttatcgaaataacgatgattacaagggcatatctctagagcatgacttgtagctggtccgtgattgtagctgctgtgtgttcgcgctgcaattttgaagctgtgtatcgtcgcaagaatggggcgagactcaggatggagcattgaccgtgtctggctttacaatagcgtggggtgtgaaatcgaacgtaaattagtcagggctgttagagcataagacttggagttccgacctggagccgaacccttacaagccaagaaagaagagtattgaggcaacatctgtcgaaaggcaaagttcagtagctgtacatttaaggaaaaattggggctacaaccccgtgacacagctaagcatttggtggcccaatatgctgggtttggcaattggtgacaaatcatggctgggtagcgcacagttggctaacaatgattttgggtcccaacgctgcatgggacacgtcaccccgtcacagcgattgggaattggtcaattttgaaaccacaggttggcttgaagggactcggaatggattgctagcagcaaattcaggcacaaattgacaaaatccctttgacctgggatcttcaaaggagaggtcatcacagaatgcgggcggcatggggcgaccgtccgctcgtttgtcccgtgtgctgaaaccggttgtgaccaaaacccgtgtgtggtcgaccccttgtgttctcataccgtgtacacggcgacgcaaatctggtggatcccatgatagtgtgggaggcttctcggagaacgaagagcactaagataaacttgtcc

SEQ ID NO: 549131 - DNA, 857 bp, Homo sapiens
  misc_feature (61)..(61): n is a, c, g, or t
  misc_feature (159)..(159): n is a, c, g, or t
  misc_feature (167)..(167): n is a, c, g, or t
  misc_feature (174)..(176): n is a, c, g, or t
  misc_feature (183)..(183): n is a, c, g, or t
  misc_feature (185)..(185): n is a, c, g, or t
cacgagggcgtggggctcggtcgcgcggactgaaggacactgaaggccctcggatgcccanaacctgtaggccgcaccgtggacttgttcttaatcgagggggtgctggggggaccctgatgtggcaccaaatgaaatgaacaaagctccacagtccanaggccccncaccgcnnnatccccngnactcccacagccagggtaacgccaccggggacagaacagagaccaggagaagtacaggatacagccacaaaggcgagcacaaatgaacaacaggcctacatcagaaccacgaacagcagcatctagccctagccagggcaccagcccccgagacagacgaaaccatcgccagacgggacagagtggcagaccaacatgaacacgaacacagagcgccagacatgcccaaatgatcatacccgtgacgtgggacccaagaagagacgaaaagagactcaccgcacgagcagagatcgtcaaaaacccaagaccgtaccacaatagggggccgaaataaaaatacacatgaaagaagaagaaacgaattccctaaactaacaagtagagacacggagaaaaggacaaaacgcgcatgcgtggaagataaagggaacgtccactgatagtacagtataccatgcggtacaaaagaacacacacaagacaatagggggcaaacaaaacgagcagagagcctaacaaataccaacgaagcacggaagaaccaacaacgtgaagcaaaaagcaagaaaccgcggaacaagcagcacaagaatagaaccaggcggaacccaggagggcacccaaaaagagacagcaaacagaccgaatcgaaagacaaaaaaggaagaa

SEQ ID NO: 549132 - DNA, 355 bp, Homo sapiens
  misc_feature (8)..(8): n is a, c, g, or t
atggctgntcacccggtgtttggagccctctcagaggtcatagacctctagagagagaaactgagatacataacagggcggaaacaactcactggtgacacactgtggagtcctgtctacaagcagcacacatcaatccaccacacaaaaaccctaggctacagctcagttccttctcttaagaaaaaaaaagtgtgaaacaaataacctaagaatgaggagaaaacaagaagaatgaccctcttgcgagcactctgtaggttttatggcacctctacttgccagagttaatgtaaaatggaagtaatatcgtcttcgtgcacatttacgttaaagaaaaagagccctaaagtag

SEQ ID NO: 549133 - DNA, 163 bp, Homo sapiens
aatagccctggccgtacgcctaaccgctaacatgactgcaggccactactcggccctaattggaagcgccacccttgcgatatcaaccattaaccttccctctacagtaatcatcttcacaattctaattgtaatgactatccttgaaatggtcgccaatccg

SEQ ID NO: 549134 - DNA, 313 bp, Homo sapiens
ctgccacgactcgggcaaatgacatattaatttatacctatagaatctgcctgttcacagggagtgccttaaacctaattgagacaggagtggtaatatttggaactctgaaactaatttttttttgagacagaatctcactccgttacccaggctggagtgcagtggtgcaatcttggctcactgcaacctctgtctcccgggttaaacggatttccctgcctcagtctcccaagtagctgaggcaggagaatcacttgaaccctccgggaggtagaggttacagtgagccgagatcacatgattacagtcc

SEQ ID NO: 549135 - DNA, 420 bp, Homo sapiens
accaagttgctgggttgttttgttttgttttgagacagagtctcactttgtcacccaggctggagtgcaggggcatgacctcagctcactgcaacctctgcctcccaggttcaactgattctcttgcatcatcctcctgagtagctgggactacaggtgtatgccaccatgcctggctaattttggtatttttctcagagacggggtttcaccatgttgggcatgctggtcttgaactgctgacctcaggtgatccgcccacctcggccttccaaagtgctggtattacaggcatgggccaccacacctggcctcagctgttcaattaaaagtaaattcaacttaaaatactatgtatcattggcagtagtgcatacattaaaactgagtagccacatgtgattagtggctatggtattg

SEQ ID NO: 549136 - DNA, 301 bp, Homo sapiens
agaccggccagctcggacgccccaacaccggcaagcatgacccactccactacacccccgaacaacgggcgcagcacggtatcagcgagggtctggtgcgtttgtcggtggggcttgaagacagttgccgacttgctggccgatatccatctggccctggccaagtgcagcgctgccaacctgcggcccattgcgacagcggcgtatgcgatgaaatagcgtccaaccccatgggttatgcggtgcctgggcgacggtcggaaggatccgactgccgctctgcctgtttaatgtttttttt

SEQ ID NO: 549137 - DNA, 359 bp, Homo sapiens
gaggctaagggagtgccagtgcgtagcgcgtggtgcatgtactcttagttacacatcatgagaccttaatgcatgttgctggtctcgggtgggagaaattccctttgacaccttttggggcagcgggaacggggaggagggcatggacgttgatgacccatcttctggctcccttaatggcatgggtggttcagcaacgtgaactttggccgctcccgctcatgcccaagagcccggccgagaggaagcaagatcccccagtcacccacgaccttcgagtctcccttgaagagatctacagcggctgtaccaagaagatgaaaatctcccacaagcggtcgacggacggggtacggagc

SEQ ID NO: 549138 - DNA, 173 bp, Homo sapiens
aactgtgtcgtactccctgtgttttgcgtgttctggtcccaatactgcactgtgctgtggcttgcctcaacgagccaagcccggcggaacttgccgactgtattcgcctggcatctcgattgcgcggagttgtgccagactgccgttggttacattggcacgcgacatcgcca

SEQ ID NO: 549139 - DNA, 357 bp, Homo sapiens
ctatcccgtgggccctggccaagctttagggaggctcctggtctgggaagtaaagagtaaactggggcagtggtcggccactacttaccacccacccccagatccgccggaaaagtaatctgtgcgctgcagaggaatttggggtgtgtggggagcggggaggcagggagcggaaagcatggatgtaatcagtgggcctgaacttcattcctggccgcgggccaagacaccttcacctccaccagctccacaggtggtgatccaaaacggctttcggcgtttccaacatcaacaatttggtgattttgtctctgggctgttataagcccagccaattattggccttttaaaaaaaaa

SEQ ID NO: 549140 - DNA, 108 bp, Homo sapiens
aggtcaatgttacacaaaagtaaagagatcttctcacaacactgttgctatacagaagtataaactggtacaatcttcacaggacaagcaatatggaaatagactaga

SEQ ID NO: 549141 - DNA, 263 bp, Homo sapiens
  misc_feature (215)..(215): n is a, c, g, or t
  misc_feature (240)..(240): n is a, c, g, or t
agccaactaagttctctcttcgtgaaacacaggtccatgagtcgacacaaacactaatgcaagaaccatcacggaaaaccaccgcagcagctgaaacttttatagcccataaaaggaccaaacaagtaagctgaatgactgtgaaaatatgaccttccagagcggcacataacaggatatcaaatcaggctgatgcttagcaggcttcaaatatnatggtcaaatgactggattacttanatgaggcaacttcatatcggaaa

SEQ ID NO: 549142 - DNA, 182 bp, Homo sapiens
tgtttatcgatgcacccactccagcctgagtgacaaagcgagcctctttttcaaaaaaaagagagagtcaagaaacaagagatgctggcgaggctgtggagaaatgggaacacttttacagctgtgggtgggaatgtaaattagttcaaccatggtggaagacagtgtggcatcgataaaca

SEQ ID NO: 549143 - DNA, 1183 bp, Homo sapiens
tcaccgaccaccacgggaaacacgtgtactggtccctcgttggctcccctatttttttggggtgtaccacgcctatttatgtacatacccagtcgatgttgtgttcaaccaaatagtgacgacccggcgctgtgggttcgcccgggttgctccggggcgtttttaccccgcggggggatgtttgtctggtgtgagaatccccctcacggactctccgcgcaggcgctgttttagttgtgggtgtagtaggacaatacacggcgtccgggtctgcccgggggatgctttctccacgcgtttatgtggagcttgctgctccttagaaggccccccacttggtgctgaacgacgcccgccccacttctgccttgggggttccaattgatgttgaccgtgttcccccacgagtgacctgtccttggtgaaatcttatgcccggcgccattagttgggttattaaatgaccgtcccttcgcacgacacgccaagtgtcttgtcgagaccccccccctcgcaccctcgaagcactcgctttggcgcttatccccgcgtgtgcgctgtggtgacgtatgtcccccttattgaagcgcaaataaaatttattacaccaagctcaccatctatggccttatccgcacacaatcaccaggacctttataagtctgcctcacatgtgcaataacatcttctcacaatcacagcctcacattagcccctcgttaggtacacacagcccctattttcatgcccatacccccctctgtaagactttcacccgcgccgtagatacatttctacataattcggcccaccgcgacttaaatcctccacttaacttatttctgccctatgcccaaactcacaatctaccgaaccgccacatccaccagtcgccatctataatcctcttttcaaggacttccaaacatttacatccccactaatagcatttttgatgacttttagcaagcctctgcttaaccttctcgcccttaccccccacctattaacctactgggagaactctctgtgctagtaaccacgttttcctgatcaaatatcactctcctacttacacggactcaaacatactagtcaccagccctatactccctctacatatttacccacaacaccatggggctcactcacccaccccattaacccacattaaaccctcata

SEQ ID NO: 549144 - DNA, 662 bp, Homo sapiens
cttaataggaacactatattacatctgcaacagctgccagtttggatgatgcaatgcctgctatagcaacgcggctgtggaccaacgccgaatactacgctgtacagaggcctggaggcgctacggactagtggtccgtatgtctctgcctaatcagagagaaggatatgtgagccgaattggccatgttgactatccgggcccactccacgtgactctatgtacagtcaacgtactccgtcatcgtgggcgacacagctggtgactgcattgacgcacagctagtactatgaggcgcagaaggttgagatcacgatcccgcagagacacgtgggcgcttatgacctagcaacgtggaacattagtaatctagactagtatgatcatcatagaagaatgctgacttccatagctaacgtgctcagctgcctactagaatagagactgtctgactattaggcacctataatgatgcactgtgctgcgatagagctgaactaggtcccttaaagctgtacgacagagatgttagaacttaaggatagataaagacgattccatgcttttcaagcttctgccactatgcgcggacagactagactgtttggaccaggcacatgttgtcgcactgcaacatttctgcatgatctgataagattttt

SEQ ID NO: 549145 - DNA, 192 bp, Homo sapiens
ctgcgtagtacaggaaaccaaacactccatgttctcacttgtaagtgggacctaaatgataacacgtggacacatagagggaaacaacacacactggggcctatgagagggcggaaggtgggaggagggagagatcaggaaaaataactaatggatacttagggtgatgaaataatctgtgtagaaattgaa

SEQ ID NO: 549146 - DNA, 333 bp, Homo sapiens
cgaactgataactttgggtagcaggccacagcgtcggcaacaatgcctggattgctttacttatgacgagtgtgaatgtgcgcggttcataaaattgcagattgcaagacacgatgccgctgagactgctccggcgcttgtaattgagcataccacatcagcttgtttgaggattgcatctcgttcacttctgcgcgtgaataatccagcagtatggtttgcttcccgccgccgctttgtatttcgccagattaatcgccggcttagcataaacgaatcatcctgcggcaaaacgcgtcggaaatccgccagcagcaggggctttcacaacgt

SEQ ID NO: 549147 - DNA, 100 bp, Homo sapiens
tttcctgacagactatcatcatataactttggtgcacttaactgagtgcataccaccacattcttcagcattgtggatctgtgtcctgacttgtgaaaac

SEQ ID NO: 549148 - DNA, 206 bp, Homo sapiens
gccttggtggagggcatgaggctatgatgactattggctataatatggatatggctttggctgatagatttgaagagacctcaattacgtttttcaggaatgtttgatcatagatacagagatggtggtccagttttcagagcaccacagggcactgtgtacacatgaggggttaccttacagagccactgagaatatattaataa

SEQ ID NO: 549149 - DNA, 187 bp, Homo sapiens
tacatgtagtctacctctgacggctcccccggtcttctcctgtactccgggattcttcgaatgtgtggtagggtggggggcatccataatagtcactccaggtttatggcgggttctactcctattaggacttatatcgcttcgcagcgaaagcttctcccatcatcacaaattcattaatcattac

SEQ ID NO: 549150 - DNA, 905 bp, Homo sapiens
  misc_feature (1)..(1): n is a, c, g, or t
  misc_feature (4)..(4): n is a, c, g, or t
  misc_feature (49)..(49): n is a, c, g, or t
  misc_feature (52)..(52): n is a, c, g, or t
  misc_feature (59)..(59): n is a, c, g, or t
  misc_feature (61)..(61): n is a, c, g, or t
  misc_feature (64)..(64): n is a, c, g, or t
  misc_feature (104)..(104): n is a, c, g, or t
  misc_feature (113)..(113): n is a, c, g, or t
  misc_feature (131)..(131): n is a, c, g, or t
  misc_feature (157)..(157): n is a, c, g, or t
  misc_feature (159)..(159): n is a, c, g, or t
  misc_feature (168)..(168): n is a, c, g, or t
  misc_feature (189)..(189): n is a, c, g, or t
  misc_feature (197)..(197): n is a, c, g, or t
  misc_feature (207)..(207): n is a, c, g, or t
  misc_feature (212)..(212): n is a, c, g, or t
  misc_feature (219)..(219): n is a, c, g, or t
  misc_feature (230)..(230): n is a, c, g, or t
  misc_feature (239)..(239): n is a, c, g, or t
  misc_feature (271)..(271): n is a, c, g, or t
  misc_feature (274)..(274): n is a, c, g, or t
  misc_feature (293)..(293): n is a, c, g, or t
  misc_feature (303)..(303): n is a, c, g, or t
  misc_feature (311)..(311): n is a, c, g, or t
  misc_feature (318)..(318): n is a, c, g, or t
  misc_feature (324)..(324): n is a, c, g, or t
  misc_feature (326)..(326): n is a, c, g, or t
  misc_feature (338)..(338): n is a, c, g, or t
  misc_feature (340)..(340): n is a, c, g, or t
  misc_feature (390)..(390): n is a, c, g, or t
  misc_feature (398)..(398): n is a, c, g, or t
  misc_feature (406)..(406): n is a, c, g, or t
  misc_feature (431)..(431): n is a, c, g, or t
  misc_feature (443)..(443): n is a, c, g, or t
  misc_feature (479)..(479): n is a, c, g, or t
  misc_feature (481)..(481): n is a, c, g, or t
  misc_feature (485)..(485): n is a, c, g, or t
  misc_feature (830)..(831): n is a, c, g, or t
  misc_feature (875)..(875): n is a, c, g, or t
nacnatggctgaccacaaccctgaaagcgattccacgccgcgcacgctnctncgacgcntnctngatacagcggacccgcgcaccccgcggcgaccccggattnctcgggctngagcccggagagcccttntttaaacggcttcccccaggaatttnantggccaaanaaggacgatagccaaagggcnttcccatngagccagttnttttngcagatnggcccatattnaggccattnggcactttgaggaacagacacctcggacgctnctnaagaacatcctactaactnccccagaatnttccatcnttattcnttattngntatttaagccantnccagcaccgcagcggtccaaccctccaaacaagaaagcagtttcggcacnttgagctncaacttcnttagctcgagccccccacaaccctngctccaggtctnctggcccctggcaggaggaaacagaggctgagactntnattntttcagcagggattggaccaggggctttctctctcccaagagcctcaagggaattctgatgcctcttccctcaccagatccctcaacctgacctttgccacacctcttcagccacagtcagtgcagaggcctggcttggcccgcagacctccagcccgccgagctgtagacgtgggtgcctttttgcgggatctgcgagatacttccctggctcctccaaacattgtgttggaggacacccagccgttctctcagcccatggttggctcccccaacgtgtatcactccctgccctgcacgcctcacactggggctgaagacgctgagcaggctgccggtcgcaannacagagcagtgggcctgggctgcagaagaatagtgagtgtgtgnactgggtggctggagcaaatttagcttggg

SEQ ID NO: 549151 - DNA, 1010 bp, Homo sapiens
ctggataatcatcatgatgagctacacgttgtgacatgtaatagtgacctagagatctgtcattcgtaggtgtctctcattaactggtccccgaggagtgctgaaagagacgtccagatggaagttctagagtgtcaatcacggggatcatttcaaccctggatgtcaactgcagtagcatgcggatttgcaaattaacgcaccaggtcagtgatcgtggattaacgcacctgtggagtaaaccatggtcaaggttgtaccacacagagagtcacggccactacttgctaggcaaaatatcttggtgctcgaaatcgcctgcacaaatctgagggcggtactccactacaatgaggcagactggaacaagcgtcttcaagagtggtacattaccacaaaagtggtgtacccagggaaagtacccacttatcctaaataatcatccggattacctgtgcatttacgtggctataacgacaactctgcgggatgaaggcatatctcatcaattcggaaacacgaacctggtgacataaaaatgagcctgaataacaaatggttgttgtaaaaatgataattcgacggctcttattaaaaaacgggtcgataaatagtccatgagtgacacgggtcgggggttatacaagttacaatatggagcagaatggattgaaggtggctcaaaaaattgttgtgtaagcatcgccattggaaataatttaaacggtgagtatatgcaagggatttcttctctcactttgtatattccgtcagctcagtaataagccttataattcagagatatgccatacgtatacaacgaatcgcgagaaagggaactaggcagatggagatggccaatctatgagttccaaatagtgagagagtattgagtagtataaagagtatctataaaaaagagggtagtgttagaaggttatagaagatagtgacaggcgaggtatgaacaacagtagtataagcgagaacaataggttgtttaaaacagt

SEQ ID NO: 549152 - DNA, 122 bp, Homo sapiens
atagcccggtccagatatgcgagaaccagttctcgagctgttcaaggacttggactaagtctgataacttcccaatcagatagctgatattgggccagaaatgaagaagaagtttgcagatg

SEQ ID NO: 549153 - DNA, 377 bp, Homo sapiens
  misc_feature (4)..(4): n is a, c, g, or t
gagnattccccacttgatgcccctggaatgcttacagtgtactgtggatacgggggattccctttccccattcattgacatgtctctctgcttggctgtaaactattcttgggaggacacttattgccaagtgaactctttccccagctgattcgtgtctaatgaatgatccattactgttgcccttttccttgattattacactgtctgtagcataccatagaatcttgtctgtacttcattcgaaaagtctcaatagagagtatacagtcctagagaattcctttatttgttcatgatctcattgattacccccgggtattgtcttttgacgtccagcagtccaaggtattgagacgtattactggaattcagaa

SEQ ID NO: 549154 - DNA, 926 bp, Homo sapiens
tggccgtaaacggaccagagcgaagactcaggacatccgccggccaaaaggtggctcaggggaaagcagctgctcacgagcagagggcaagcacaggctccaggaagagagccctcaaccgccaatcaccagcataccctctgactcaatgccaaggaagagacacggcgctgacaagtctaacaccgagacacgacgacagctgggacaacagaaggcgtattagtcccgatgacaccagaagatcgggaagagtggacagtccagaaactgttcccaccagctggaggaaggggccaacggagggtgagcagcaaggggccgtgggagtggcccgcaagagtcctcgcgaatggacctatgcgggcctgcccacagactacaaatgctcagaccagctcgtccgagataccaggccttatctccaagagccagagatagtggggagactttcttggactttggatgaggacaaagcggacagtcaggctggtcgaaccaactgctcggtgaacaccctccctccatcgttttcgtttcactgtcctccaagaccagcgggaactggcagaccgccaacgccgcccataaaagcacactcatcccctcacgtgccgcgtcgccctcccaggcgtgctcaacaggggagaagaagtgtaggctctcttcgcgtgcacggccaggacagcgtgcctccgcgatgatcaaacgccacagctccgggacgccagagttggggatgacatgcagctcagctctgggctccactgggatgggaggagaggacaagggaaatgtcaggggcggggagggtgacagtggccgcccaaggcccacgagcttgttctttgttctttgtcacagggacatggaaacctctcctcatgttctgctttcgattcgttacagcgcaggatttaccaaca

SEQ ID NO: 549155 - DNA, 117 bp, Homo sapiens
gccggtcctgcacacgcgtagaacaaacctgtgaagtcactgtggacgaagttttgcgcaacaacttcgtccattcagacttgatcttaagaagtgtctggtttctcggcgtgtgca

SEQ ID NO: 549156 - DNA, 157 bp, Homo sapiens
gttatcctacctacaaggaaaaggtaaggaaagggcctcgaggccgcccagaagtgatcttacaactatgtccaaagacccttttattcgaatgtcctgggagaagggaggagggaaagagtcggcatgtagactttcagtgttttaaggataattc

SEQ ID NO: 549157 - DNA, 399 bp, Homo sapiens
  misc_feature (266)..(266): n is a, c, g, or t
  misc_feature (350)..(350): n is a, c, g, or t
  misc_feature (354)..(354): n is a, c, g, or t
gggtcggggcgggttcaggcatcccgcaggatggagtctccggctgcaggcgggccagcggcgtgtgggggccattctccagctgctcctgaagagtccggatctggcccggcagctgctgcacctccttcacgtgctcccggtagctggccggcatgcgtgcctgcacagccgtgatctccggctcccgggccaccagctggctttttcactttgggcctcccgggctggtggctttgggccttttctggtggccatctcctggntggagctccctcaagttggctctgtggcgacagccgcatcttccggttctggtggccagcagtttttccttctcttccagcggncgtntcagaatcgccacagggtcacccttcggaggggccttggggggta

SEQ ID NO: 549158 - DNA, 501 bp, Homo sapiens
  misc_feature (492)..(492): n is a, c, g, or t
ctactcttaccatgcagcttcgcagttctgctgctaggtacttccccaagagaagtgaaaacgccagaacaagaaccctcaacaccaatgtttatagtggctttattcaggattgctcaaaaagaaaacagcctaaatgcccttcagctggtgaatgggctgataaaccatggtacattcatacagcccagtcctaccaagcaatacaaaagaatgaatgcccgagacatacatctccatggaggactctcagatgcattttgcagctaagtgaacagtttcagaaagcttcatatgctgtatgactccgtttcaataacagaaaacagatgaatgattgccaggtgcgggaggggctccactacggagaggaattcgagaacgttgggagtggtggggtcatggcagtagctacgtgatgataatgtgtccgtcagaattcgtagaaccatatattgtactctgtaaattacccttcaataaatccctctnttaacactc

SEQ ID NO: 549159 - DNA, 400 bp, Homo sapiens
  misc_feature (135)..(135): n is a, c, g, or t
  misc_feature (150)..(150): n is a, c, g, or t
  misc_feature (161)..(161): n is a, c, g, or t
  misc_feature (167)..(167): n is a, c, g, or t
  misc_feature (194)..(194): n is a, c, g, or t
  misc_feature (215)..(215): n is a, c, g, or t
  misc_feature (305)..(305): n is a, c, g, or t
aactctctaggctattgagggtcatcatttgaatgctgagaagtgtcacagatgctctgaaacacagatccttgagggctcttgggaatatctgtaaggtcacactgcagcacaggtgatgctcatacagtcctngagtgagtctaacangaaatgatgangcactngtggaaattctaacaacaaatgtgaangtaattccagaaaagcaccangtggcagtaacaaaacattccacactgtgcagaatggtttgcccataaacaggtatcttggaaacataaatacaccaaagaaagtcaaantactgagcccatattaaatccttttggaggaacgaaccaaggggaacatttccacggattggaaaaggagccaccaagtattacaagaccaactt

SEQ ID NO: 549160 - DNA, 663 bp, Homo sapiens
  misc_feature (95)..(95): n is a, c, g, or t
caggaggagcgcgcgggcacaggctgcgggtgactcgagggtgtgctccgacgtccagaattggacgtgcttgatgacacgactctgctgctgtngagtgtaagtctgcttgctgatctgggacgagtgagtcagcgtgcctggagagaccagtactggtgctcatcactagtgaactccatgtacactgtccgatcacgtgaagctatgataccgatccatgtattgggaatgttcatcaatgcttgtcatacggggttgcatggaggattaaccgactcgtcgagtagaacaaacagcaataccgagagatgcgcatgagacttgtctctggtcaaggctataagaagccgaaagaagaagataggaggactgcccttaaatgagaccagggaatctgatacatgctgtggacctcgcagtgagtgttgcggtgatgagcatgagtggccctctgggaagagtgtaagccctgcctgaaacagacctgcatgaagttctacgcacgcgtctgcagaagtggctcaggcctggtttggccgccagcttgaggagtccctgaaccagagctcgcccttctacttctggatgaatggtgaccgcatcgactccctgctggagaacgaccggcagagacgcacatgctggatgtcatgcaggaca

SEQ ID NO: 549161 - DNA, 433 bp, Homo sapiens
attgagtcgcgtctagcgtactaatgttgcatcttgaccttgagagtccgttgacccacagaactggcacaattaggctgggtgcagtggcttcatgcctataatcccagcattttgggaggccaagccaggtggatcacctgaggccaggagttcaagaccagcctgacctacattgtgaaaccctgtctctactaaaaatactacaatgagccaggtgtggtgcatgcctgtcatctcagctacttgggcagggtgacgcaggagaatcgcctgaacccgggaggcagatgttgcagtgagccaagatcacaccactgcattaatctgggcgacagagtgagactccatctcaaaagtaaagaaaaagtccaaagaccatacagatgactataaaggatggatgggcctttgactttccgagctgcctggg

SEQ ID NO: 549162 - DNA, 297 bp, Homo sapiens
  misc_feature (1)..(1): n is a, c, g, or t
ntcagtctgcgacgactctcttaatcctccaccgctacacgttgtaagcagccactgctttactttaataatcaacaaatagttatggaaaattcggtcacgtaattactctcatcgaaggactcattaaaaggaagagacacatcctctcatactccctgagactctgagaacagtggacgcagagggaagagatgatcatttgtgaagccccaccacagtggtcaaaaggcgtctgtatctgacactatgtgtgtgttctaaaataaactgcgatgcggccggtaccctttaggg

SEQ ID NO: 549163 - DNA, 884 bp, Homo sapiens
  misc_feature (23)..(23): n is a, c, g, or t
  misc_feature (142)..(142): n is a, c, g, or t
  misc_feature (144)..(144): n is a, c, g, or t
  misc_feature (146)..(146): n is a, c, g, or t
  misc_feature (190)..(190): n is a, c, g, or t
  misc_feature (192)..(192): n is a, c, g, or t
  misc_feature (237)..(237): n is a, c, g, or t
  misc_feature (242)..(242): n is a, c, g, or t
  misc_feature (279)..(279): n is a, c, g, or t
  misc_feature (281)..(282): n is a, c, g, or t
  misc_feature (315)..(315): n is a, c, g, or t
  misc_feature (323)..(323): n is a, c, g, or t
  misc_feature (326)..(326): n is a, c, g, or t
  misc_feature (333)..(333): n is a, c, g, or t
  misc_feature (336)..(336): n is a, c, g, or t
  misc_feature (339)..(339): n is a, c, g, or t
  misc_feature (342)..(343): n is a, c, g, or t
  misc_feature (349)..(349): n is a, c, g, or t
  misc_feature (370)..(370): n is a, c, g, or t
  misc_feature (383)..(384): n is a, c, g, or t
  misc_feature (394)..(395): n is a, c, g, or t
  misc_feature (416)..(416): n is a, c, g, or t
  misc_feature (427)..(427): n is a, c, g, or t
  misc_feature (445)..(445): n is a, c, g, or t
  misc_feature (457)..(457): n is a, c, g, or t
  misc_feature (567)..(568): n is a, c, g, or t
  misc_feature (671)..(671): n is a, c, g, or t
  misc_feature (884)..(884): n is a, c, g, or t
tctctcaaattttttgaattganttatttaattaatccatcaacctctcatagcaaatatttgagaaaacaaatttatattcagattcttattttcagtagggaagtaagaagttgcagctcagtgcacataaagttgaganananatggagacatccagccccacctctctggaacaagaaagatgaantnggaggaaacacaggtcagcatgggaacaggggtcacagtggacanaaggntgggctgtctctccacctcctcacattatgctaacangnncgcagacacattcaggtgcctttgcagaaaganatgccagntgntcttgangtnacnttnngggggngtgaagaaatcctgcatctcngtccctcacaagnnagctgtctcnngcttttcaagctgtggggggnacatcggggcnctgggcactgtcgctggncgcagcctgagngtggctccctccttttccacctgacctcttcctcctacacatcacagcggcgaccacagctccgatgaccacaactgctagggcagccaggccagcaacaatgcccacgnnggggacggtggactggggagatggctcccatctcagggtggggggcttcggcagcccctcatgctgtacatggcatgtgtatctctgctcttctccagaaggnaccaccacagctgcccacttctggaaggttctgtctcctgctggtctggtctccacaagctcggtgtcctgagtttggtcctcgccatcccgctgccaggtcagtgtgatctccgcaggttagaagcccagggcccagcacctcagggtggcctcatggtcagagatggggtggtgggtcacatgtgtctttgggggggtccgcgcgctgcan

SEQ ID NO: 549164 - DNA, 535 bp, Homo sapiens
cagtgtgccctgtggacaatggtacccgttttccactgcaactccattggacttgttctgcctaagtaacgaccgtttttctttttcgcctctttgatgtttctcgttctcgtctctatagcaaccgatgtgccgtctgtgtgcctatggcctcttcggtgcggggccttgccgagcgcaacagtctacctccgcgatctcttctttgagtcccttgattactcaggtaccgatggttagcctgcgcggacgtggcagggatggactagggcagggcagctggagtagtaagaccttacttgccacgtcgatttgggagtttgctaacgtagttttacagagctagatctgtgtgcatgtgtgtgctttgtgtatatatacatatctagggctagtacttagtttcacactccgggagctgggagctcaaacctgatatcagttgtctttctcttaagtttcttaatagaaatagaatagtcgcgcagcttgcgcgtcccccccctacccccttttttaaaaaagtgtacttgtg

SEQ ID NO: 549165 - DNA, 293 bp, Homo sapiens
gtgtcattatataacattcctttggcttataattcttaaagagaatgataatagcaaaagtgatgcaaaatcttcagtgtgagattatgcatcacttttgcgtattatcgattgcttttaagaattataagcagaaaagattttacgccttaatgtgtcattatataacattccttaaaagaattgtaaatataggtgttagtgatctgacattttaacttgaaagcgatatgctgcaaagataatgtatttaacaagtatttggtggcaaatattcaataaatagtttacat

SEQ ID NO: 549166 - DNA, 100 bp, Homo sapiens
gcagtacggatgagaaaactaccaaaagccggcaaatctccacaaccagacccaggggacaccccagcaagcacaaagcaacgggcccggggtaccgagc

SEQ ID NO: 549167 - DNA, 646 bp, Homo sapiens
cttttcttatgagaaatggttattggcaaaaaaaaatatttttacccttggttagaaggcaaatttcctgtgttaaagtgggccacagggttgaaaattggtgtttttccattttagccaaggagagagaggtttcttgttaaaacgggggtcaaggaaggtctttttgattgagaattctggatggtttaaggaaatattcttgatcacattgcggtatttttcagccctgggaatgatttaacggccgttattaatgttttaggtgtggggccatcgcgcattcagagcagtcttattcattattaaccagggattcattcaattcctcatatgtatcatacacagttatgggtgtcatggcatagtagtcggggaggatagatacatagtgttttgggcaattagtcaatttgttcacaatgtccttatcatctatgttgagcattctgtccattatagtgagaagattgtcgtaggtaggcagcttccttgtatgagagttctgtctaaagaatgaacatataagtgttagatatagtcacggcttaagggcgagataagtttccatttaggctgtgtcgtgtgaataaatcagttgttagcacccccggcaaagtttttataacaggccagtgtaatttag

SEQ ID NO: 549168 - DNA, 695 bp, Homo sapiens
tgaacctttatggtttacttattccaaccggaacagatgaaagagagggagaacagggagagcacgagatggaatggcccacacttgggaaggactgcgtcaatactaactttgtgaggatagggggcaactcagaaatcctgcactagcattactcggtgtgagatgcaaagtgggcaacagcctgctttgtgtcctgagttcgatagttgcttatgaagtaccatataccatcgaaacccagcaatgcttaagagaaatgagagcatacccgtaaattcggatactacgtcatgcaacatagtcacagaataaatcacttttacatgcaacaacaaatgactctagaacattctaccaagtgaaagaaaggttcaaacatgataccattcttctcttctacaaagagaaaaatatagtgacagaaaacagatcagtgatagccaaaggcctgcaggtagaattgcactgcaaaggggtctagcgaatgtccaaggcatgtttttgggggtgatggaaatgttctatatcttgcattgtggtagttaaatctgtataatttgccaaaagtcaaactgtataattaaaacggttattcatataatttataaacaattatatttcagtccaagctgatttacaaaaagaagcatttggttttgtgagaagcctcagacacataggtagaaagcaag

SEQ ID NO: 549169 - DNA, 285 bp, Homo sapiens
atctatagatgattctccgacacctgggggtaagtcgaggagaggaacctgagaatctggaggtgcgggagtccgctgacagataacaggcaatgatcggcagatgctggaggtcaagcactgagtacaattgaccctaaaacagatgactgtgatgcaggtatgtgggacgcggaaacggagagacagaaaaaggagggctgaaatagacaagggatgatgtctgaaggagtggcaaatgagggatttgggaaaatagtaggctccatgcctgattcccatggg

SEQ ID NO: 549170 - DNA, 595 bp, Homo sapiens
aaatttatttttaatataattttattttctaatcacaaaaaccatcacaacaaagaaaaaacatcaatattacaaaatctcaagaaaattcactaagtcacgaaaaaaaaaaaaaaaaactttcatcataaatctaccttgaaacaaaaactgaaaaaaaatcttatataccaaaaagtctgaccgaaaaaaagcgaaaaaaacaaaaaatccacgttactaaaattaacaaaaaaaaagataaaaatattacacaaacaacccgtacatatccaaccaaggcacaaaccggataaataaaaaccataaatgcaaattgctatacacatcatcgtctcaactaccaagcaaaaaactcctctaaaaattttctatccatacaaaaatatatccttaattcatacaataaaaacattaataaatttaaaaaaaatatacataatttaaaacaaaccataaatacaaatggccaatacaaataaatcaataattaatagacctaacattaataagaactttaaaaaaaaataattaaccacaattaaatctctcacaaaacatacataaaaaaaattaatttacaaaataaataaag

SEQ ID NO: 549171 - DNA, 423 bp, Homo sapiens
  misc_feature (31)..(31): n is a, c, g, or t
  misc_feature (322)..(322): n is a, c, g, or t
  misc_feature (411)..(411): n is a, c, g, or t
  misc_feature (415)..(415): n is a, c, g, or t
  misc_feature (418)..(418): n is a, c, g, or t
aaaaaaatggcccctacccaaaagctttcanaactagggacttaaccctgaaaaacgaagattttgttgttgttgtttgaagatggaatttcgttcctccgttgccccaggcctgcagtgcaatggccgtgatcctcagcctcactgcaaccctcccgcctcccgggttcaagcgattctccctgtcctcagccctccctgagtagctagattacaggtgcccgccactatgcccagctaatttttggtatttttagtagagatggggtttcacaacatgttggcgaggctggtcctgaactcctgacctcaggtgatcccnccgcctgggcctcccaaagtgctgggattacaggcatgagccaccacgcccggctgagatttttatagataggattttttaagagaatnaaanacnggact

SEQ ID NO: 549172 - DNA, 1791 bp, Homo sapiens
  misc_feature (515)..(515): n is a, c, g, or t
  misc_feature (681)..(681): n is a, c, g, or t
  misc_feature (719)..(719): n is a, c, g, or t
  misc_feature (724)..(724): n is a, c, g, or t
cttctgcggagaggatgtgtgttgtttgtgtgtcggcgtctgttataactaattttgttagggatgagggggtggtccgctccgtgtgggcgcttaatacgctacgccccgcgcgcaagattggtcgtcctatgttgttctctccaagggggcccgtcctccgcagtgtgcccctcttctgtaggagcccctcttgtctctgcctccattgtgcctgcccccctactttcttacgggaggggaatgttcctcgctcattagttaagtcccctttgttctgcacgccgaccccgctccctgaactgtttggtgggagaaagtcccctcgtttggggggggaccacctttctttttcttttcccggggccttattggggggaaatttctcctccacgggagagcgcgcgcgtgttgttgcattgtggtgtgcccgctgcccgtgtgatctctccctcgcttgtttttgcccccccaccacagtgttggggtgtccccttgtttgtcatgaagaattntttttgttgcgcaacacacaaatatttttggggggggaagcgacacaacacaacccatccttctttcggggggggcgccctgcttctctccccgccgggagaatgactctggtgccttgtgtcagcgcaccgaccgcacccctttgtgtggtgaagcaagtacatnttttttttgtggctggagggcagactggtggcgtgccnccctncctttatgatggggtgccttccctcgcgcgggtaggttttcctcacccctcgaagtgctccccccgtcccgtcgtgttactgagtgagttgtctccctccgtccccttcccggcagtatgtttcgccccctggctgtttgtgtgtcctcctttattgaaagaggaggaagcttcttccgtcttgtgtttgttaggaggcgtagcacctccacaacaagcagagttgttggtgttgctccttcctttgtggcgactgtcgggaagacacaagccaccgactgcgctgttggaagctgcttctgctttgctgctcctgtgtggggccgactctctgtttaagtttgggggtggttttctcaccaggagaggcccataatatgtctcccagcagttttgtggacgcttcggtgtgtgcccacacagtgttagacactctctccctccccccccctgctgctacactccctacgtgtcctcacagcccacacctcaaaggtgtgggcctctactctcttgggggagacacacacccagaggttctcacaacagagcccgcgcgagagggttctcccccctctgtgattcacattctctcccatactctcacaccccaaccccagcgaggggaacactttgtacacccactgggtctccccaccccctgtggtctctctcgtgctctctctctctccagacacccctcaccaaactcgcgcccaagaccagatccgcgggagagcttctcccctctccacacaccaacattcgttagacaatagtggattgccagaatagtggaaataccaaaacgcgttgctttgtctttttgttcttgttttgattctaccccctcggtcccgtggtctgccacagacagccttcatttctctgtaaataatagtgacttgggaccaaatagtttgacacccacgagaagtggtccatgaatagcctggtgttgggaatgttttgcactattctgactttttggtctcctgtaaaaatatgtttattcacccccagaccactttaaaaaaggacaaccccctaagaaaaagaaaaaataa

SEQ ID NO: 549173 - DNA, 104 bp, Homo sapiens
cgctgcttttcactgcgatgctgtcttgtctagtgaaaacgggttcctcctctttattacagctgttttcacttctctgtttttctaccagtgggctctacatt

SEQ ID NO: 549174 - DNA, 402 bp, Homo sapiens
gcgtaagggtcatgatgttacatgctaatcatagaaggagaaactgcacatttttttgaagaaatcaaggaggaatgatagaagatggtgttatctgtcctctgagttaggttatgtgttgaaaactgccgtacaggtactgtcttcattagaaaactctgaatctcatgttgaagaaaatcaagaaaaactggctctggatctccgattgtcaagttctcgagcagcttcttatgccttaattattggtacaactttggaacatgccagagctgagaaaaagaaactacgctaaacgttgcgggaatttcgtagaagcttttatcaaccatatggaacgaatgcccagaacgagtgtcgtgtgccagtgcttgaggagtacagagagttctagaaaattaa

SEQ ID NO: 549175 - DNA, 233 bp, Homo sapiens
  misc_feature (68)..(68): n is a, c, g, or t
  misc_feature (131)..(131): n is a, c, g, or t
atgatcagcggaccgggttccttagtcttttttccccttttatgtggagaatgggatctcgctatgtngcccaggctggtctcgagttcctggcctcaagagattctctctcctctgcctcccaaagtgtngggattacaggtgcccaccaccacgccccgctatccatactcttttaatgctttactgttgagttttaaaattcacagtgattttttagacaaagggaaaca

SEQ ID NO: 549176 - DNA, 786 bp, Homo sapiens
  misc_feature (535)..(535): n is a, c, g, or t
cgtggaatatttcccgggtgtgtgttagaaaattgattttggccgtgagaaaatcacatgttgtgccctccctcgtgggatagtttagttgcgggtgtacagacccgccgctatatgtgctctctctcgggggtgatacaaccgacgaggagtctaaataattattctactcgtcgtctccgactatttagcggctgctatggcgttggtagaccggcccgacgatgttatttatttgctacactgggggcgccccccctctctatgtttacgccccaccgcagcatgttgatgtggtcctacagcgcgctgagaggctccctacacacgactcctcagcacatgtgtgtttagatggtagtctctataataaaatgatgtgccctttcgccctcccaaggcgctgtgtgagatatatctatttggtgtgtttgtatagactcttcaaggtggagacacacccatgtatcaactaatggttctgtactgtgtgcggtacgtactcaccccacgcaataaatgtcagtcaaacccntgtgtgtctgtgtgccactaagagaatattctgttatgtctatatgtgttacaacagtggttactatcgcgggcgttcttctagccctgcgacgggagaatgcttatgttagtttaggataagtaagtctcgataagacgcacgagggttctctttcacgctccggtcatcgattagtacatgagagctcacagttgtaccactgaatcagtaggacttcagatctattcaacggacccgacaatgtcgca

SEQ ID NO: 549177 - DNA, 653 bp, Homo sapiens
atgcgggcacactattccacatgtcacatatgccagcgtgtcacactatatccactttcacactattctactgtcacactatgcccgtcacactgattccactgtcacactattccagtgtcacactattccactgtcacagtattccactgtcacactatgcccatcacactattccactgtcacactattccactttcacactattccgctgtcacactattcccatcacactattccagtgtcacactattccactgtcacactattcgccgtcacacgtattcccggtcacactattccactgtcacactagtgacccgtcacacgtagtaccactgtcacactattccagtgtcacactattccagtgtcacactattctactgtcacagctactaccctcaacacccactcccgtcttagcccatagtgtgcctgttgccatactagtcttagccgcctgcgaagaagcggtaggggcctaggccctactagtctcaatctccaaacagatagtggacaagacaacggtacataagctaaagcttactccaatgctaaacacaatcgtcccaaagagtatattactacccactgacatgactttcagaaaacacatagttcgatcacacagcagccaagactaatat

SEQ ID NO: 549178 - DNA, 648 bp, Homo sapiens
cacgagattcagccaagtatttgttctctacctcattcagtataaggcagcctttaatttgcttagaaggcaacattagaaggttagagttcagcaggaacatagaattttaaaatgtgacttcaactgaataaatttgaatttctctagggagtaaagaatcaaaacacctatttaaagactgcaaaatatgataattatttttaaagtaattgattaaacctggtaggttttcccaaaatgaaaaacaatcagttctaaaaccaaagctgatttttagaaaatgtgaaaatgtaaatcaaccctatccataatagattctctaaaactttatcttacagtcactttcaaataactattcaaaaatgtaactgctatattaacgtcttaaaataatttaaaacattttaaaatatgaatactgtagtttaaaacaaagaatctaggggaaggaaaagtagacaaagaaatgccaattccagtccaaagctgtatttgccaagttttcttagaatgacttttaccgatttatgaattcttatacacagaatgcataatggaaatactgatttttgtctaaagtggcattattgactgctgctgtgatgctactataatgtaatacattattaaattgtttcaaggtgc

SEQ ID NO: 549179 - DNA, 898 bp, Homo sapiens
cacgagattcagccaagtatttgttctctacctcattcagtataaggcagcctttaatttgcttagaaggcaacattagaaggttagagttcagcaggaacatagaattttaaaatgtgacttcaactgaataaatttgaatttctctagggagtaaagaatcaaaacacctatttaaagactgcaaaatatgataattatttttaaagtaattgattaaacctggtaggttttcccaaaatgaaaaacaatcagttctaaaaccaaagctgatttttagaaaatgtgaaaatgtaaatcaaccctatccataatagattctctaaaactttatcttacagtcactttcaaataactattcaaaaatgtaactgctatattaacgtcttaaaataatttaaaacattttaaaatatgaatactgtagtttaaaacaaagaatctaggggaaggaaaagtagacaaagaaatgccaattccagtccaaagctgtatttgccaagttttcttagaatgacttttaccgatttatgaattcttatacacagaatgcataatggaaatactgatttttgtctaaagtggcattattgactgctgctgtgatgctactataatgtaatacattattaaattgtttcaaggtgctgttttgcctaaaaattttgtgtgtcttgaaaactatagtattgggtattgagactctgcaaattctcggcatgcttggcatgaggtaatcggtttttattcttacaaaattgtaactatgtaagtgtgtttattaaaagaacacaaactaaaaaagttaacaggaattaaagttgtgggatgaaaaagttacaggataaaaaaatactgtggaaaagtggcaaaaaaaaagttgtggaaaaaaagtaaa

SEQ ID NO: 549180 - DNA, 1198 bp, Homo sapiens
gcaggcatggcatgggttactctaggtcgaagctgaccctacatgtgggtgacagttctagaggttcatgaaacagaatcaggatgcctatcgaggtgatcatcactgactcctcagcaccccatgggccccgccgagagagtctctgcaatggagtccgtattaccagcatccattaagacggcccttcaagtgacagatggttgtccttcttgctgctcatgggtctgagtgccaatgtggactgtcacccatggacactcgatcaaggcatgatgacagcgcgagatatctgcgcagatcccatggtgaccccgctgattcgagccatattgccctaacgtagccagcacgaattccccctacccataacactccaaaggctgggcgcgacggatcggcgtcgttccgcttggctggttagccgatccgatagggaagctcccgagtcgagcggatacttttcaccacgagcacgactcgggatgacaggctgggtggactacaattctagccaggggtgggcaggcacgaatgcgggcttcgatacgttactcatcgaaacctccccttaatcgggtggcaacgcggccgcccagtcgctttctggttcgactgggcctcgtaggatatccgactcgcggcaaaggggacctgcatgaaaataggactcgttcgaaaggcatgcaagtcccaccaggggctggcccatcccatcgtggaactcgaccccaacaccctatggggtaacacgtgccggggcacccctttgtggcgcaaagacgcgttggcagtggcgcgattgcaacctcagcgtctccgccgttcactaaggctgcccagaagggcaccgtgcactcgtaccctagccattggccttattccgccactccaacctaagacccaaacgtagttataacaacatgctcgcgcaatggagaatgccttcccgcggggaccatggtgcctgtggctgtggagtcggggaccttggtgcgtgggtgcttgcttcatggatacttacttcatttgggccggtgttcccttactcatcctcgagagggccctttgatacaccagggctggttggtgtacccaggggggcccaattccttcttgttcttggccccgtataccttgggtgtgaccccccttccttgttccactcaggaacctaccggtggtgatttccacttag

SEQ ID NO: 549181 - DNA, 340 bp, Homo sapiens
caactatgaagcgcttgtgaggcatatgctgtcgcggtgacgggcccatggcgcggagctcgtgcgcatggcgctgaatggctgaggaccttcccagtctccccatagtgcgtgcctttccctgtgtgaactgtgtatctagcctacagttgccctaggctttcctgtctgaggacctatgccatcttaggtatcttggcatgatgtccgccgaaagcatgtacgcatgtccgcatgctgtccgtgccctcatggtagtcatccgcatcaaccagatgttgtcctgtgctggggctgacaggctccacaggcatgcgaggcgcctttgggccccctgccg

SEQ ID NO: 549182 - DNA, 154 bp, Homo sapiens
gcacatgtttcgtacaagttggttaactgccagcagctttgaatcgtgtaactgcttacaaaaaatttcacatggtccaggaataagaggaaacaaatgtatgaaaaacaaattcccagatacttacatttaaaataaaaagcaaactaacaaa

SEQ ID NO: 549183 - DNA, 211 bp, Homo sapiens
cccggaaaccagcttgttttttaaaaaagggggtttttaaaaaaaaaaaagccaaaagggttttttaaaaaaaaccccccccccccctgggtttgtaaaaagtcagctttttttgggttcaattgtttgttttttccaaaaaaaagtggaaaattttgtttcaaggggggggttaactgggcctttccaataaaaatgtgggaagcttcca

SEQ ID NO: 549184 - DNA, 184 bp, Homo sapiens
actagtccacggttggctcacgcctgtatccccaagattcgggaggctgaggaggatcactggaggccaggagctcaagatcagcccgggcaacagagcgagaccccatctgtacaaaaaatacaaaaattggccaagcatggcgacgcacgcccgccgtcccagccactctggaggctgaggc

SEQ ID NO: 549185 - DNA, 325 bp, Homo sapiens
acctcccagccttggcctcctctctccagcctttccactgcattttccttttctgcaacaccctgcagcattccaggaagaaggtataagaggggaggattcctcctgatgccagtatttgatctgtgctatgcttggcaactgtgtgagtccaagctttgtttttaagggcagagcctgagtagaacatgaggcaattctgcaacaggcacagtgacgatgatggaccattgtgtctgtggcagtgatttcagtggagcccttcttttgctattgcatggggcagtttgccattgctggaaaaacaaggggttgcacacagggt

SEQ ID NO: 549186 - DNA, 338 bp, Homo sapiens
taggcatcagctcactatatacctcaaatcaccgatattcagtcagtgcactacgtaatcccacatagtgaccacttgagtgcacgagtgcagatgacgtaacctgcctcagaccactgaggcgactttgctctgagtcaccacactatactgcttaataccaagttgtttcctctgcttttccataatttccaatttctctacacagggcctgaagcacaattatttttaatcttttgagacagtctctctgtcgcccaggttggagtgcagtgatgtgatctcagctcacgtgcaacctcttcccaggttcaagcaattctcctgcctcagactcc

SEQ ID NO: 549187 - DNA, 258 bp, Homo sapiens
cagctcccagtagctgggacacaggcgcagcaccatgcctgctaatttttgtatttttagcacagatggggttcacgtgttggcagaatgtcttgatctcttgacctcaggtgatctgcacgtctcggtctcgcaagtgctgggattacaggcttgagcaactgtgcccagccttgtgttcatttttgtaagccttgaattcttaacctgggagcaaaaaggacaatttatgtggctagcatgagaagtgggtcgacg

SEQ ID NO: 549188 - DNA, 158 bp, Homo sapiens
ggtggctgtgggactgctgttgacttcctactaccggcgacggtagtggacgctgtcacgtgaccgtgtgttgtagacgttgacgcgcgggctgcctgggggttcttgttgtacggtgctactttgaccaccttctacaccacatacggggggactcc

SEQ ID NO: 549189 - DNA, 544 bp, Homo sapiens
  misc_feature (80)..(80): n is a, c, g, or t
attcgcggccgcgtcgacctcacatattaaaaagataagagtttaggtaaaaaaaaactcacagttcctcccattctttntttcgctgttgaatctttagttgtgccctttcagcttttaatataagttttctcgttttctcaatttgattttccacgatgatttcacttagggttttaggccgaaatttcttccctttttctattattgattcttcttgtatggtaacgctcccacctacatagagaatcaacatttttcagcctttttgagacataaaaacaaaactctcagatattgtttttaacctgctgcattagaaaaaacacagagaatatattgaatttgtaaatcaaagtatttattgagcactagttgtggtggctcttgcctgtaatcccagcactttgggaggctgaagcgggtggatcacttgaggtcaagagtttgagaccagcctgggcaacgtggtgaaaccccatttttactgtcgacgcggccccgaatttagtagtagtagtagtccaaccggggaatccggaac

SEQ ID NO: 549190 - DNA, 825 bp, Homo sapiens
agcggaaggggaggctgatactgcagaaccggaggacgaagcgaaccggagtgcgaacactagctgggtgggaaccatggttgggcatcaccacccatcgaggacgcgtgatagcgccaaaattgcaggttgctgaacgcaagcaggactgaaatgactggccgaggacgagagtcagcagacgtgcacgccgcgctccagacagaagacagttcgagggagagtacaggcaggcgtgcgcagcggaagcaacggactgaaggaggctgtagggtggagcttccttggaagcgcgcatggatgtgcacccgtggtgttggaaggaacgagctggaaccgatggcgtctaggcagcggccttgggcatgatgtgctgtgaaaagctgtggtgatgaagctgcggaaaggtggctgatgtagagtgtaggagagtgtatggaagacggttcatgtgaaagacttggggattacaagaatgatgaaggaggctagatggaagttgaggaattccggatcaaagaatcttagcggattgcagcaagaggtagatgtggagagtatgaagtaggtggcctcgataacggttgggtggatcagtggatacggagaatctgtagggaaagagctgcaagtagggatagggtagcgtgaaggcttagtggcgagcacgctcgtgaacgtgttgctggtaggcgtaggtagggcatggaagcctggcagaggagaatgtagagcaaaccaaaagcgtgcttagtacttcttgcagggttccaggccggaggaaagtgactctcagagaaagaaagatggaatatgaaggaataa

SEQ ID NO: 549191 - DNA, 165 bp, Homo sapiens
tgtagctggtacaattcacacaggaaagggttaaaagggtggtgagggggtaggggtaaaaaatttcaccggggagagtttaaaagcgagggatggggggaagggggtgacaattgtaacccagggaggtgaaaggggaaggggtaaggaataggacagagcaag

SEQ ID NO: 549192 - DNA, 752 bp, Homo sapiens
cgatgaagcaggtgatgtatgtgatgctgatgttaccgtgagggcactggagtcgtggcgttagtacggaaagaagatatgacctagtgcaggtacgagagaactggataacaagtaagtttagatctcactgcagggagagagactgactacgtccgggttagagttggatgggcgtcagaagtccagagttatggaagatctcggatctcgagagcgcgtaggtcgtagcgagaagccgtagcagaagcaactaagtgaggagtcgcagattactccccaaggagaagcagaggatctccacgctattctccccgatcatagcagatctcgctctcgtacataagatgcattggtgatcgactttattgtagaacccatgtcgtatacagtttttcctttattcagctaacaagtcttttcatgtatgtcaattcaagactgtttggtctcagaatgggctacaagtgtcgaattgcattcgttgtaatatccccttgctcctaacatctacattcccgttcgtgtcttgtgataaattgtattttaagttgatgtcatagaccaggagtagtttacaacactttaaggttaagctctcaataactctttcaagaacttgctgactactttgtggttaacaatggtacttatcttgcccctgggcacaggggggagcaaggttggggaatggttgcccgcggtgcacaggcagggcccatcctaaacctggggggaccgatcactataat

SEQ ID NO: 549193 - DNA, 658 bp, Homo sapiens
taaccagaagtttatttcatttttctaaataagtgaaattgtattgcatcttctaaattattctatttaaacacttgatgtctcgctgtctccgtctctgtgtgtttgcatgtcattgtacatgttcttaggaaaagtgtgggagcttgacgcaatatataccttatgtttctatgtgcatatagtttaccaaataataccataagtttacttagcatattagaatccatgcacattatttttattttatcttcaccgcaaccctgtgggatagaccaaaatcatgcttttcagcctcctttttccacttgaggaaaggagtcttaaaaaagggaccagtctcatgttcccattcgtcttacaactaattggtcaagccagaaagccagaactatgtcctgggtcactaactcctagtcactgtgtgttagtatttgagatgcctgttggcttgatttagtcatttattttttagtgttttataatccttgcatacttttacattttaaatggttaaccaggcaaattggtttaaaatcagtgcataaaaatactgtgcctatcatgatgggtttcatgaagtgataacttttcatcatggagatcctcagctgtcacaggatgaggggccctgggtacgctcacgtgagggtggtct

SEQ ID NO: 549194 - DNA, 141 bp, Homo sapiens
atttatataattagcagttgttaatgcaattaaatattaatccatgataggttaccttaactgtagtacaaagttatttgcaagcttttattttcaagaatgtaattttcaatcctggctctgccaccacctagttaaatg

SEQ ID NO: 549195 - DNA, 459 bp, Homo sapiens
tttctttcaggacatttcatgttcatttttttgtgactgttcttggtttctgagccgggaggaaacttttcctggtttaaaaaaaataactttctgcaaaattatcaggggcgttcgtcccccaaacttaaccagaaaaccgtttgccaggccgcttaaagggttcaaaaacaaccaataaacaccgttgtggtgctacaaaaaagtgtgcctgagtgcctaagcctttccccttcaaggaggtcctctcaaaagaaaaaacctggctgactgctaaccagggtgatggtcataaaacaggggcgcccctgttctttctggggaaaacaaggcaggactggttaataaatttttctatactaattctccgccgacggcttgggtaatcccccctcttccggggtttcttttttttccgttttggagatgcaaaatggtgccccacccaaaatggagcca

SEQ ID NO: 549196 - DNA, 178 bp, Homo sapiens
gtcggaccgtatttacggcttcaactcatggtggttgttattattggaatgccaagaatgtatatatatgtgtctagatatcttgcctgtcacatagtaggtgctcaataaaaagcagtgctcattattagtagctacaactactttgatcaggagaccgctcttaccagaccgctct

SEQ ID NO: 549197 - DNA, 488 bp, Homo sapiens
  misc_feature (375)..(375): n is a, c, g, or t
  misc_feature (390)..(390): n is a, c, g, or t
  misc_feature (420)..(420): n is a, c, g, or t
  misc_feature (448)..(448): n is a, c, g, or t
  misc_feature (456)..(456): n is a, c, g, or t
cagcaaacatgctaccctgctggataactgaaaacaaacccgtcacatgggttcaggaggcggttgcaggggagcaacttctcagcacttccttttgccgggtcgctgagtaaactgtggtctgaagccaaaccgcctacaccctgaactgttagagctctgtagattacgttcttaaggaaaagagtaacccccttacggcgtttagattttcgtacacccaagcagtagcatagatgctgtacaacgtaacactgagtcagtctgaactgtggacacggggactgctgggtgtgtgtactagactttcttggctatcattgaaccgcttttatagaaatgttcgagtttgatcttggctcagcagatgcattnactgctcctgtagtncacacagcatttgtttatttaacgagcttntcgggtgctttctgcaaccgcaactctnttaaggtnttgaaatgttaattccaaagtggggcaccagg

SEQ ID NO: 549198 - DNA, 373 bp, Homo sapiens
cctctagagaataaaaaattagccgggtgtggtggagggcacctgtagtcccagctactcgggaggctagaggcagagaattgcttgaacctgggaggcgaaggttgcagtgagctgagatgcgccactgcactccagcctgggcgacagaacgagactccatctcaaaaaaaaaaaaaaaaaagaaaaaaaaaaagagcaacagtgatatatttggcagaagcaatgtctggagtattaggagagaggaagcaagaatctaacgctgtgatgggaggggtttgagaccagtattgttgtctcatcctggctggtaataaggacatcgggcttttggggcgcttttggagaaatggggcgcgggtgtcccgga

SEQ ID NO: 549199 - DNA, 118 bp, Homo sapiens
gacagcacgtcaagaacctccattactacttatgatggccacctatgatgtcttgccagaagccgctggagcagcagctgctttgtctggagcagcttgacccccctgtcgtcgtctt

SEQ ID NO: 549200 - DNA, 200 bp, Homo sapiens
  misc_feature (157)..(157): n is a, c, g, or t
cggatcatccactattctctaatatcaagtagcacgttgctgtagatcgcgaacactaacgtacctcattgttcccactgctgacacatgtgatcatctctgcgcgtgctgctctgttgagaagatgacagggctcacgaagtctcacctgtctttngtttctttacaggtttttctggagcaacttgcttgttccgctg

SEQ ID NO: 549201 - DNA, 261 bp, Homo sapiens
tgagattttcagggcctccggtgagcacgggactgacgaggagatcgaatctctgatgaaagacggcgacaagaacaacgacggccgcattgacttcgacgagttcctgaagatgatggagggcgtgcagtaaggagtggacagtcgcctctaccaagatcgcgtgaccctagacagcagtatactcagtacctgacgcagcttccaccagggaggcgcggccccttgtgggtctttgtctggaaggaataaaagcaaatg

SEQ ID NO: 549202 - DNA, 181 bp, Homo sapiens
tgactcttgaggatcccagagtcgactggggcttggggggtcggtgcgctggggaaggtcccggtcggccggtgaaggtgaccgcgtgagccggtcgaggtcgcggcggatgtggtgccaggtctggccggtgctggtctcgatgatcctgatcaggagcagggcgagccagcacagcacg

SEQ ID NO: 549203 - DNA, 156 bp, Homo sapiens
gtctgatatgaaaatataacattaactaatttataaaaatattctatgtaatgcaaaatacttgaagctgcagtagttggtttaaacaaaaacaaaaaaaaaatgagagaaaacctatcagaaggactaaaagtacgcctggcttcaggggttggg

SEQ ID NO: 549204 - DNA, 83 bp, Homo sapiens
ggtcgaccgggcggtgtgtacaaagggtcagggcagctgtcaattcagacgcaagcttatgacccgcacttactgggaattcc

SEQ ID NO: 549205 - DNA, 870 bp, Homo sapiens
  misc_feature (96)..(96): n is a, c, g, or t
caaggacaatggtccgcccccgtgcggcgaagtcccctttcaggcccagttgtcgtgcggacgccacttctagggcctggctctccgggtgaagancgcgacacaacgcggtgggcctggagggagaacaacaaagaaaatgcgctttggcggggatgcgccttttccccagaccaaacgttttcccggagtagccccatgtattatgacgcaccacgcttggggctaattatctaggaggaacttgtgctcaatattaagggagtggttaagcagaagagacttgtcctctgttgctccttatacggggaaaaaaaaagcaccctcgtgtaaggtataatttctcccctacttctccaaagcccgtaaggtcaacaagatatttccgtaaaacttggcgataacgggccgagcccacccccggggtcaggtattgtaacattgaggggctcttctcctctttgttaactaactagagatgacatgcttgcctgacgactgtggtgggccaccccacgggaacactctgaattttaatatacacagagggggtgtccccgagggatttggtagtagttgaagcacccacagtggttgcctttaacaaaaggcgtatatgactttcttctgcaacaggtatatgaagaacgttggagacccacggtgtggactaatccatgcgggcaacaatgccagcaatgcgccaatttgcacccccagttttataagaagactgcacaccccatatgggtaatatcgacaaaccaacagccccactagagttcacggggccattataggttacctaggagaaaagtattcccctggcccacctattttcccaagggctaaaaattttgtaaaataaca

SEQ ID NO: 549206 - DNA, 750 bp, Homo sapiens
gggacccgggggacgcctaaccccgcgagacaccgtgcacatattcttcctcataattgggagaagactcactggccgaatggtcggcgagtagatgacttgcaattatgaagaatttggcaattgtcagccatcttctctgacagctaaacccagtatgccaccacagtaagacattgaggatccgtggtgaaaccccaataactaggtcagccgaggatccccagagaggctcaggaagagaagaagatgatagagttactgggaaatgatgactctgtacaagaacgtgagttactatgctggacagacagaaaagctcccccttctggacatttgaatacttaccaagacattctttgatgtggacacctaccaggtctttgacaggaagttaaaggatctcttgttgccaaatacccgggagaaaactttgtgaggttatatatccgcagcaactccagagtctctatggccccttatggactatgtgccacggtggtcttgtgccatagcaattcagtgggaactctttccaagcttctagatccatctgggagagacgacgtaccattattgtgcccgattcctgaccagtgtccgatagcagctaccatcatctatgcctatgcctggctggttcctctttgcactctggggttcgtcatgtggagaagccggccgttttgaacatcgtctcctattctttctggcattgtgtgggccacgggtttcctcttcattatttcc

SEQ ID NO: 549207 - DNA, 288 bp, Homo sapiens
cccccccccccggggggtttttttttgggggtttgggtttttaaaaaagggggggtttttccccccccaaccccttgggggggggttgggggggggggggcttttttcccctaggggaaaaaaaaaaggggggccccccttttttgggggacccgggggggccaaaccccttttggggccccctcttttttttgttttttttgggggggggggcccccccctttttgggggggggggcccggggttttcccccttttttttccccccggggggggttttttgggggga

SEQ ID NO: 549208 - DNA, 433 bp, Homo sapiens
ccggtgtatcctttgtctgataatcatgaatgtgctgccatgaacctgtctccccaggacaagtcagtagtttcagacacagacttactctcctctcacaaatctaactctaatattctgacaatctatatgacattctggtaaaaagctacaattacaattacttaatttaagctggttgtctaaggttcaaattaattgccctctgcctatctaacgtacattttgttttttgttttgttttgtttttttgagatggagtcttgttctgtcgcccaggctggagtgcagtggtgcgattgtcgctcactgcagactctacctcctggtttcaagcaattctcctgcctcaggctcccaagtagctgggattacaggtgcgtgccaccacgcctggctaattcttttgtatttctattagagacaaagggaa

SEQ ID NO: 549209 - DNA, 452 bp, Homo sapiens
gaggatctcagcagccatgtcgaagccccatagtgaatgccgggactgccttcagttcagacccagcagcgtgcagcgcagccatggcatgactagcattccgtggacgcacaatgtgctcgccttggtacatttgcattcacctactccagtcacagctccgggtaacacgtggcgatcgatcttgtacctattggtcccagacttcccgaatcagttggcagacgtcgaaccggacgactgacttaacgctctctgggcaatgacatgcttggcctcggctcttgtacacctcttacttccgtcgatgtggcacaccgtccagtgaacgcttaccacaagctgccccgcggaagggaaccccaagttccagcacgggacactcgctcgccgggccaacaaaggcgcccaaccgcgccacagagggccctatctcgcccgatcacgtggaa

SEQ ID NO: 549210 - DNA, 230 bp, Homo sapiens
ggtcagactaggcgtgacgtctggcccggcctttccgttttcctctcctctcctgccgagagtggaacacacgtgtcctgggagctgcatcttgtgtagggtccagctgcttttggggactgcaggaatcatctcccctgggccctggactcggactggggcctccccacctccctctcggctgtgcttaacggagccccaatccaggcctcctgtggctgttgggttcc

SEQ ID NO: 549211 - DNA, 1085 bp, Homo sapiens
ggagcgcgcgggcacaagggtgccgctgaccgaggcgtgcaaagacctccagaattggaggcatgatgaagactctgctgctgtattgtggggctgctgctgacctgggagagtgggcaggtcctggcgggaccagacgtgtctcagcacaatgaagctccaaggacacatgtcccaatccagggcaagtcaaggtcacgtctatatccaggcacacattccaaacatgctcgtcgcaccgatgaggttgcacaagctcaggcaatcaacagcacctcgtccatcaggcacacacaagacaaacacagcacagacaggccgcaccagccacgcactgcattcccagtcgaagagcccgttcaggccagagcacaaggccctacaaggcacaggcaacaggcacacacggccagagcaattgcccccagttagagcactcgcaaggaaccccaagtgagccaacatcaacagcaaggccaccgcaccaagcttaggaaacaaggtgtaaccgaccttaccacacagatgcggccagctttagattagggccacgtagtctgggtcacgtaacgcacgccaacttaggaacctaggatggacccccccttacattgggtgtcggcacacagcgaataggtcggcttaaaatggcgagcccacatatgggaaccgcattgtgtaaacataacacaaaacaatgatcaaccaccactttgagacacaaagaattgggatacaaaaggcagtataagcaatataaaagaaaggaacctacaatagtgagaccgtggggattccgattgtaccccaaggatgaacaaacgcacctatggaggtgcgagattccaagtaagaaaggcatacccgatctgaggagcacatacatgggcggtcaccacccggggagaccaacaaggaacgtatttactggcgcacgcccgacaaccgcttctagcaccccgattagggcatgactacaccagatagacaaccagcagcactatccatgggcccccagcccagtatgaccgatataaaacccattgacccacttggcgtgcacatgtgcgacaacaaattgggag

SEQ ID NO: 549212 - DNA, 796 bp, Homo sapiens
agttcaagaaaagcctggaccacatatgacaccccccacccttccctacaaaaaatttaaaaattaggtgtgcatagtggcacatgcctgtattcctagctactcaggaggctgaagcaggaagatcacctgagcccaggagttcgaggttacagagagctatgatcgtgtctgtgcattctagccggggcaagagaaggtcagtcttgtgcgataccgataacaatctgctgtattttaaaatgccctctcaaactaagaggaaaagaatgggtcatgcacgtgccactgtctcacgagcccgttttcaggaggaaacaaaaaaggaaacaaaaagagacaatagaagcaagatcctaccagaagtgacctccaaatagtgatcattcttaagtacagagtatagatcatgcagctcacataaaactgctggcattccagcaatcaatgcagtgcccaaagtaatccacagattaaggcggttcaatctgcgacccttttcactaggaagaacatgctagagtcattacaagcgccaccatcttagagcagcagcaacctgcaaatagcttgcactcattaattctcttatggttaactggtcaccattgactctgaggacatctcgtattgtaattctgaattaagacttccatacatttcagaattgaaagtagtggtaatggggataaaacttttcatacagggatgatggtttaaataggaaatattttactccgaaaaattgatgggcattaaaaataaatatgaggctaatctcattaatgtgaaagac

SEQ ID NO: 549213 - DNA, 278 bp, Homo sapiens
ctcttcgtttccgtggatctctatgagtctaatggtctcacctccatgattggctatgaactatcgtcacacaacatcatagctgggtaaatcccgtactgtttagtagagatggggtttcgccatgttggccaggctagtcacaaaactcctgacctcgggtaatccacccaccttggcctcccaaagtgctgggattacaggcgtgaaccactatgcccggcctcttatactaattttgatcacttatatcactcaggaaattcatctctttcttt

SEQ ID NO: 549214 - DNA, 397 bp, Homo sapiens
  misc_feature (1)..(1): n is a, c, g, or t
  misc_feature (7)..(7): n is a, c, g, or t
  misc_feature (32)..(32): n is a, c, g, or t
  misc_feature (99)..(99): n is a, c, g, or t
  misc_feature (106)..(106): n is a, c, g, or t
  misc_feature (109)..(109): n is a, c, g, or t
  misc_feature (120)..(120): n is a, c, g, or t
  misc_feature (124)..(124): n is a, c, g, or t
  misc_feature (126)..(127): n is a, c, g, or t
  misc_feature (141)..(141): n is a, c, g, or t
  misc_feature (148)..(148): n is a, c, g, or t
  misc_feature (150)..(150): n is a, c, g, or t
  misc_feature (156)..(156): n is a, c, g, or t
  misc_feature (170)..(170): n is a, c, g, or t
  misc_feature (172)..(172): n is a, c, g, or t
  misc_feature (178)..(178): n is a, c, g, or t
  misc_feature (186)..(186): n is a, c, g, or t
  misc_feature (195)..(195): n is a, c, g, or t
  misc_feature (208)..(208): n is a, c, g, or t
  misc_feature (226)..(226): n is a, c, g, or t
  misc_feature (230)..(230): n is a, c, g, or t
  misc_feature (249)..(249): n is a, c, g, or t
  misc_feature (255)..(255): n is a, c, g, or t
  misc_feature (258)..(258): n is a, c, g, or t
  misc_feature (268)..(268): n is a, c, g, or t
  misc_feature (283)..(283): n is a, c, g, or t
  misc_feature (321)..(321): n is a, c, g, or t
  misc_feature (378)..(378): n is a, c, g, or t
ngggaangcaaaaactttattgaaaggaaagngcaaagaaatttgtggaaaccttaaaaggggaaacttagacacccccccccaagcgcaggaccaagngcagagnggnctctttctggntgtngnngtaagaaagggggngtccatntnccagcngtttcccagcaaanancaaccnctgcggancaggggggntgccttccttatnttggatctttgccttganattntcgagggggtaactgggcnccaccncgngggggagggnctaaccagtaagggncttcacgaagatttgcatcccacccctgagagggagcnccaggggcaggggggactctttctggatgtggtggtaagaaagggggcgtccatctnccagctgtttcccagcaaa

SEQ ID NO: 549215 - DNA, 113 bp, Homo sapiens
gaaagaacacaagcagaggacaagggatatagtaacactatgtcagagctgaatacatagccactgtggttggcatagtctcagacaactcctacaaggaatcagctcaggga

SEQ ID NO: 549216 - DNA, 933 bp, Homo sapiens
cggagcccaggccgggagcaggcgccgccagccacagtgcgagccatgggtgaacgatgttggactgccagtctcgcctgccctgcagtggccgccaccgccgcctgcgccggccctcgtggggctgccgccacctcctgccctcgccgcacgggcttcacagctgccgccgctgggagtgcagacctgcgtgcgccgtgcaccagtactgagtcgaagttctggaacggacccccggggctgcaacctgccagcgcctcatgggtgccgccagagggatggggcctgcgggctgcctgtcccaacccgggcacattcgaggagtgccaccggaagtgcaatggcagctgtattcccattacagattggaggggtgtcaacgctcacaagtcaaccaaaggggttgagttaacccattatttcaggtcaaggcacacaagtagccagtcatgcacaatcaggggagtccaagctaccaagtatcgggggatcaccatatgttggggaacacaaggcacgcttgagttcccacagaaggcgttcccttgtactggttgaggtgaccataggaacaaacaggttggcaaggtcctcaaaactgctcacggtcatttcaacccaagcctggagcccccagggatctcaaggatacccaaggatgggccaatccaagacaccaggaagatcgaaagtttgtagaacttgtgcagggatgcaccggcagacgtactcggagggctcttgaacattcgacaagggaagccaggtcgagcacttgggaggaaaccccaatgaccgtaccatcagatgggggtacacagggaaattccgttcgtaaggcccaacgttagccttcgcattgaagcattcagacggccctattggcacgtgggccccgtgagcatgggaggacggctaggtacttagcgaccg

SEQ ID NO: 549217 - DNA, 107 bp, Homo sapiens
  misc_feature (1)..(1): n is a, c, g, or t
nggtgtgcctaagagatcaccggggctgacgagaaggtacatctgcgtgataagaagtctcaaaatgatgcttcagtaagttggtagctggtcgctgccaggataaa

SEQ ID NO: 549218 - DNA, 151 bp, Homo sapiens
acaccaaaaaactggccggggcacaattgggtcttaaaaacccctttcctccagttttttgccaggatttaccatatccagccggccccccatggttttccccctatgctttcccaccaaaattcgtggttttgggggggttcattttttg

SEQ ID NO: 549219 - DNA, 601 bp, Homo sapiens
atagctgctcgctcaggtgactttacgataagggttgttgtcttgtgattccgtggcaaatatctacgccttccccaaaatggtctgaacaaatccgtctctttaacaattcttcactgtctctgtcatgaattgattaatccctgtgtatctggattggaaggagtcaatatagcatgcagcatcattttctttaatgcccatctgctctcccaaagatttagctcccattccataaatgatcccatagcaaatctgggaaaggcacaaaggcatgtcgcatgctaaattgaaaatggcattcctctgtctacagctctctcctccatctgtgcctggcatctaggattcaggctgaaacccttcttatattttcctctgcccatgggaagtaggccttcgcctacagcttgagaaggtgggctttctcctactagtgtgggccatttggatttcaaaatctcttgggacattctgaatatttggttctgtaaaggttatacggcctcagcgatgtcatctgaactggtgaaagaaaaacctgtgggcagctagttgataggcctgggctcaaatgcaccagcgtgggtggctaatatgt

SEQ ID NO: 549220 - DNA, 365 bp, Homo sapiens
  misc_feature (41)..(41): n is a, c, g, or t
  misc_feature (116)..(116): n is a, c, g, or t
  misc_feature (123)..(123): n is a, c, g, or t
  misc_feature (140)..(140): n is a, c, g, or t
  misc_feature (188)..(188): n is a, c, g, or t
aaaaaaaaaaaaaaaaaaaaagagagccaatcacacattanaatccagaaattatccaggatgtaaaggataccaattttattagataggaaccccctattcttaactagaatttntgagctngggcaaagtccacaccnggaatctgggtctccaaaaagggagaattattatgagcttagaccacngtgagcttttacagtgcactttaaaaaaagttttttttaaacaaagtcatttctaagtatctaaaccacactcttccacatttgatcttagccaaaggcccagaagcgataaaaccacactcttccttaaaaactcaagagtaagagtaacctcagttacaataactattttagtaa

SEQ ID NO: 549221 - DNA, 563 bp, Homo sapiens
  misc_feature (25)..(25): n is a, c, g, or t
  misc_feature (69)..(69): n is a, c, g, or t
  misc_feature (84)..(84): n is a, c, g, or t
  misc_feature (112)..(112): n is a, c, g, or t
  misc_feature (129)..(129): n is a, c, g, or t
  misc_feature (135)..(135): n is a, c, g, or t
  misc_feature (148)..(148): n is a, c, g, or t
  misc_feature (166)..(166): n is a, c, g, or t
  misc_feature (186)..(186): n is a, c, g, or t
  misc_feature (198)..(198): n is a, c, g, or t
  misc_feature (212)..(212): n is a, c, g, or t
  misc_feature (280)..(280): n is a, c, g, or t
  misc_feature (311)..(311): n is a, c, g, or t
  misc_feature (320)..(320): n is a, c, g, or t
  misc_feature (327)..(327): n is a, c, g, or t
  misc_feature (329)..(329): n is a, c, g, or t
  misc_feature (331)..(331): n is a, c, g, or t
  misc_feature (343)..(343): n is a, c, g, or t
  misc_feature (459)..(459): n is a, c, g, or t
  misc_feature (524)..(524): n is a, c, g, or t
tgggcggtgtttgctctggtttgcnggggttccagctcgggttccaacctcattcttgtgccataaaantcagcatggctcttngatgttctagaataccctgtgttttganatccacagctggtttcntttttnaccattatgaaanaccagtactccttttccntcaaatgtgttttttaagcnataataaattcngatcccctgttttntgccacatacatctttgggaagccacataaacagtgggatcagatcagtaggaatatacccagttaanagaaatacacaaagtactgtagtttttttancccctactncttgggncngncatctttccccnactagcctacccctgtgggctggtggcggggtttggggcggctttaccccagcttatttcccattgtgtcttcctgggggtggtggccaagggtatttccttccttctctggggtntccctgtctccctccccggtcctctcgtctgggtgggtccccacccggcccggctggcctctggncctggtttggctgggggctgccttctgggtttgcagcat

SEQ ID NO: 549222 - DNA, 284 bp, Homo sapiens
ctgaccaatcaggccgaggccacagctctgattgcgtgttgaagccggttgcgatctatccgggcgctgcgcgtgaaaacggcgcgctcgtgatgtgcgaagtcatgatgcctgatggcaagaccccgcatgtgtcgaacaagcgcgccaccgtcctcgacgacgagggcgcctggttcggcttcgagcaggaatacttcttctacaaggacggtcgtccgctcggcttcccgaccgacggttatccggcgccgcaaggcccgtactacaccggcgtcggctac

SEQ ID NO: 549223 - DNA, 480 bp, Homo sapiens
caatgtgttgaagccaggagtggtagctagataccctgcattttcaaagccctaccatctataacaatctttctcttccttaacaccccaattcatcatcaaaactacatttcccaaggactgtatatccttaaaaaggtatgtaggcacagacatctagggggtaatagcaaatacctttgggtaaggtaagttagcgattagtaggctatggaaaagctataccctaactaagggctatagaggacagtccatcttcatctttcatatatagctagctaacaatctaatactatcagatgcagaaccttcagtgtattagggcctttgagctgctagacacacaatagtgcatcagagctgcctctcagtgctccggtcacctaaccacagaagatagactgaaggaatgcaaatgacgagtaaataccccaggaagaaaataaaactgggaacaaatgctagccccaaattgagcag

SEQ ID NO: 549224 - DNA, 1263 bp, Homo sapiens
tcattgtgaaaagctgggaatctcaaacatagtcaacttaactaaaaagaagctaatacaggttgagcattcctaatccaaaaatccagaatccaaattgctccaaaatctgaaactttctgaatgctgacctgatactacaagtagaaaattccacatacaagtacttaacacaaactttgtttcatgcacaaactactaaaaatattgtataaaattaccttcaggcagtgtgtgtagttatatatgaaacatgaatttcatgtttagacttgggtccatgcccaagatacctcattaggtatctgtaaatatccgaaatccaaaaaaaagtctgaaatctgaaacacttctggtcccaagcatttcagtaagtgatgctcaacctgcgtaatggtctgcgggccagtgctcattttctgcctatgttgtacatactttaaattgtgtaaattaaaagtcaaagcaaagagtctatttttaaagaaacttacaataatctaaacatatacttcttatgattatgaatcatcctgcaaagctgaatgaagaattttaccaaaaatacaatgaattaatcatatatttgagagtcacagtgataggttcgactatattttgactgttgtgtagtggcaccgtttaggtagtattgtttctgagcatggtgctttttatacttgaaatatatttttgctttattttttattgatataattatatttgcactaatggctttctgaagaaaatattatagatgacattttttgtatatatatttattaagcttgggaacctggtcgcccagtgttttctctggacaaatgtgaaactggataaagtatggataaagtcttgagttcctcagggtaactgtgttgatgtctcccgtcctcttcagtaaggcttgaatatgattttactcatcattgattctgcatagtgtacccagcaagacttagaaggacactgaacctgtcagagattttaagaggcacattttagtcactttgaatatggtagtggtgggcgcggtgactgaagcctgtaatctcagcacttcgggaggccaaggcaagcagatcacgagatcaggagtttgaggttacagtgagctgatcgcaccactgcactgcagcctggatgacagagtgagactttcttgggaaaaaaaaaaatgacagtgaagcagactttaagaatccgagatgtcattgcagaattatgggaataaaaattcagctgcaaaggtgtagaaattga

SEQ ID NO: 549225 - DNA, 700 bp, Homo sapiens
ctgaaatctgtggagcataccgcagctctctacatggcccatcgtcctacacatctcatagttcccctgaaaagatctgttgaaataggggcccggtatataccctatagacagcccgctctatcgcctctagagctatagaaaaaagaaccgaaacacacaagacgacaagaataatgattctggcagcgagtgtccaatgaggagaattttgaaacctgtgtccgtgagaggtactaggcgtgcccggggtgttgctttgcactgggttttctctggtttgctcaagatctctcgggttcttccgagaggtgctttcttgtccacagtacataaaacagacacgggagccaacactgcaaatgtgtctatagtacttgtgcgctcaggcgtgtgtggcgtggcgctcttcgtgggtgactagttgctcgagctctctggaatcacgcatcttccaagattttaccgcgcgccccgtgtgggggttgcccttgagggacttaccttctccttcacacatacccctgtggcaccccactgacaacttctgcacatactgggggccctgcttattctcccaggacaggctccttaaagcagaggagactgtcctggagccccttctcaaactcctaagattgtttcatgtcccacgttctttgctgaatcgcccaataaaggacctaagtttcaaaaaaaa

SEQ ID NO: 549226 - DNA, 117 bp, Homo sapiens
ccccggaatacacagcgcggagtacaccagcgcgaatacaccagcgcagctgagccttcacccaccgtaatgagcacgtccctgggcagcaacctttctgaactcgaccgcctgctg

SEQ ID NO: 549227 - DNA, 92 bp, Homo sapiens
  misc_feature (82)..(82): n is a, c, g, or t
  misc_feature (84)..(84): n is a, c, g, or t
attggagttggaaatcccagcatgacaaatatctgtaatatacagtacatgcaggccacatcctactgccttcctaactacncnctaaggaa

SEQ ID NO: 549228 - DNA, 426 bp, Homo sapiens
  misc_feature (59)..(59): n is a, c, g, or t
  misc_feature (89)..(89): n is a, c, g, or t
  misc_feature (188)..(188): n is a, c, g, or t
  misc_feature (223)..(223): n is a, c, g, or t
actgcgtccagcctgggtggcagagtgagactccgtctcaaaagaaaaaaaaaaaagantattgcccagtcgcgttggctcacgtctgnaatcccagcactttgggaagctgaggtgggaggttcacttgagctcaggagtttgaaaccagcatgggcaacataatgagaccctcatctctacaaaantataaaatttagctgagcatggtggtgtgcaactntagtcctagctacttgggaggctgaggtgggaggttcgcttgagcccaagaggttgaggatgcagtgagccatgattgccccactgcactccagcctgggtgacagagtgagaccctgttctcaaaacacacacatacacgcggcgtgcgcacacacacacacacaagagaacattttaacatgttacaggtatttgtaagtg

SEQ ID NO: 549229 - DNA, 641 bp, Homo sapiens
cattgctcctggtctgggatccagtgacagtctgctggaaggctgctgaatactggacatggggacttgccagggcacaagggtgagcggtgaggcgggactgatagtgtgtctacactcaagcccaggtgcttcctgccactctgcccagtgagactgccttgatccacagctgcggtaggagacgaggaccgtgactgtctccttccagtctggggtaccaggcagggcccagacaggagaccaggacccaggttcagcaggggaaatggttggaaatgttgaaaaggcatctgggggtggggaggccaaccagagaggagcagcagcaggaaactgtcacccctccggccccctaccagtggggttgctcccagggctggagaaacagagggagggagcccagaacctggactggccaagggagctggagccatgaagcaaatgggcttacagacagagctgccacccagatctggagatcaggaggaatacccagacttctcttcttactctgccctcatcttccttcacttttattgcgtctaatcagaagccacatggcatagagggtttggaccaagttgatttgccctccaagatactgagcagaacacaaggccaggaacagatgtgaccat

SEQ ID NO: 549230 - DNA, 132 bp, Homo sapiens
tctgctacggtgcccggtctctactacttcacctacctacgccagctctcgagggaacctgtgcgttaacctcatgcgtggccggagcgtgcgacagaaagtggtcaccttctgtgactttttcctacgata

SEQ ID NO: 549231 - DNA, 416 bp, Homo sapiens
cccagagcaacagaatagcatcctgcaccctgcctcggcttaaaccctcagatgctccgtctgagttgtgcagctttggacctgagagctctctcggcatggcaggcttcctgggaaggagggctagcgatagcatgtgccttgaattctgttgtccaaatgtctccttgcctgacaaacactctaaacttctttgctattgttactacatgttaatcaaggggaaacaacgtttacaggtaggaaaaacttacaacttataaaaactactggacttaccaccctcagcccaattgaactttgtcttgccaaatcagaaacatccctggagtcccttctaatcattgaattgctcacacaaataatgtttgatattaacaatgtcttttttctatttcagtttttacttgaaatgt

SEQ ID NO: 549232 - DNA, 187 bp, Homo sapiens
agtgaccatactaatggactaccttttaagctcaccaaaattttttacatcacatacgacgaaaagcacagggtgaagaagcaaaatcagtaaagaactctcttcccccaggatcaagaccgtgtttttcaccacctaaaaaaagactaccatggcctcgtttccctccttcggctgcgtagtgagc

SEQ ID NO: 549233 - DNA, 321 bp, Homo sapiens
ctgtgctgctgtgattctagaggatcccaatgtcggtcccattcatgtgtgcacccaggcaggaagtgaggacctggcaggtccctaggatcagcgctcaaagtcatccagtgactggcatggcccttctaacttgatggccccttggcgcagcaagaacctcagtcttacctagccagcagctgtcacccttagaggggatttccgtgggtcccaaaggaatgggccagatgtctgggagaacaggactgttggaggataccacgcacgtgatgtcctaatgttggccccctttccctcaactctaagaactccacatgt

SEQ ID NO: 549234 - DNA, 223 bp, Homo sapiens
ttacctgtcatactatgaagtcttttgtctgcatagtaggtcaagtctccagggctctgacaccatgccgggaggaatgtccccatagatgaagggcagttgtttgccagcttccaagtcactgcttggctatggggcttcttcatcatcatctttcttttcttctttggatgtaaaacattttcatagcttttctattcattcatcctaagcatatgttgaa

SEQ ID NO: 549235 - DNA, 278 bp, Homo sapiens
  misc_feature (181)..(181): n is a, c, g, or t
  misc_feature (258)..(259): n is a, c, g, or t
tcggaccagcgcactagctcatgcggaggaaaacaacaacaacaacaaaaacagaccccaaggtatcaggagaaggatagtctgaagtcatctgggcacccagccatttgggaagaacggatgcttctccacgggcctggttccccgtggtcaccccacccccaagatatctggtgacagngctcctccagttaaccagtgacggctaggtggcggccgaatttcaagggtggtgacccgtcaagtgaggctaggtgnngggggatccttctagaagt

SEQ ID NO: 549236 - DNA, 264 bp, Homo sapiens
cgcgttgacgaggcactgaataagtaaaggcttcctacaggtctgagaaggcaccacagtcatttcttcccttctgtcagacatattcctcagtttagccttcccacctctatacagtctgatagcagaccagcctttattagtcaaatcagccaattagtttttcaggctcttagtattcagtgaaacctttatatcccttacggtcctccgtcttcaagaaaagtagaacggactaaaggtcttttaaaaacacacctcgtt

SEQ ID NO: 549237 - DNA, 692 bp, Homo sapiens
  misc_feature (8)..(8): n is a, c, g, or t
  misc_feature (133)..(133): n is a, c, g, or t
  misc_feature (202)..(202): n is a, c, g, or t
  misc_feature (207)..(207): n is a, c, g, or t
  misc_feature (209)..(209): n is a, c, g, or t
  misc_feature (217)..(217): n is a, c, g, or t
  misc_feature (221)..(221): n is a, c, g, or t
  misc_feature (226)..(226): n is a, c, g, or t
  misc_feature (229)..(229): n is a, c, g, or t
  misc_feature (235)..(235): n is a, c, g, or t
  misc_feature (267)..(267): n is a, c, g, or t
  misc_feature (293)..(293): n is a, c, g, or t
  misc_feature (392)..(392): n is a, c, g, or t
  misc_feature (401)..(401): n is a, c, g, or t
  misc_feature (414)..(414): n is a, c, g, or t
  misc_feature (417)..(417): n is a, c, g, or t
  misc_feature (425)..(425): n is a, c, g, or t
  misc_feature (432)..(432): n is a, c, g, or t
  misc_feature (434)..(434): n is a, c, g, or t
  misc_feature (436)..(436): n is a, c, g, or t
  misc_feature (450)..(450): n is a, c, g, or t
  misc_feature (454)..(454): n is a, c, g, or t
  misc_feature (459)..(459): n is a, c, g, or t
  misc_feature (468)..(468): n is a, c, g, or t
  misc_feature (482)..(482): n is a, c, g, or t
  misc_feature (632)..(632): n is a, c, g, or t
  misc_feature (658)..(658): n is a, c, g, or t
agcaaggnggaggagagctccgccaggtggggatgtggggcagcctcacagggccccgtgctgggcctggtatcgggacagcacggcgcggtagtgggacagctcctggcgcacggccacaactttttttttnatcagggcgttctccttctccaggaaggccgcccgcaccgatatctggttctcctttagccgccgggcnttacngnaccgcttngctncctcnttnttcttnttccgccggctccagtttttctcatccttctnctcctccggcacctggatttttcttnccttcttcatgattggctggggcttaagttcctcttctgagaagcgatgtcttcgagggtgaaaggtctcgtggccaggaatgcttgatagggcaagancagcggggncgggggcaaaggncancaacaccnccacggngncnggggccacagggcngggnggggnccgagaggncaggccggcgcggnggccgcgggcgggcccgagggcagcccgggcgggggcgggccaggagaggagcggggggaagccgagccgcacgaacccggcccgggggagggggcgggcggccgcgcgggcgacggcgccggcgacgggccaacgggggggcggcgggnggggcgggagcggggcgccagcaggnaggcggcagggggacggcgccacaacgccgaacg

SEQ ID NO: 549238 - DNA, 160 bp, Homo sapiens
cgggtgacctgaggatccatttttactctctctacacgtttttctagtgtcaagagctgtctcttggctcacacttaatatacaaggggattagagggttctgtggggaaatttaaagttgaactaagattctatcttggacaacccagctatcaccagg

SEQ ID NO: 549239 - DNA, 237 bp, Homo sapiens
agataccacccgagaatgggcagaagcatcgagcctgccttatggcttccgatagctgaacactgtgtcatacaatgagcgggatgcgatgataggtaactagacaggacaccaccacgatccacaccctcacaccatgctgagactgacgggggttcccattgaggagataatggtgatattcagactctctgaattcctaggccatttggacactgtggtgaccgcatatcgatg

SEQ ID NO: 549240 - DNA, 203 bp, Homo sapiens
gagaaatcggacgaagctatagccaaatacactacaccgcagacacaacttggagcttcactgagaaaggcagatacgagttatgtcttggcttaaaagacgtgatcacactcggtatgagggtaaatcccaggacccaccagccaaggcatctgcctcttcctatgtcgaggtcgtcaagagaacacaacagctactgaggc

SEQ ID NO: 549241 - DNA, 727 bp, Homo sapiens
ttccccctcttcctggatcatccatatctccaccgtgtctcattcatcacttgctgtctgctagagcccttcctctcagcccccatgttgggagatggggagtggattcttgctgctggtatgagactccctgtgtgacctagatggtgctggcaaatgtttaaaatcaccacgtgtacgatgtgcatgccaagtcatgctctgccaacttgctagtgtggagtctggtgacatgagtggtgtgttgtgtcctgcatcccctcatgtagtgaaaacagaagcttatgtatgctatgcttgctccctcacacacaccacccaccatgtgttcaatgaccctttttatcttggtgatgacaagcaatcaaattgtggccttgctatattatccaaactgttattacccatgtcctggcccgttgccccagtcttgtggccgtgcccatgtccccatgtccatgtgaaccttggcttggattgcttccctgtccctaggaactcttccagcctctactaacttggatctccatgccccccagtgtcttattggccagattgatcggcgaactgcgcccaggcacgaccgtgtgacctgtgcacctacttattacttgctacccctgacaggcggattttcgacttgtataaccatattcaacgtgtgtgttgtgctgtgtgtgtagtgtgctgttgtctgttgtgcgcccactgcctcacaccgcgcccg

SEQ ID NO: 549242 - DNA, 896 bp, Homo sapiens
  misc_feature (12)..(12): n is a, c, g, or t
  misc_feature (64)..(64): n is a, c, g, or t
  misc_feature (83)..(84): n is a, c, g, or t
  misc_feature (96)..(96): n is a, c, g, or t
  misc_feature (107)..(109): n is a, c, g, or t
  misc_feature (112)..(112): n is a, c, g, or t
  misc_feature (123)..(123): n is a, c, g, or t
  misc_feature (125)..(128): n is a, c, g, or t
  misc_feature (137)..(138): n is a, c, g, or t
  misc_feature (142)..(142): n is a, c, g, or t
  misc_feature (149)..(149): n is a, c, g, or t
  misc_feature (163)..(163): n is a, c, g, or t
  misc_feature (165)..(165): n is a, c, g, or t
  misc_feature (172)..(173): n is a, c, g, or t
  misc_feature (188)..(188): n is a, c, g, or t
  misc_feature (197)..(197): n is a, c, g, or t
  misc_feature (200)..(201): n is a, c, g, or t
  misc_feature (204)..(204): n is a, c, g, or t
  misc_feature (215)..(215): n is a, c, g, or t
  misc_feature (219)..(220): n is a, c, g, or t
  misc_feature (227)..(227): n is a, c, g, or t
  misc_feature (243)..(243): n is a, c, g, or t
  misc_feature (255)..(255): n is a, c, g, or t
  misc_feature (260)..(260): n is a, c, g, or t
  misc_feature (266)..(266): n is a, c, g, or t
  misc_feature (279)..(279): n is a, c, g, or t
  misc_feature (285)..(285): n is a, c, g, or t
  misc_feature (289)..(289): n is a, c, g, or t
  misc_feature (291)..(291): n is a, c, g, or t
  misc_feature (318)..(318): n is a, c, g, or t
  misc_feature (321)..(321): n is a, c, g, or t
  misc_feature (333)..(333): n is a, c, g, or t
  misc_feature (342)..(342): n is a, c, g, or t
  misc_feature (344)..(344): n is a, c, g, or t
  misc_feature (352)..(352): n is a, c, g, or t
  misc_feature (360)..(361): n is a, c, g, or t
  misc_feature (387)..(388): n is a, c, g, or t
  misc_feature (416)..(416): n is a, c, g, or t
  misc_feature (418)..(418): n is a, c, g, or t
  misc_feature (472)..(472): n is a, c, g, or t
  misc_feature (490)..(490): n is a, c, g, or t
  misc_feature (558)..(558): n is a, c, g, or t
  misc_feature (886)..(886): n is a, c, g, or t
tttacaaatggngaaatcgaggcacaaaagattaaacatctgaccaaagtctgcacagccactnatatgcgggagcgagaatnngaacccaggggngcctccacttnnnaanacgagaccaancnnnncacgggggnngggnccgagantaacaccctcacancngggaagnncaggccaaaaccggngggcggggnggnngangcccgcacggngggnnggcggcncggaaacagggggggnagacaaaggggngggcnaagggngggaccagaagangggggngggngngggggggggccagaagaacccgcaagngcnggaacaaagggnggggggggngnggggaagngggggggnngcagcgcggcgcccagcagccagggnngcgcgccagggcaaagggggggggcggngnggccagcggaccaagaaaccccgccagcgccgccagggcaagggcagcagcggnccgacaacgaggcggccngccacggcggcggcttccttgcctcactctatgtcatggttacccttaccaactggttcaggtaaganggagtgggccttagatactctcctgaagagctagctattttaaggaaagagcaattcaaggccattccagacacacatgggtctgccattatatttggtgaggaggtagaacaggtctaaaagctaaggcccttcatattctctaaccagagcctttggttacacagctatgagggagcagaactggaaaagaccttcatcaagggtagctgggccaccttctgggtcaaggttgcctcatgctgggcctgcgtactcctctatctggggctgttactggcacactctgttggcccccacccagaaacccagccccttatcttgaggngcgcgccacc

SEQ ID NO: 549243 - DNA, 243 bp, Homo sapiens
cattcctgttgtttcagcccagcctcttgcttgggacccagaataagcatggatccaccgtggacacaccgaggctcagaaacagctctcctgctcccagcctgaccccagcaggatggaatgaccagaccccctccttcctggcctccatcagtggataaagatgccacaggcatggacacaggagcccctcgattcccaagtgtactctgatagtacaaagtgctgacaatttcaaggagg

SEQ ID NO: 549244 - DNA, 228 bp, Homo sapiens
gcccacgcccggttttgcaaaggttttcactcatgtttgctctagttatttgggggggtgtggggggtggtgatttaccatcatgggtttttttgccatttttttgataactcgggttgccaagtacccaatcacaggcttatgagccaaccggaatccttttttgtgaggggcctgtggaaagctgctgtcctttcattgtttttcaaaagagttgtttgcccttta

SEQ ID NO: 549245 - DNA, 606 bp, Homo sapiens
  misc_feature (542)..(542): n is a, c, g, or t
gaagacgtgcatttctgtgtttgaggcacatgtgcacgtgtggggcgtgaatgagaggcgtgcatgtgtgctcgtgtgtgtgtgcgaattgtgctcttttgtgtggggaaggggcagaagagacattttttttctcttccaaacccatggggcagtagttatgctgtaaaagcaaacaccctcctgctgttatgaaacggcttaactcacgagattaactggccgcgaaaatatgtacagacctttctcattcacaataagtttacattgagaagctaccaccaatacccattcctgcagacattcctctgttcagagggatctgtcatgagagagaaattgcatctgatatgggatcagaacatgcactctgctactttctagtgatgagaggccttgaaaatgataccttttatttcttcattacattatccttgattcttctaaaaatgagctgaggctgcttgcaataaacattgcttactttttctgtgcctcagcttctttacactcttaagaaggctaatgacatatctaccttntctttgcggttcacctgggggaacaaagttgaaatattatttgggatgaaagcccctgttgtcc

SEQ ID NO: 549246 - DNA, 1319 bp, Homo sapiens
  misc_feature (855)..(855): n is a, c, g, or t
  misc_feature (960)..(960): n is a, c, g, or t
  misc_feature (1030)..(1030): n is a, c, g, or t
tgtatctcaaataaccagaggtgctacgtcatagtcatctttcatgttcttatagacgccctcctacacgtgcggtgtgaccctcacattgacgtcctttttatttggggcaatcctctctccgttgcacatgtttttaagctccccccggtgtctctccccccccacaacgaacgaaaacgaccccccgggggggggccccccctccccacacacctcgtttccgggggacctacaaccaattggcccccacaaccggattgggacacagagtctccgcgggaccgggacacacaattctcgtggggggccaggggagaccccccgacaccagacagttatacggggacacaatccggcacacccccggcaatttgaagattctccccttccgcccccttttaagagagaagaaggaaaagggcgccccccccccctgttttccccggaggccgggccaggtcctcgggaggagcccaggcttttcctcggtggaccccccccccggggacacacccgttatgccccccatatgccttgcgcgcttccacggagctgctctatcccacgcgatgtatccccctatacccccccagattcccaaaccccgcagagctttcaaggccccgccccccctttacacgcgttttgtcctcacatatcgccacccacagaatttccaggaatatatattcacacaccaatagccctttccatagatatttaatatattttcttcgggaaaatgtgagaagtggctcccacatattggggtttccctccacaataatgtgtcacatgagactcccccacgagagatccccacattataaaatatatgtgtatatacttcgntggtacctaagagagagaagagatacccctctcccgccgcgagagagagagcggtgggacacataaatatatattttgttttcccaaaaagctaattctctgggngcccctcggcccaccctcggctccctctgtgcaccacggctccacgcttgtagaactctctcgtgacccntctctccacacatgagaagaaaggtgggctcgttattttataggagacttctcgtggagaaccacaatcaccacgtgcctgtttttaaatgccctgaggaaaatgcacctcttaaggggtaaacttcataccctctaacagtgaaaggaggtgggggagagcgagaagaaaccactttcttataagtatgaacgcacttttataaaataaaggcaggattgcttttaatgtttaactaccaaactgtacagcctattttagtgtggactattaaaacccctgccctgta

SEQ ID NO: 549247 - DNA, 230 bp, Homo sapiens
  misc_feature (18)..(18): n is a, c, g, or t
  misc_feature (26)..(26): n is a, c, g, or t
  misc_feature (64)..(64): n is a, c, g, or t
  misc_feature (83)..(83): n is a, c, g, or t
  misc_feature (145)..(145): n is a, c, g, or t
  misc_feature (183)..(183): n is a, c, g, or t
  misc_feature (209)..(209): n is a, c, g, or t
  misc_feature (222)..(222): n is a, c, g, or t
tcggtaccctcatcttgngcctgtgntatccaggaacacatttattatcattatcaagtattgngtactgtacagaatggtgngcgctgtgctatccaggaacacatttattatcattatcaagtattgtgactgtacagaatgngagtgcgctgtgctatccaggaacacatttattatcantatcaagtattgcgactgtacagaanggcgtgccgctgngctatcca

SEQ ID NO: 549248 - DNA, 578 bp, Homo sapiens
gcgacagtgcagtggaataatctcagctaactgcaacctctgcctcctgggttcagagcgattctcctgcctcagtctcccgaatagctggatttacaagcatgagccaccatgcctggtaatttttgtatttttagtagagacaggggtttcaccactgttggccaggctggtcttgaacttgctgatctcaagtgatctgcccacctcagcctcccaaaatgctaggattacaggcatgagccaccacacctggcccacagctcactgttgatacaggaactagaaagaaattatttaggccgatactgagggttcttaccaagtagctcctaaatcatttcttttctaacaaagagcagcctgaaaaattgagctgcagacataaataagcaagctggacgttgtataggtcaatgccaacagctgtgccaataggaaaaggctaactgggggtgaggccatgttcaacatggaggctcattttcccttatcttggtcacccatgtgtacggtacagacacaggcaccatgggtccggccagatagaggaccactgccttataaagatcgggtgg

SEQ ID NO: 549249 - DNA, 404 bp, Homo sapiens
ctggttactgaacagtaactcatgacatatgttcaaatttggcatacgttgatattaagtcatatgatagctttgcaaagagaaatattcctttgaaacaagggagtagggctgtgtcattattcttaccttctaatactcatgccaagaggtgagaaacagttaaggtcatataaggtgctagggaaagggtttccccatggagctttctgtgaggcgcagtattatagagccagcagcaaagtagaggaaaaagccagactgcgtcacacaagatttctcatccttttcaggagagggtcactgtgtagatttgaatcttttttctttgagtctgctttgaactttatcaggcttgtcctaagactgacaattgtcgtcttaaatcagcgattagggttagt

SEQ ID NO: 549250 - DNA, 1316 bp, Homo sapiens
  misc_feature (1219)..(1219): n is a, c, g, or t
ggctatcctgattatgtttgttcttttcaatcaatcgaattcttaccgcacacgattggtggggctgactcacgacaaaatagtagtaactagccaacgagatgtagcatctggagctgtcttgatcggttcttatacccacactttcctctccttatttccttgtcaagactggaggcagcaacactagctcaccctctatttctctaactctttattgtttttttgtattactaaccacatacttacgtatcttttttcacgcacaaacctaatacaccacactgcgttcagctaatatttcctctacatgtcacgctcttcacgcgggaagatcttttctttccgcccttttatgggttcccctcccccacgcacaccccggggactgtgacaccacagatctctcctctccactccacattgtttgatctacatctccacgtgtgtctctgcacccacttctctgcgcgcaaccctctatctttcatcacagtcgtcccttcgcactcatcttgcggcacaccacagaagtagaggtcgtcctcactcctctactcacgatagaaagaacgtctctcatgattttccctatggtttctccccccacacaattttctacacgacgactgatttttgtctgctgtctgtgatactcctctatactagtctggactatccccatgcatctgcagttcaggagaagactccacacactatttagcaccgcacacacgacacgacctcgatttttttcgaccccatcctctgtgtggatctacaactctctctttctctctgtgtgtatcaacacaaggcacacacatatctctctctcgtgcgtcgtagcgtatgtctcacatcatctcgtctctcgtctctctctggtgtctcacaactgacgggcttctcttcatacattcttatgcttcgcatcacacaccctgcccagccacacatctctcaccctctctatctctacattacttttcacaccaccccacacactaatgtggcggcgctcccaccttccacacccacacacaatgttccacacacccgtgacacacaccctgctcctccactcgctcgcgacaacacacacaccactctctctgtctctcatcgatgcacacacctctctctcacgccacctctctctctccttgttctctctctctctctcccccaccctctctctctctctctcccgcggttnttctctctctctctctgaccaccacaatcatccacaaaaatcaacaacaatataaacaatttagttaatacacacataaataaaataaaaaataagg

SEQ ID NO: 549251 - DNA, 823 bp, Homo sapiens
ggacccttggggtctgacgcgacgggggggggagatgaacgccctccagccttcgagtcgtctggctcttcgagggcgagaagaagatcaccattaacaggcacaccaggtaccaatggcctgtttattcaccatcaacaaagaagaccacacagtggaaacatcattaattcacaattcttaaaagaccgcgcagtgctatgggctgctacaaagtcccccacccttgtggagcacaagatcatcatccggagtgcagaccacgcggaattaaagcccccaggaagcttttaccaagggcaatcaggcgactcatcagtgagctgtccctgtgaggagcgcttccggtgggccataaaagacaagcaggaaggaatggagtaggggccagagggggctctgcttcggctctgtgaaaccccgtttcctacgttgtgcttgacccctccgttcaagttaccacaccgaggaagagcggccgtccacagccatgccccgcttggtgcaaccttacaccgtgacaacggaggtgtcctgtacctggattgaggggttcaaatattcccaattaaaaggtaattggggagggagacctagaagaaaagacacagctcaaaaaaaacacgtgtgttgtggccggcggcgccactaggaacttttcaaacacacttcttgtgggcgggggcccactagggacagtagcccggcaaaggtgccagggacaccgtgcagcgcacggtgtgccttcccaaaaaagcgggggacggggttggacaaccacaggggctgagccgggcaccagcgcaagggtaaaccgccgggg

SEQ ID NO: 549252 - DNA, 165 bp, Homo sapiens
atgctacgtgctctttagctactccttttcctacaagcatctcaatgcacgagcggctccgcaaataccattgaagaggacacactcctgcacccctcccacccctacgaccttgtgcccgatgccccctccgtgacggaacacaactctcacatcgttgcttga

SEQ ID NO: 549253 - DNA, 663 bp, Homo sapiens
  misc_feature (449)..(449): n is a, c, g, or t
ctcatctggatgtatggcaccatcttcttcatgctgggctccaacttctggtatcactcttataccaagggcaagcggctgccccgtgcacttcagcaaaatggagctccaggtattgcaaggtcaggcaactgaaagcatggctaataggcgcccactaatgctcagatggacttaggaggtcgtcagtgcctctcaactaaaacctgggaacaaagcttatgttggtccaggacatgacaggggacatggcctcccccttcccacaaggtggtctacagggacacacagggtttggttcctctaaccaatttcccccgggccagctcccagggattgttggcctccattaggttgtcttggcaatccaagaagctgggggctaaaagggcttggtacagttatttcccccttcctggcttaaaacttgggagaggagcactcagggncttggcccacaaagggtctcgtggcctttttcctcacacagaagaggtcagcaataatgtcactgtggacccagtctcactcctccacccacacactgaagcagtagcttctgggccaaaggtcagggctgggcgggggcctgggaatacagctgtggaggctgcttactcaacttgtgtcttaattaaaagtgaccagaggacacacacaacc

SEQ ID NO: 549254 - DNA, 638 bp, Homo sapiens
  misc_feature (23)..(23): n is a, c, g, or t
  misc_feature (71)..(71): n is a, c, g, or t
  misc_feature (77)..(77): n is a, c, g, or t
  misc_feature (80)..(80): n is a, c, g, or t
  misc_feature (93)..(93): n is a, c, g, or t
  misc_feature (137)..(137): n is a, c, g, or t
  misc_feature (202)..(202): n is a, c, g, or t
  misc_feature (207)..(207): n is a, c, g, or t
  misc_feature (222)..(222): n is a, c, g, or t
  misc_feature (270)..(271): n is a, c, g, or t
  misc_feature (273)..(273): n is a, c, g, or t
  misc_feature (275)..(275): n is a, c, g, or t
  misc_feature (277)..(277): n is a, c, g, or t
  misc_feature (280)..(280): n is a, c, g, or t
  misc_feature (282)..(283): n is a, c, g, or t
  misc_feature (297)..(298): n is a, c, g, or t
  misc_feature (358)..(358): n is a, c, g, or t
  misc_feature (430)..(431): n is a, c, g, or t
  misc_feature (433)..(433): n is a, c, g, or t
  misc_feature (437)..(437): n is a, c, g, or t
  misc_feature (452)..(452): n is a, c, g, or t
  misc_feature (489)..(489): n is a, c, g, or t
  misc_feature (498)..(498): n is a, c, g, or t
  misc_feature (527)..(527): n is a, c, g, or t
  misc_feature (532)..(533): n is a, c, g, or t
  misc_feature (537)..(537): n is a, c, g, or t
  misc_feature (539)..(539): n is a, c, g, or t
  misc_feature (543)..(545): n is a, c, g, or t
  misc_feature (548)..(549): n is a, c, g, or t
  misc_feature (552)..(552): n is a, c, g, or t
  misc_feature (554)..(556): n is a, c, g, or t
  misc_feature (560)..(561): n is a, c, g, or t
  misc_feature (620)..(620): n is a, c, g, or t
ttgggaaagggtaggggtctggnggggagaaggaggggccacagccagacaaaatggcaacacacgatcanaggcantantgacatcacaganatagcagagggtgcaggataggggctccagaccaggcctccaancaccccaggacgggtggaggtgtggagggagggagggcgcaggggaagggggaagaggggtgggncagtnccacatacccgtttnttctttcctcctattaacctagctgtttcatcacgggagtggggaagnntntntntgntnnggtgcttctctctnnatcccacgcctcaccctacaagccatatcactcgactcttctcaggccacttccgtcccnagtcgtagccagagccattctcccccacccctaacaaaacccatctggaagctcctatccaagtcccctctnnantgcncaaacccagccattntaaaacattttcttcactgcaccatggggaggggctnccctttctnaaaccaccatggaagccccattctaagcnacacnntgtntngaannntgnnttngnnnattnntgaatcccacttcttgccttgctcaagatctgtcccctttagaatcaagctcagtctcncaaatgttccaagccaca

SEQ ID NO: 549255 - DNA, 194 bp, Homo sapiens
aggcctggggccgggcttctccaggttcttcccagggggtcccggtagcccgggcccccgcccagccccgggtttccccgggccctccgcggggggccgggcctccctccccctgcagccttcccagggttcttgccctactgggcccctgggttttggggcaagccctgacccaataaaggttttgaccccca

SEQ ID NO: 549256 - DNA, 144 bp, Homo sapiens
aaatatatcttagtatcatagctaattctccaatacgttggaatatgtaggaaggatcaagtagtatctgcctcgacctaaataatttaaacataatttcagtgataattctctagaatataacaccgaggtactatcatatat

SEQ ID NO: 549257 - DNA, 1567 bp, Homo sapiens
  misc_feature (943)..(943): n is a, c, g, or t
  misc_feature (1196)..(1196): n is a, c, g, or t
  misc_feature (1225)..(1225): n is a, c, g, or t
  misc_feature (1288)..(1288): n is a, c, g, or t
aagactggcggtcttgttggtcagtggttcgtcctctggctttggtggtgcgtcgtgtcgtttggccacgtggcgttgtttgttgtatgatcgacttactccccgcttttttgtttggtttcggtaggctggtcggtgttcctacaacttgtggggtgctgggtgtcccggtagataattgttcgctgttctatttagtgtgggtgttgtttttcttcccctccccccgagttattcctcggccgcggatcggtgtggatcggggtgggccgcaccggtggggcggccgtgggtgggggcgttttagttatgttgttgtttgttttatatgctcggtggtttcgcccccccgcctctcttgtttgttgtagtgttgaaggagccccggggcggctaacaccacaactggttatagattatctcctccttatgatcgcccctccttataattggttaaatattcccacatgaactaccaccccacattatcccgcaatttttttaaaagggtgtgaaccaccaccaccttatataatggagaacttcttctcgcacaataggggaagttcccccaccccacaagcagggtttggtgtaccaccacaacaaatatagcgccccgggcgcgtgtgtggataaaatctcgcccgcgcgcccccaccggtgataacatttatattataccccgcgttctctcttatagagggttatcggctcgagagcgctctcttgtgggtgtggctgcgagataatgttctcgcgcacaaccgagaggctgcgcccacacaccacctcggggcgccgccccgcctgttgttcgcacccccacacaagcccccgcgtcgagaaagagagaggggcgcggcgcgccccgcgcgttatcatcatatcatcatatagagaaaaagatatattcttacacacacggcgcgcgctctcgtgngacaccacacgcagcacgttttctccacacacccgcagacacacacagggcgcgcgctgtgtgtgctgcgcagagagagagatattctctccccacactttatatctctcctcacgcccacacatatataggccgttctcgcgcacacaacacacagagtattattactcacagcgcgtatatagtgtttcacaccgcgcacagtctctgagatgatgagacggccgagaatgctcacagagagagagggcgnctcactacttatatagagagtgatatatnctctctcacactctacacagcgctctcacagagagagagagagagagagagagagagagaaangagagagagagacgcacacattaatatgtttctccctgagaggttctcacgccccttggagatacacaggaagagattatattgaaagataagagatccctgaccacctataaggagaaatgctgaaagcttttggaacttcgccacgtctgtcccaccccctcacggtcccctcacccccacccacttgggatgaatttccaaaccccttcggggacccgtttgaattttttctgtagatgctgtattattttccaataaatttgggaccaccacccc

SEQ ID NO: 549258 - DNA, 1468 bp, Homo sapiens
  misc_feature (545)..(545): n is a, c, g, or t
  misc_feature (927)..(927): n is a, c, g, or t
  misc_feature (1283)..(1283): n is a, c, g, or t
tcccaaattcatcttttattattataaaaggggcttttttagcaaaagacacacagataaaagagtcactatggctcaggacacaaggcagggaggttgccaggcctgtggtgcccctttctgtgggggaaaaggaggcctcgggacaaagtgtgggaaaaggtgcgtgggaagggctgagcggtaggggccacaaaagttcccgggtgggcaacacgtgtgtcggcggggtctcagtgggtgtgggacctcatgtggggaccctcgcgtgcataactctcttggtgtgggtggggggggtgtctcctataggtgcgtgccaccgtgggagggccactctccttgggtcccgtgggaggggacccacccaaggggacaccaggaaccaggagaaggcccaaggatgtggtttaggtgcaacctctcggggatgtgaaggcgcccaggggagaaaccgctggggtgcctctgtgcaagtgtggccgggatatatggctccaagacgcctgtagaggcccagaggcgcgcttctcccgtgtgtacancgtgtgcggggagcggttctcccgctctctgtgcgtctctctgtgtcacaggatgcgactctcctctctgtggacctatatggggcgccccgagggcatgtggcatgtgatatcacctctctctcttctcagggcgcgctctcccatgtgggcggcctcttttgcttgcccaggcaaatacgggtttgagcggccgagactcttcctttgtgccccattcttccgctcatattagacggtgaaccagcatgtgctcccgggtgataggggttgccctctgtggggaagcccccctgtgggggccccgcccggggggtgtggcctcacacaatccggcccgtggaccagcatgatatcccccccatgtggtgaagaggggcgntgtcccccacataaggttccgcttcaaacaccaggcggggtcccttgaaaaaagaggaagaccagcccggggactctcgtggtgccactttgaaagcaccactgaatagcgtcgacacgggggaaccgcccctttccctgtggaggacaaaccagggggcggccgacgattaatagaagggctccacgcgccgcgtgggcgcaatggggataagcccacggggcactccccacagggttttttccacaggcccccgggagcactgggggtttttgtccgcgcgaattcccccccccccaaggggggattggtgtctcccaccaccgtgggctgagttccaccgttgtccggggggnaaaatcctccccccactgttggggggccccccttaaaagagcccttttgtgttagtcacgccccctttctcaaacacgttgtagtttcgtgtgttggttgcggtatgcacgagggaccgcttcatgtgttgcgcaggaagccgctcacatggtcgtgatcgtgatcccacccgcgtccgtgtgta

SEQ ID NO: 549259 - DNA, 237 bp, Homo sapiens
gatgcttatactgtggtgttaccgtgaccaggtgttattctcatgacatttacattcctgtggagaaacaggctataaataagtaaactaaacggtacatgatgaactaaggtcgtttgccagagagtgatggggacgggacaagccaccaaagtattggatgaccaggaaaggctgtttgaggaggtaatatctgagtgaagagctggatggtagttggttgtataaagatttggg

SEQ ID NO: 549260 - DNA, 109 bp, Homo sapiens
cagcatcatggcaggcattggttcatctcaagggcagcaagggcccacgcagggcagccttctaagcaatgcttggcaacctttcccatcaacttcaatcttcagtcag

SEQ ID NO: 549261 - DNA, 165 bp, Homo sapiens
tttaggcacaattatttctggaatctcactcttgtaatcacagtaatttataaaaacaagagtgagattccagaaaaaattgtgccctatagacaatctggtttaggccagagtgcggtggcaccacagctgacaatcccagacaccttgagaagtccagaggca

SEQ ID NO: 549262 - DNA, 355 bp, Homo sapiens
tctgggttcttgcagaacagcaccactaccatggtgtaccaacaggtgggaactgcatatacacagacagcactgaagtggctgggtctttgcttgaacttggctgtccagtcaccaccagtgttcaagcacaaaaccagcaagaacagcagatccaggttcagcagccgcagcaggttcaggtccaggtgcaggtacagcagtcctccgcaacaggtctcggctcagctttacccaaaaatcaacgttcaccagcctactgagcaacccatccaggtccaggtgcagatccaaggccaggcaccacagtcagcagccccctccattcagaccccgtctctgcaaggaacccacg

SEQ ID NO: 549263 - DNA, 173 bp, Homo sapiens
gtcaaaggacccacaccaccatgtcaggtgtggcccacagagcttttgaaaatgatgttgatgccttgtgtaatctccggggtttcttcaactacctgccccttaggaggtaaggacccggctcccgtccgtgggtccagatcccagtgaccctcttggttcctgaggtttaa

SEQ ID NO: 549264 - DNA, 416 bp, Homo sapiens
cggcgggtgtcgctgccgctggtgatgccggcactggtctcgggtacggttctggccttcgcgcgttcgctcggtgaattcggtgccaccttgaccttcgcgggatcccggcagggggtcacgcgcacactgcccctggagatctatctgcagcgcgaatccgatgcgcaatcggccgtggcgctctcgctgctgctggtggcggtggcggcggttgtgctggccgttgtgggagcccgggcctggcgccgcgatgggtggcggcgatgagtgagttgcgattcgaggcagggcattccggtcggggtgtacacgccgcattcaccgttgcgcccggagagaccttggcgatcgtcggccccaatggggccggtaagtccacattgctcgggctcattgccggactactgaaaccc

SEQ ID NO: 549265 - DNA, 1015 bp, Homo sapiens
ggagtcatcaggaacctggagcaatgagatttcttttgactttggccccaacggggagtttgcattacctgtacagccaggtgctacgagctcacctactctaacgaatacgtcataccgctctcttgccccattcaatgcttgtctcgcgagaaacccaaatctcgagcggtgctctcccaccagccttggcacctggggctcatggattgcgccccgacctactgacgacatgttctagtagccaatgataagtgatggagccataggcacgggctgctggcgagggccccaacacgctccaccaaccagtgacgcctcctgtgcgggtaacagagacctatgagtagtaccaagtctccacatgtagaccctagttcgactgtcgagtgaccttcatgggagcttgattgatcgtccgagccgtcctgctccggagtccactcgcctgaagcacccaccgaagacgatccatgactcgacgctctatgcttggattggcgcgcaccagggtagggcagggcgatgcgtggacgtcgtcggtcgagtgctgtcccatgccaagggcgccggccggcgcgtgccctgacctgcgcgacttggacccgctatggcgcactctctcagtgctagtgtccccagtgtgccgctgcttattcctcgttctcgcgtccagtcgaccgtgcgagtcctccctcttgcggctcctatgctggccgtgcctcccgatcccacactcgcacctgacttgcgagcttctgccctcccgccgctcgccccccatcgtctcggtctccgcctttccgagtgacctgggcttgaccggtgtgccccccgctgcctggctatttttactccagaaggcggaccacaatgatgcccgaacataaccgccaagaccccgaccgtccaaagcaccgcgcgcccctggcctcccaacgggctaaggatacccgcttaccccccgccggcaaatccaggctcacccacgacaacacccaccacccacacccaa

SEQ ID NO: 549266 - DNA, 585 bp, Homo sapiens
ttagaggatccccttgcaggctctctacctactccagtcacccactcaggcggagcaaagtggtgtccaagcccacatgctgttgcaacccagccagatgtgtgcacactggtggtggcactgagatgccagccccctgctgcctcaaccccctccagacttggagcactgacaagctcaggagggaagctgaggggtagctccaccgggaactgcaagcacccctctgcatgaacagcctaggtgccctagacgacatgttgatggcagcaggaggcagacaggctcctgggcagaagggggtgggtcctcagtgaaaccccacctacaagccagggatggcctgaagccgcggggctgggctgccagttccaggtggagtcctcagcccagagtgagaacttatggtgctttttcccccagccggctccgggtcatggacaggggctccggcatgtgcaaagctggtttggcgggggacgacgctccccgagccgtgtttccacggccaggtaatcctctcattataacaacaattctctcaggtctgctctccgcggccggtggttcaaaatatcgccacat

SEQ ID NO: 549267 - DNA, 660 bp, Homo sapiens
gctgagatctagaggatcccagcggggaacagtcacttagattgttctcaccttttcttcctgctcagaggagaggagtagccagtgtgggaggaggattagagggtcaggatggcctgaagattaattcatcaacatggacctaattcatcaaatcctgatggatggggaatgggtcatttggctagctgtatatattcataaagtacccaaaatgtccctggttatggagagtagtttgggctttaaagagctttatgtgctggtagtgataatagatagggaggatgataatgaaaggatacatttctatttaatgatctttggccctggatctgttagggcaaacttcctccatatgcacaacattatgccaagcccagagctatgtttaatcgagtgatataatgtcaaaggaatttctagtttaattggcagagatactcataatattatggataataacagtaggaggccaaaggatttcccagttttttttggctctagtctgcttgtgggagagttgaagtgggttatataatactttgtgaaaaataatttaagaggtagttgtggggttggtgaagaacaaagtgacaaggggtcagttttttggttcctgatcgtgaatagattgtttgttgtcttgttggaaatgaa

SEQ ID NO: 549268 - DNA, 866 bp, Homo sapiens
ggggggactgtcccttgctccaggcgctcactttgcgggcggcactttttccaggtgttaatccagctaatggagaaggatagatgcacgctacttggtttagaaaaaaaaacaggaagaatgagcaaacgagagggccccttccgggtttatggataactaaagctgcaggggaacataaatcggttggttcctactggcgaatctactggcactcgagtgacatggtgagcctgcttctgtcgaattactggaagctataaggagatttggttaaaaattaaacttcaacaaccgatgagggggttgccacatctgtaaacttccggggagagtactggggattcggagtgcttcgattatcttggggggtcatgccgtgcgtatgatgtactggtagctgggtgtttgactggttacttgccagtgttatagaagacaagatggtcatgtgcgtagggaaataaaatcccagggagagtccagcatggagtcctgtatctcatagtgcaggacgtacaaagaacagatctcttattgaaacttttaaatcattatcaggctgtaccaaatctggcacagtggattgtggtcatggacgaatatgcggcgagaagggcacccagatgacattatggaattctgttagggcccacctatcctgtgatcttccaacacacagacagcaaacgcgtggaatcgatccgggtcttctgagggaaccagggttgtgttgattatgaacaccatggacccaaactgtttgctttcaggtgggacaatcggtcactgtggatggctaaaaacagttcaccaggtacattgggttgatgtaccggtgatgcggctctggtggcactaaacta

SEQ ID NO: 549269 - DNA, 886 bp, Homo sapiens
gaatatatccgcattcttcctagctccatctctgggttgtcatcagtaggtattctgggagaagcttaagaaagagaatcattgaggtagaaagtgaacgatgtaagtgattttcctttggtcatagtgcaatctagttaacatgtaaaatctttgtgccatagagaacgtgtataacttgtaagtaagggatagtatagatatatgggatagaatatatggactgaatggtgagaatataaatgcatccgagaagactctggtgtcgatgaaagcagagagaataaggctggggatggtcccagatccaagaggtgccaaaagcctgttggtcatcagttttctctatcgtagggtgatgtgcatacatgcatggatccttagtgcaaatgagggacgagaagtatctcgagtgcagccccacttcctttctgtctagctcctacctttgcccttgcagaggaggtagtagagatccgggaatggtctatcttatgaatgccattatttgtccatggcatctctactgaatacaggtctaagaatagaggagtgatagtctgaaagactgaatgaactaacaaaataagcgtttagaggatcacacctcttcctctataacaaagaccaagagacgttcggaggccagattagggtagtacagctataatgtaatgtaaggtgctacacaggcactactgtacatgtcccccaagtacgtcatagcgttcgacggcatgggtagagtctgacacagggggtgagcgtgagaaaaagcacgaggaagggcgggggccgaggaagcgggcagggcaggagaaagtggggcaaaaaaacaacgcgccacaaaagggcaaaaaaacgaaggcaaagagggcggcgggca

SEQ ID NO: 549270 - DNA, 488 bp, Homo sapiens
agtgaaagagccaggagttactgtctcgcttggtcatccgtgatgatatattctggaggatcacctcttcgatcacgtctattgtgccctcctcgatgggcttgaaccaatgcttctccgtcagggacgtcgctgtagtccagctccttgcagtggctaggagccaaggtggaacatctatctccatacgctcttcctcagaggtcagtcgatccacctcgggagtcgtccttgatgatccacgaggggagctcgtcctcctccatgaggcgcggcttccgcttggggtttgcgggcctcctcgcgcctgcggtccaggtccatgcgcatgaacagatcaaactcctcctcgtgccgggcgatcatctggttgacggtctcgtcgtcgggcacctcgtcttcctcctcatcctgctcctcgtgctccaggatgtgctgcaggaaggcgcgccgatcatggctggaggattctggtcgaacatgcgggg

SEQ ID NO: 549271 - DNA, 186 bp, Homo sapiens
  misc_feature (26)..(26): n is a, c, g, or t
  misc_feature (29)..(29): n is a, c, g, or t
aaggctatctatgggttacaccttanttngaaacacagtggtggtttaaaaacgtgtcgccgatcggatcgtaagcatagtgagtgtctgaagcctatcggtcatcgcgctcagtgccgcgaggtcggatctgttagcgcgcgcggaccttgcgcactgcgcgcgtgcattctcatgcggtcggct

SEQ ID NO: 549272 - DNA, 611 bp, Homo sapiens
ctctacctcctaggctgaagcgattctcctgcctctgcctccccagttgctgggattacaggcacccaccaccacgcctggctaatttttgtatttttagcagagacggggttttaccatgttggccaggttggtcttgaactactgacctaggtgatccacccacctcggccttccaaagtgctgggattacaggcgtgagccactatgcctggccaactcattttagttttaaattttttttttttccagagacaggggtctcactctgttgcccaggctagagtgcaggggtgtgactcagggctcactgcagccttcagcctccggggctcaagtgattctcccacctcagactcctaagtaagtgggactacaggtgtgcgccaccattccgggctaatttttttcctataatttttggtagagacaagatttcaccatgatgcccaggtgggtctcgaactcgggggggctcgaacctctgcttgggcatcccaaacgtggctgggatcacaggcctgagccaccttgcgtagcaagttcactccgcccgcttacgcgcttcaggatctgcggcctctatgctttcacagagccctcacccatgc

SEQ ID NO: 549273 - DNA, 578 bp, Homo sapiens
gtggtgtgatataagtacaaggtgctaggctgaagactgtaacaatctctgaagatacttcataattatgtctaagaggatcacctgggccatccctatgagccttgagacttgaaaaactgcacgcaacattggatctgtgttgagcctctgtgcaactgatctttgcaacctgaaaataattcattctatttgataacgtaatcacaaatccaggatcattagggattgtctatcacagaaaatgacatccgcgcggtgctagagatcttcgtgaaatactcctttgcggagagtaattcactgttatcattttcagggtcatccttctgaaatactatcatgtcaccatccattagttcatcaagggctttatcaagagacacgtcatacttcttactggtctctgttaaattcggtttaacttcctcatagaggataaggctagtatcttgaataaatcctgctctgtcacacataactgggagcaagtcacgtattttacaggatattggtgtgtagatatgcccacagtaattcaagccccgcgtattgggatcatacatcttcaaaaatac

SEQ ID NO: 549274 - DNA, 99 bp, Homo sapiens
aaaatggccgagccgcaaagaagtaccgcctgcgagtaactgcaaagatgctgtccgtgcgcgttgctgcggccgtgcgctcggcccttcctcggcggg

SEQ ID NO: 549275 - DNA, 105 bp, Homo sapiens
ttagctggctcctggagccactatcatcgtcgctgtctaggtgaccactagatggacaacatggagtgggccaggctagaactatctagagctagctactagcta

SEQ ID NO: 549276 - DNA, 168 bp, Homo sapiens
tttggagatggggcctcattaatttcgcccaggtgggtctcaacctcctaaggttcaaaggtatcttctaaccctcagtcccctggagtagctgggaactaacagtggcgtgccaccatggcctttttttttttaaatggaaccgggttctccttatgtgtcccctaa

SEQ ID NO: 549277 - DNA, 452 bp, Homo sapiens
ccccttttataacctcatatctcttgaatgttttgttcattttttaattttttctttatttttgtctaactgtattttggagaaccagtctttgagctctgagagtctttcctcagcttggttaattctgctgttaatacttgatatggtttggctgtgttcccacccaaatctcatcctaaattgtagttcctataatctccatgtatggtgggagtgacctagtgggaagtaattgaatcacagggcagtttcccccatgctattctcatgatagtaagttctcacaagatctgatggttttataaggggcttctccctcatttggttctcattcttctccttcctgtcaccatgtgaagtagggcatttgcttccccttccaccataattgtaggttccctgaggccttgcgaaccctgaggaactgtggtcaattaaacctccttcct

SEQ ID NO: 549278 - DNA, 567 bp, Homo sapiens
attgtatgtacgcagagttttcatcatggataactgtgaggagctaatccctgaatatctgaacttcattagaggggtggtagactcggaggatctccctctaaacatatcccgtgcagatggttgcacacaaaggcaaaattttgaaacgcttatcacggacagaatttgggtcaaaacaagtgcttagaacgctctttactgaatctggcggaccgactaaagagaactaacatagaaattctactgagccagtttctctaaagagacatacaagcttggacatactacgagagactactgccaagaatcgcgaaggaacgctttcagcagctggttacagggtacgtacacagttcttgcctctgggtggatgacgactgggtttactcgtcaagggacgtactggcaaccagcagatggacaaggaggaaacctagataagcaatactcttatttcactagtcaccacggttgaagacccagagggacccagggtaagcataaaactcaagccctttttggtgggaaccggttcctatccgagaaaagcaatggggctataga

SEQ ID NO: 549279 - DNA, 161 bp, Homo sapiens
  misc_feature (87)..(87): n is a, c, g, or t
ggccccagcagttatatgtcattgacagctccactagagtccagtcagtggagacaaaggtcaccaaatggtcagagactcaggcancaaggggtagaggaactccagctcgaggtagcagccttaaggctcagggcaggctggaggaaccgtgtgtgggt

SEQ ID NO: 549280 - DNA, 220 bp, Homo sapiens
agtgatcccgtttacacgactgtagttttgcaccccgatcatgtttgttcgtcacctgttcctatgttgctgacgccttagccctgtgggaacaggaaagcgtggcctggcctcttgcactgctttgtctcctaaataaactactgaaatctcaccgcatttcacacgtgtttacacattttgctcaagtttgttatgtcatactgcctagtccgctgca

SEQ ID NO: 549281 - DNA, 409 bp, Homo sapiens
ccctttctataaagacattagcatccccctaatggcctcattttatttatttatttatttatttatttttaaaatcttcgtaaaatttttttattgatacataacatttgtacatttgtgtggggtacacgtgatgtgttgttacatgtatagaatgtgtatagaatcaagtcaaggtatttagggtactcgtcaccccaagcatttattatttctatatgttgggatcatcaagtcctctcgtctagctatttgaaatatacaatacattgtttttaactatagtcaccctactctgctatcaaacattagaacttatttcttctaactctatatttgtacccatttaccagcttttcttcatctcccccgctccccctacctcatctcaacacacatccttccatta

SEQ ID NO: 549282 - DNA, 363 bp, Homo sapiens
tctctgttgtaccagagatatttctattggaaatattggaactattggaactatttgccccctcattacacgcattcctgttaacctatgggaaagagatcttttatatcagtggggggcacagatttcttttccggaaggcaatgacagccagcagagtaaagatgttatgaccaaaatgggatttgttcaaggtatgggcttaggaaaattagcacaaggcatcaccgagcctattatacctactgatgaatcagactacaggacttggttattctttttagcagcggtcactatcaagcctgcagatccctttgacctggaaagaactcagaaaccggtctgggtagatcgtggccgtcc

SEQ ID NO: 549283 - DNA, 197 bp, Homo sapiens
  misc_feature (174)..(174): n is a, c, g, or t
tccacttcagttccaaggcagttccaagtgcattgttccaagtgcattgtccaagtgcatggtccaagtgcatggtccaagtgcatggttccaagtgcatggttccaagtgcatttgttccaagtgcattgttccaagtgcattgttccaagtgcatgggtggtcactgcagcntcgcaattctgtcacatccatgg

SEQ ID NO: 549284 - DNA, 420 bp, Homo sapiens
taatttgtttctgattcaaagatttctaatttgttcagatactagttaccttgtgacataattaaataaaagtgatttataattagttcattaaccatgccatttaatgatgctttaaagaagattacccgccctcagagttgtggaagcagctcacttattcttctataggtacttgtgcttgccttgctcagcagctcattccttctgatgaataaagaggcccctgcagctcagcacagtgggtcagttgtacttgtgtcaaagaaagctgcaagaccctcctgtcctggctgctctgtgtatgctacttggtcctactaacctgctgctgttagctttaactgttagcttggcatgtgtgtgtgggggggagggagagaggaagggagggagggaggaaggaaggaaggtcgacgc

SEQ ID NO: 549285 - DNA, 211 bp, Homo sapiens
cagtctcaaaaaaaaaaaaaaaaatttctctctctcccgggtaatggggtagtcctggaccggtcagatatttttttcccatgggggtcaacagggtccctaaggtatatagatggcagaggggaaaaatagggggacaagaaatcagggatatgggcaggttttcccattttccatttggtggtggtagaatttacaattataaatggcg

SEQ ID NO: 549286 - DNA, 227 bp, Homo sapiens
gataagtctaatacctctcacacatgtatgtgatgaagagtagctataggattattgtactagaccatgaatctagattcccatcatgacttagaaggtgctagtaggtggctacatacccagaacccagataagctttgatcacttggatcaaagatgattctcgatttccactggagatctatacatatcacacacgatatttcatacaccacacattacatcgt

SEQ ID NO: 549287 - DNA, 204 bp, Homo sapiens
tacgtcaacattgagaacgtttactttgagcaatctccaataaaccaaagtgatacaaacacagtgatttgggaatgcttcaattacaatgcaatacttaaattttaataactcttgtagggagaaaaaagcaactgtataaatggaatgtagagtggaatttctgcaaatatttcaaaacctgtaatcaagagaaattaccac

SEQ ID NO: 549288 - DNA, 213 bp, Homo sapiens
tctggatgctaagtgtctacagctggacagaaccctaacatggacgctgtgaggcggcagcaagatggctgaatagatgccttccccaatcatcctccccacaggaacaccaaattgaacaactatccacacaaaaatagcaccttcataagaaccaaaaatcaggtcagtgatcacaacacctggctttacctttttattactgaaaggcat

SEQ ID NO: 549289 - DNA, 1019 bp, Homo sapiens
agtgtatcctcgggttgctggcgtttgtttgtgtggcgtgttcaaagttgttctcgtgggatgtctttggtaccctttctggtgttgtgctgtacttcggccgtctgtctgagtccgttcttcgggccagtcggtgggctatggatgccatactcaaggcgggcgcttgcggctggtctaccgctcgatgcattcgtgcccacagtcatacctgagggcgtgtgcttgcggagtcttgttctgagtcgtgtgtttcgttccttcgctttcacgatgcacggtggtatagagaggctccacacgggctgcagttcagccattggcttgccgggctccagcctcccttcctgcggccacatgttcgtggcagagagcccaatgggtgtccagcctcgtcagaggctgcgcaggcgtgcgtgcatgcttcgctaccagaagcgtctggaagtccccatcaccaggcctccacctcctgcctctccagcacccctggctgagtctgtggcacggcgtgtagggtggacatgtccgcagggctgttcagtcgctgtggggctcgcgaagcccaaacggctgaggggcccataccccatgaagaagcccccacgctccctccaccgtgctgtgtgtatgggcccccagggaacaaaagggtgtgggtcagggaggggtctagaggcaggattcactaggcctcaggccacccaaatatgcccctccccagtgagctacggttccctgcctaggagctggggagggagagatctaatcccttcaaggaagtgataacactggagtgctaacaagaggagcaggaagcaaggccagccttggttctccattcacccatgagtttccaggtggaacaggaggaactggtccaggccaggctcatcctcctggacccagcaggggcagaaggaggaaggactggtccagcatggtccctccctgctccactggggcagcgctgattacctccgctattggatagtcagcttattaaatgtctgtgtctt

SEQ ID NO: 549290 - DNA, 429 bp, Homo sapiens
tttagtgggttccacagctgaatatccctattagctagacacacaggatctgctttagtgggtcatacctctttgggatcagtccattcatagctgaatgtttctgtggatgccacatgggagtctcagtaagcgcgctcttatgctctgggggttgttatatggactttacctagtgctaagtttgaatatgaatgacatcatgagggcacatcaatgtgcgatgactgcttcagtagaaaagagatctaacactgctaaggatctgactatatgaatggcagttatcccataagtaactcgagagcatcgttaatgattatggtcaagttcctaggaagtggtaggccgctgttgatgttgcaggtgccgctgtttaatccctctttatgaccctagctacaatatggtgtctttcttccgtctctg

SEQ ID NO: 549291 - DNA, 352 bp, Homo sapiens
  misc_feature (16)..(16): n is a, c, g, or t
  misc_feature (209)..(209): n is a, c, g, or t
  misc_feature (244)..(244): n is a, c, g, or t
  misc_feature (257)..(257): n is a, c, g, or t
  misc_feature (272)..(272): n is a, c, g, or t
  misc_feature (302)..(302): n is a, c, g, or t
gaactcctgaccttgngatctgcccagcctcagcttcccaaagtgctgggattacaggcatgtgccactgcgtccggcctgtataaagtaatttttcagcatctattgcaagaagtttgtgggatttgatcactgggtttcataaggtagaattgcttcctcagcaattgtcattttatatgcatttgaataatttttcagatttctcngggtggcatagactttaaaggcagttcagatgatnaagaagagagtcntctttgcaatactgnccttataacacgggccaacaggaagtgggnaaaactgctgcaagtgtatgcttgtgcccacggagctttggatttaaaga

SEQ ID NO: 549292 - DNA, 947 bp, Homo sapiens
  misc_feature (1)..(1): n is a, c, g, or t
  misc_feature (220)..(220): n is a, c, g, or t
  misc_feature (229)..(229): n is a, c, g, or t
  misc_feature (260)..(260): n is a, c, g, or t
  misc_feature (268)..(268): n is a, c, g, or t
  misc_feature (272)..(272): n is a, c, g, or t
  misc_feature (278)..(278): n is a, c, g, or t
  misc_feature (339)..(339): n is a, c, g, or t
  misc_feature (359)..(359): n is a, c, g, or t
  misc_feature (364)..(364): n is a, c, g, or t
  misc_feature (396)..(396): n is a, c, g, or t
  misc_feature (398)..(398): n is a, c, g, or t
  misc_feature (408)..(408): n is a, c, g, or t
  misc_feature (413)..(413): n is a, c, g, or t
  misc_feature (423)..(423): n is a, c, g, or t
  misc_feature (425)..(425): n is a, c, g, or t
  misc_feature (427)..(427): n is a, c, g, or t
  misc_feature (429)..(429): n is a, c, g, or t
  misc_feature (440)..(440): n is a, c, g, or t
  misc_feature (442)..(442): n is a, c, g, or t
  misc_feature (446)..(447): n is a, c, g, or t
  misc_feature (452)..(452): n is a, c, g, or t
  misc_feature (454)..(454): n is a, c, g, or t
  misc_feature (462)..(462): n is a, c, g, or t
  misc_feature (468)..(468): n is a, c, g, or t
  misc_feature (480)..(480): n is a, c, g, or t
  misc_feature (487)..(487): n is a, c, g, or t
  misc_feature (514)..(514): n is a, c, g, or t
  misc_feature (536)..(536): n is a, c, g, or t
  misc_feature (544)..(544): n is a, c, g, or t
  misc_feature (567)..(567): n is a, c, g, or t
  misc_feature (874)..(874): n is a, c, g, or t
  misc_feature (926)..(926): n is a, c, g, or t
naatcattagttgctttcctctatggcacactgagagccccaggagggtctttaactcccttcctcagattatattcatcccagaaatatagccttggacaataatttggttacagcatagtcccaggaatgaggtcccccaagttgctaagttttacataggggagactgggaaattcaaagaattggatggagaaaccataggatccaagataatgtnagggggttnaagatgttggagaggcatggtagcatcattnagtttgantctncttctnacttggagtggaagttgtaggattctgcctctaggaaatgtgccatccttctgaataattngacccaggaagaggagtgtnactanagtggccagctctccgccagctgatcacaccnanagagaagatnttgangcccaggccnanantnactgttgatantntttnntttangntctgcttngtgganagcctaggtgtncagtccngaagatgggctcaggagctccaatgtnctctaccacacaggtgttagtntccccgtnagatggggttaaggctaaatgtnagatggtctggtatgtccagtctccattgggctgggcagtcttgtgcgcactgctgtgaggcatgacaagcttcccgttcttcctccacgtgatagtcacttctgctggatagaagccccacacatagcaggccagcatcacaggctccctcgtgttaaaaggagtggttttggctacttgcacagatggtggccgtgtcctgttggtcagtgatccccagaagggctgggtgtgtgtggcacaattctgaagcccattgcgcaacgctgcatcagggtgtctttttggttgaggtgctgtgagagncattcgcaagttattcagcaccccaaattcgcaaggggccatcttattctcntctggatccagcaggtcagca

SEQ ID NO: 549293 - DNA, 239 bp, Homo sapiens
cccatgcagccagctacaggccttgtattggacatcatttcaccatctcccaatggtctgttggacattccagttttacttgagtcaatattatattctagaaaactatcttcttcaatgaggtttcaactatttaatacagtgcaatttaatttttcaaaaaatctgcattttatctttctaatattagtgcatatccagggttttttcttatcctcttttttttttcttttcttttt

SEQ ID NO: 549294 - DNA, 925 bp, Homo sapiens
  misc_feature (619)..(619): n is a, c, g, or t
tttagggtcgttataagccgtagcgtgcggcagctcccgccgccgaaacagccaaaagggattgcaccaccaagaacaacaaaaggggggaaaaacaaacacagagggattaaaaatcgggccattaataagattgccgtgaagtacctgaagagaaatcatgttcccgaaggggtatatatttaggggtccgcgtgccagcgcgatgggccacacataagtgaaccgaaggggggggcaaccacagagggttgtctgcccgcaaccagggtgtgtatataacaggccgaggtaaaaatttttggggaccacgggagcccgaattttcctcttgacagcccctccagagattaaaaacgcacgtcggttttgacagggactaccgtgccgctaaaacgattggtggtggaacactaaacctgctcgctgtgaatagaaatttcttggggggaaccccgcccagcttaatatgccacgcgaaaagtggccgccaacggggtattccactgctgcgttaatgattcacccgtgatttgtaaaattaacagacccacctgtttaggtttttaaagagcactactagtggttgtatattaagacggccccttaaaaatatatntggggggccaaaaaaccgcacacctgttgaaatatctcttctcattgtgctaagggccataaggcacaataatgtttttgggcccaacgtattgtggcgacaatatgctgtgcgctgtaaaatgtttccgctcgcgcgccattgttcccccctctggtagatgccgcgcgcattagcgccgaccagcttaaatagttccatgggatgagctgcttcgatggggtgtgctccgcgcagattaaaagggaattcttttttccaaatattttttaaaggggaaaaaaacaaaagccggccccaaaaaaa

SEQ ID NO: 549295 - DNA, 294 bp, Homo sapiens
aacggtggtatatgacaacgtgacttcttgatgcctccagtggtatcatcgtggtcttctcgccaggacgcgcaccgtctccccgacatggtatcttcatgatcacctctgcccttctgggacgcccctttgaccaagccacggtcctacagggctttgtttcctgtaggatcctcatctacttcatcattcctgtttggtgggagcctcaccacacatatgttgcctcacttttctgcccctagtccaccgtgtcatagtccaagatgctgtctgtattgacccatctccctg

SEQ ID NO: 549296 - DNA, 479 bp, Homo sapiens
tagtctagaggatcctctctctccacactggttgaacattgtatgtaggtgtatatattgtaatagagattgctcgggggacataggttatgtgataaggagtagggtaaggatagagtgggaagaagcaaagagaggaagtaaagtttaattatgccttatttgggtagaggtgatgatggaggtggagatttggtgctagtgcaattcgttttaggtaatcagctatatctaagtcaggtaaggtctcggcaggagtaggggcaggttttggctcgtcaagaaggcctagataggggcatagtgcggtgtgtgatgctaagggtagcaatccgcagtatgtaggagaaataaaatgtagcatagtggggattttattttaagtattgttggttaggtagttgagagtctagggcctgttagaagtcctaggaaagtgacagcgacggctgggagttataggttccagtgtggaagag

SEQ ID NO: 549297 - DNA, 1004 bp, Homo sapiens
gcccaatgccaggatcgagctgcaggagtgggagcatgtgacctgcattgaatgccatcgtcactgcgcagagaggagacgtgtacgggcctcaaacggctacgtggccgccgggacctgcctcatgcaggcggagcgaggtcacagtgaccgagggcggatcttgatcatggatgtgattgacggtggtgcccgagcctggccagcccttgagcaagaacaagtacaaagtccgttgacagagaaggagcagaaggggcccgtgaccgcccatgtgcacagtgcaattggccgacctggtgtcgtgccatcggccatgaagaatttatcctgatgcgagcctgctgtgcccagctgcagctgaagggcatggcgctatcatcgacgacgcaggcgtctacatacgaccaggctgatcatgcgatcaatggaaacgttacagtccttggcaagccgacggtcggtgaatgaggcatcttcgctgcttgcgcatacccaggacggaaagcaagacgcatgaagccttggatgtcgcggtgatgccaacgacccctgtgaaggttgtacagacgctggcacctttctatttgcatgtgagcatatatggccccaagcctgggagtatctacctcgcggctactagctgagcgcaggggacccattggcggcatgcatgcatagctcttgcgcggagttgcaccagccagactgtacaccatgaaagcccgacctgcatccaaccaaagtacgctctgactcagccagaactccatgaaaacccttccggttgggtggaaccagttaataaacgcgattggcctcagtaaggacgcccaaagcggctcgaacagacaacaggcggagcgcacttagcagccgtttacgttgagactccaggggacagcaaagagtaagcaccgattaggggttgacccacaaggttggaaacccacgtgttcttcggcagggcagcccctcgttgccagagtgggcgcaacatacag

SEQ ID NO: 549298 - DNA, 493 bp, Homo sapiens
tgccagtcgacgctagcaggaccctcacgttagtagaaaaacacagacacatgtgacaagaaaagatgcccgaatccgaagacattgcaatgacaactaaagcaaaatgaaacacattaaagagcatataaaaagtgtatgaacgaagtatcagcgacctgcgggacagctgccaggggcccaacgtacgcctaaaagcagtctctggcatacataggagggggcaaaaagtattcaacgaacttaccgtagaaaactgagatgtcaaatactgcacttgaaatgtttccaaatagctagaactatacagcatatagatctaaacaagtccatgaaccccaagcaaaagaaacatacagaacactctacttacatgtacatactaataaagtactatcaaaactagtgataacaacatattcaaagccttagatacggcaatgtaaatgccgaggattgtcaactaagtaatacaaagtcaaaaattcatcaa

SEQ ID NO: 549299 - DNA, 216 bp, Homo sapiens
caggtcctgatcacgtgcattgtgcggtggtcccgtagtatccctaggaggcgaggcaggcggatcacctgagatcaggagtttgagacagcctgacccaacatggagaaaccccgtgtctactaaaactacaatattagctgagcgtggtggtgcctgcctgtaatcccagctactagggagtctgaggcaggagaatctcttgaacccgggagg

SEQ ID NO: 549300 - DNA, 263 bp, Homo sapiens
  misc_feature (125)..(125): n is a, c, g, or t
  misc_feature (196)..(196): n is a, c, g, or t
  misc_feature (250)..(250): n is a, c, g, or t
atgctggcatgaaggattccaggaagatctatggagacctggctggtagctgtaacaaaaatggtggagtccaaggaaacagcctgtttttggtgaatgggactttttttggtggacacttggcnccagctttgaaagcccttcccctgtgtcctgcccccatgtgggtcaaatgtactttttgtcacatgagganagtgctagttcatgtgttttccatttttgtgagcatcctaataaatttgttccnttttgatgccaga

SEQ ID NO: 549301 - DNA, 110 bp, Homo sapiens
tgtactactacagactcctatatatacatactaggctctggtccactgacgcagtccatattgtcatttcctatgaccagccacatggcctccaggtcatacaggctcct

SEQ ID NO: 549302 - DNA, 169 bp, Homo sapiens
gatgaatgataagccagggatgcactgaggtgttcgtgcctcaaaatgcccttcttggtagcagactgaaatgaaccatccagtcaacttctataagcagaagaggtgcttctgatctgtccagtgaagagggtaggagagtgaacaagatcgacaaggaggctctaca

SEQ ID NO: 549303 - DNA, 278 bp, Homo sapiens
tggcagtataaagtacatctctgcatgtagacaaccggaagacacagcagttcagtacttcacccaaaaatttcaacattgccaacacaggacattgcgaactgacacacagaaatactaggaaatgcacagtcttgaagctccacaaccaaaacagcaatcttggaacggcccctaatctacctcctcaatggtggagactgacccagaaactaccttgtggaccttttttcggaagacaccaggcccgggaacaccggcaccctgatacagaccgc

SEQ ID NO: 549304 - DNA, 347 bp, Homo sapiens
gccggctgagttttttattttctgtagcggggactcatgatgttgttcaggctggtagtatttctatttttagttgggggagaaaccccaatactgttttccataatggctgtactaatttacaatacaaacaacagtatactagagctccttttccttcacatccttaccagcatttactctttatctttttgatggtagtcattttacctgaggtcagatgatattccattatgggtttgatttgcatttttctgatgattagtgatgctgaacatttttttcatatactttttggctatttgtatgtctctttttgagaaatgtctatttggatcatttaccta

SEQ ID NO: 549305 - DNA, 242 bp, Homo sapiens
aaagtaaaaaagtaattatgattccttgtggctatcatttctgaaatcagaaattatcttattctgtctttcaggctaagaatacctttttgttttgttttggttttttacaatatataaagtgcttttatgatatgatttatttaactaaaatatctatgacgagatctcattatcattcagatgaaggacactggttcatgcagatgataaaggcttgggactcagctagatagagagag

SEQ ID NO: 549306 - DNA, 273 bp, Homo sapiens
gggggggggggggttttttttaaccccccccccctttttcgtcccctttccctttgcccccttggattcccccttttgggggggggggaaaaacagggcccactttggcccccggggttccccccttagcggggtttttcgggcctttggttttgccttttggggggggggggtccctttcggggccccattttttccccccctcccccgggcccccccccctccccccgggcccgggggttttggtttcctttaaacccgcgggggggggga

SEQ ID NO: 549307 - DNA, 783 bp, Homo sapiens
cacacgacaacgtcaacgacactgaaacactctcgccattccctatccatccggatctaccccccggatggaccacagcttttcctagaccgatatgctgcgcgacgcgtctgctagaactcgttattgtctccctccttgctgtctagatactcgactgagactcgcgccagtcttgccttgacttaggaccaatgtgctcatctttaagcacgcgttgttaatactttctcctcgcctgccgactgtaagcgtccttgttcctgtccaaggaagcgtcttacgtggacgagacagtggcctagtgtctacgtttttcgtcatctcaatcttacctgctctgtatctctctgctctcgggcttgatcgttggctgttcacgagggactttgtctacttctgcttttaacctaaggtcttgtttgtgtcttgatgtaccattcccagcacttgtgacttttgtactgtccgtggacaagcactcttcctttatccagctgagatcttggcccaggctgttcagtaaagccattttgctctcttccttgcactacgctataaatgaatagaatagagatgaaagtgtttcgttctaaacatctatagggctcagacttaagtaaattaaatgcgcttattggtctagaactctgcatccttagggctacatatagattttaatgtgttttaaagaagactgagaaattcaatgtgtggaaatgttataaaaagccagatatatttattaactccaaaggggggggaatgtctatgttatatttt

SEQ ID NO: 549308 - DNA, 213 bp, Homo sapiens
cgagcacaagtggtgtgctcagtagtacaacaggatgaccatgaatgcggccctccgtacgcctgcttcactacctttctgtatgtcatcctatttgccgggtgtgctagacggcaggtcaggtccaacactgacacgttggcagtggggacacggaaggccatgccagtgagcttcccgttcagctcagggatgagcgttgcccacagcctt

SEQ ID NO: 549309 - DNA, 1012 bp, Homo sapiens
  misc_feature (309)..(310): n is a, c, g, or t
  misc_feature (925)..(925): n is a, c, g, or t
tattagacaacaatcacgtgcctatcatatagtaaaaacctgaccatgacccttaatagtggtgccctcatcgtacgaatcccttgcgctaattggaactcatctcggtctcgtaatccattcgatgcatattacacttaccagactcgcgatgagacgactccgcatcagttacttagagaccataaactacacgcaataggacgatctcatagcacgagtactatccaattggaattgcgtcagcgaatcgtagaacatcgcagaacaggacactactactcatcggacactatcacagcacacgcnnacctgatccaaaacacggccccttcgactacgggcaataactcctactttatttaccctcagacaattatttttcattccgcaggaattatttcctgaagccacttttaccatctccatgcctatgccccataccacccacaagttagagagggcacatggaacccacaaacaaggcatcaaacccgactacaatcccactagaaagtccacacgtcactataacacgatccagtacttaactcgacactcacggacgtatacaattcacacttgacgctccacgcaatagatcataactacgacaaaacaaacacgaaaacacagaagtacattccagagcgacgtgacttaatatacaacatttatacataggagtctacatagttattagcccgtccgtaacaaatgcactcaagaagatacgattcggagatcatccccatatcacccatattaccagaaccgagacatcatacaggacatcaaacaatatatatcagatagaccaacaagagcttatccacacggaacctatcaccggtcaatatataaggagctcgaccgttatccatcgaactattcatgactacaattccagcacaacatacataanatacacatatatacgatcacaagacaattcaacttatggacttccgaacgaccggccgccttgattacctggacatagaggtagaca

SEQ ID NO: 549310 - DNA, 586 bp, Homo sapiens
  misc_feature (129)..(129): n is a, c, g, or t
agtccaagttgtgtattgacttgtttaatacccaccagaccctgtgaagtcagtatagtgttatcccttttataggtgggaaccagaagcacagggagattgagtaactgtgtgacatgatttctccantattctagacagaacaaaaaccattttttttttttgggtgtgtcccttatgtttgcccaggctggtctccaacttccgggcctcaagcaatcctcctgtgcctcggccttccaaagttacggggattacggggtgtgagccaccagtgccaggaatttttggagctttctaggaattcagcacttggcttatattatctctttcaatctttccaatcgtgtaaattagatattcttaatatctccatttttaggggaagggaatgggagacacaggagattacccccgggtctatggggggtagaacgggggcttggactcccggcatattggcctcttagccactttcacccaccttacaaggagctagcaccttggctgggggtaacagggagggcacctttcgtgaacagtgcttaagagggggtgtaaccgtgttcggcgttccgagttgtgg

SEQ ID NO: 549311 - DNA, 117 bp, Homo sapiens
  misc_feature (3)..(3): n is a, c, g, or t
ttnatacagatgctgctaggcatggtgcccagcaggagcctgaagctcaagaagccatatgtagctgcaagagtagggcataggagaacctgtgagccggcgcgtgccagagaaggg

SEQ ID NO: 549312 - DNA, 362 bp, Homo sapiens
caggggtttttgagggttaggaaattttaggtggaccccttattttttttttttcccgaaaaaataatttgctttggagggaacctccaaaaaaattcccctgggggattaaaggttgggcttccgggaaatggaacccccccttttttttttttttttttggggaggcaatggggtttaaccccttttccccccagtggaaaataccccccttaaaaccaaagggctgggggggtttgtttatatttgcttaaacagggaaaagggggtgccttttttaaaaaattttaagggggtttttaatgtggaaaagtcccccaaaatgggaatgccaatccaaaaaatattgttttaggggccca

SEQ ID NO: 549313 - DNA, 212 bp, Homo sapiens
ctctagaggatctccaccaaggaggcagaggcacaagggaggcagaggcacaagggaggccagaggccagggaggccagaggcaccagggaggctaggatccagggtgtcacaattccaccccttgccagctgtccagcagctgtccagccctgggggctgaaaccaaacctcatttctccaaaccggccccccttctttggtgcctctggg

SEQ ID NO: 549314 - DNA, 743 bp, Homo sapiens
agagagagagagatcagaaactcatagatatctacctggagagcctctctcaaggatgaggttaatgaagattatgccatgtgcagaagcagacccgtgccggccagcgcaccagtgttcaaggcatttgttgctatctggggactacatagtggcctactgtcgtgtcgtgttgtgttaatgtgctccaagagaggtggcacacgcgactatcgctgtggtggccattatctctggccaaagtctctcctatctgtcccctgtgctgcagagtgctacgtgggggaacaaagatcggcaagccccacacgtgtcccttgcaagggtcgacacgtgccgcgtgctgtgctctgtgcttgggtacgcctctatcctctgcacccgagggggcacgttggtatctgtcttcctgctatcgttgttgccgtaagaatgcgtgctctatgatcggcgtggtatctgatgacgttgctacactctcagcccgggaggtgtgcaggtgacaacctctgggcaacttcgccaagggccacctttgatgccatttctaagacctagagctatcgtgacccccgatctctggaaaggagactgtatccaccaaagtctccctatcaggagttcacgtgaccctctcgtaaagacccacaacagagtctccgtgcagcggaactcaggctccaggcttgtggttacaacaataggggttttatacgagaaaaatagtgtggaataacagcgtg

SEQ ID NO: 549315 - DNA, 660 bp, Homo sapiens
attatttctgacacattgtttcatttagtcatttgcacacataaattcacacgtcagaattctgcataggtcagattagccctgaaatgtagaaagactggtacaataactataagttcgtaaatggttacatcaggtaaaagggagttaggttgttcctgtaccatatggcaagtaacttttactgtgtcacctcatttagtccatctgcataatccagggtaaacacacacaaaaccaatggctatttaaaccatgcagagagttaaggcaaacttactgttcctaagggatatttttaataaaaggcatgataaatgtcaaagtgaggcatgtgagatcatgattttcttaaacctactggcaacaagcttaataaatttacagtataaagacttaattgattcaacctaaaaacacagtatttacaaatgcacatttttactcacaagcatacaaatctaaatatacaagaataaaacttccgtgtgcagtgcaagtttatcccacaggttttaaaaagtcatcactaccaacaatgtatgtgcctgaaacaagattcatgtacaatgacatacactttagcattttaagcacattccaatgaattccatacattattaggcagctgcattcaattcattttacctatctgagagt

SEQ ID NO: 549316 - DNA, 236 bp, Homo sapiens
actctcactgcacaaagaaggcgaagcggacacaggctggagggctggtcatgcagccggcacttcagagcggacctggaagcttccagactgtcagcctgactccaaagccactctcacaaccactgcttttgggacagtgtcctctgggcccctcataccttgaaaatacactttcttctttctactcagatcacagattgacagaacacatactgccgagaaaagcagtggtt

SEQ ID NO: 549317 - DNA, 286 bp, Homo sapiens
  misc_feature (277)..(277): n is a, c, g, or t
caggcagatcacctgaggtcaggagttcaacacaggcctggccaacatggtgaaaccccatctctactaaaaatacaaaaaattaactgggtgtggtggcgggcacctggctgaggcaggagaattgcttgaaacctgggaggcggagggtgcagtgagctgagatcgcgcccctgcactccagcctgggcaacaagagcaaaactccgtctcagaaaaaaagttcattcagagttaatccctacagaaacctatttggtaagaagtataaagcgtngaggggtac

SEQ ID NO: 549318 - DNA, 400 bp, Homo sapiens
tgtgaatggttactatgaccatttgtgggattggctagcagatagcgtaacggctgattttgccacaccaacggatttggcagcggtgcgattataccaaagtgttgacgacgcgttgcgctatcttgctaccatttgaaggtatgagaacaggggaaatcatatgccagaatacacaatgttagccgactttattcgggtttacatgtcatcactaaaacatatggaaaccatgctatcacagccaatgcgtgaatatgggctgtcttttgagcagtggttgattatggcagccattgcgcgcgaaaacgccgttgacattaacagaaattgcggctgacgtgacgtgaccaaggcgctgttgccgccaattaaggccgttgttggcgttggatttgtt

SEQ ID NO: 549319 - DNA, 335 bp, Homo sapiens
acaagccatattgaggaaaacgtagtgcatgactcactttctttacataagatattcattgcacattagccatttagaggtcattcaaataacagaatattcgatcgtaaaagaactgccaactttaaaacaataaagatttgaaccatgaaatgcgagtgccttttaaagaaggatacatttttaatatatttgagtgagtgctgcgaagtgtgaaaatatttgtatgtatcatatcacagacaaacatgttcactacacaaatgttcattaactatatactatgtaacaggtgaaacagtgttatgtaaaatagaattgtgtaaactgattgt

SEQ ID NO: 549320 - DNA, 519 bp, Homo sapiens
tttttgcccatgtaatgcaaactgcctaaaaaaattttttttaaacctcctccttgttacattgatttcacatggcgacgtgcccacataaaaaacatcttctggaatactatgcgtctcacaggtgacacgtgaaaagctctggtttaaaacagcggagcttgacaatatcgagaaaggcctggtggaactaaattaaggcaaatgttacttccctattcagggcaattgatcaagcagatctgctcatttcaatgaaaatgtcttaaatatttgccaaaataattgccatcgggaaagattagaacacgtagctgataaaatgcgctactcagcactggcaccagaaatcttacggtcatcatgtgcggttgtaatctacaccgcccacaggttgtacaccctatttacaaagtcaggtggagggcaatgcccaaatgttttttgaaggccaccccctaaaattggcaccgattgatgaataacaacgcccggcccgctttacattttggccaaaag

SEQ ID NO: 549321 - DNA, 1595 bp, Homo sapiens
tgtatggtccattgttagctcttgtggctttcctccggtaatgctccgtcttaaatccgtgtaatcgttctcgatataaatatcatgtgggtggtatacagtgccgtgatattccactgtgtcgctttcctcttcttgatgtcgagggtctcattgctcataaaacgatagcttcgtactgctttggtccctcatatcccgtttcgtaattgtatgtgaacattcattggttacacccaaaggcattcgtgccaacgtctggggaaataaataggggtcaccttggggtgtggggtttcgttatactattgactttccccatttttctctcacgcaaatgtttttccatgatttccaattccttgcggataacccaactgaaaatcaatgttgaacatggtggatagtgttaatttcgattctgtcctggcacctcatggcaacgcactgtcaataggcgtaatctttactgtgcatagggttttgtataggtgacggggacaaactctcgaccgtgtatgactgttgaatatgcggtttcccctggcaccttatggatggacggactagtacaacgacattacacccttgctccaaataagcttccaaagcgattcgtctccttctatgttgcttgtacaaccccaactcgggccatccgcaatggcacttccctctttctactttgccccatgggggagaattttccccaaaggcataagttgtgtaatccatgtaaccaactgacgcatcactaaaggttgtaacacaaaacgtgtggtagacctccctcagcttaggcctcgctggtgatgcacccattacacaacgctatggctcaaggcgtcccctaatgggcgcgctgttgtacacccctgttagttacctgttagcttcgcctgtctctgataggcttatcttctgtattgcgctcgcgttatggtagtacactaaggttgtagtttgtccctacgtgagataatttactagctacatggctggaggctagggccccagtagccaaggagacgtggggaactattcccaggtgtgcgcgcactcacgatacatacgtcgtattcgagtcgcatttgctttcatacctaggcgtcgcaacgcaccagatcttaacgctgtcgcccaaccaagaatgcgagttcggctgttttccaacacagtatgtcacgtcgtgccaagaaaagctgtagcgccaggcataatgtggacgatgacagggacctgataagtacgccgaccatagaaagacacgcacggtggcatcgaatgcgactagaggaccctcacgaggattactgaggccctcttgatacgaggagtcggtttacaaggacccaagagactactgcctgctctagagtttctctacgatgaggcgcggcgagtacgagacgtctctcttagcagcaaggacaagatgcagatcctggtacacaactgtgcttattggtgagcagaaagatgatgctaggggtagtgatcggtgataggggctgtctgtgtccaggaaacttaattccctggtgactaaagagctttgcctggtgatgaggaagtattttgtggcataatacata

SEQ ID NO: 549322 - DNA, 1106 bp, Homo sapiens
tcaactaggatgaggaacctgattagtcttatactagtatccttgaatcatttcgatagtgacatgtatcctcctcgagactcctagctcactcatagtgatgacaagcatccaactatctattgaagactatccatggtcgtcccttattgagcggatgcacgattataggatttagcagctgaaacattcaatcaaacttgcccgtatcccgaccttcttcaccaacacatgtacaacctcacatccccgctttatgccacaaatacgtagaatattgatctgaaaccgatcaaccctataacatatcaatcaaaagaccatgcctggaataacttaaatctgattgaaatatttacttgcaggccaccttactagatagcacctaaatatgagaatctgctgcactagacatatcaaactatataactttccctctatgcttatcatcgtatgtcaaattctaaattctactgatgtatccctataacatatcgtgtggctgccactctagtccaagcctacgattgcacagaagcgttcttatttaggcctctaacctgtgacgaccaacgaaagtaagtggcgcccaccgagtgaccatgcctgtcatatttgtagggcccagtgctatgacagcctgacagaggggccatcttcgagagcagacctaatggaccttcagacctagccatgtgcttttcgtctagccgagtccagtaaagcgtcgtcataatagggctacgtagccatctcacttaaccgtatatccatgatggcgcgaggttacccgagggttgcactttccaatgtcccctgtcgtatcattcctgttcaaatagggcctctacacggaaaaagccctataattacgccgaagtttatgatttcccggaatactagaaccgtttccgcccgcatagatgccatagtcccgaatatagggtgtcgcccagataacggcgacctgaaaatccatgatcagacgcgttccaaggatagagcgggccagttttagaaacccccattggtgttaaactggggtatccgacaagaatttccccggtagagtcaccacagtgaatatgctcaaggcttttgttaag

SEQ ID NO: 549323 - DNA, 140 bp, Homo sapiens
ctctagagttcccccccgtccgatggcccatgagatagagagacacctgctaggtgtaaggagaagattgttaggtctacggagggctccaggttggtgagtacgttcccatgcttaaggtgagggtagacttgttcaac

SEQ ID NO: 549324 - DNA, 155 bp, Homo sapiens
  misc_feature (113)..(113): n is a, c, g, or t
cacccaggcgcacttctcccagcggagagcaaggttttcttctgttttcatatgccagtccagaacaatgttctacgcacatttctgttctcatggtaaaatgagggcctctnggccatcaattttggctaagcgtgcccacttggtgataatga

SEQ ID NO: 549325 - DNA, 298 bp, Homo sapiens
acgtgtcctctggtgccatgccccggtgggcggcgggcctctctactcgaaggtgacacgtttagattctgagccgggacgtggcgggtgcataggtcaggcgtgcttttttttaagttaaacttttcctttttggctgtctagtcaccctcgtcggtcttctgcttctgggtatcgacatcgtcatcctcatcatcttcagctggccgctggcccgtagctgactcagcttcctcaccttcatctccatcctcttcctcaccatcagcttcttcttccacctaggggtaccgagctc

SEQ ID NO: 549326 - DNA, 770 bp, Homo sapiens
ggcagccggctcgggtccccttccacaccatggaagcttgttctttcgctctttgcaataaatcttgctagtgttcactctgggtccacactgcctttatgagctgtaacacttaccgcgaaggtctgcagcttcactcaggaagccagtgagaccacgagccccagaagaacgaacaactccagacacaccgctttaagagctgtaacactcaccgggaaggtctgcagcttcactcctgagccagcgagaccacgaaccaaccagaaggaagaaactccgaatacatctgaacatcagaaggaacaaactccggacacgctgcctttaagaactgtaacactcaccgcgagggtccgtggcttcattcttgaagtcagtgagaccaagaacccaccaattccggacacaatactagtacatgaaatgataggcttctcatggacttcgaactatgggtcattttagcttcctcaagtaacctgtactagcctttaatccttaagtgtcagaaagttattcttttacctaacaaaattcattggcattttagaccaattgaactttcatagattataacagatactatttgacagagcatgagaagtccagtaaccaagtactctgattgtacagataaagaacacaagctttcagaagaggtaaagtgtattcctggaacacattaaacgaagggaaattccagacgtgtgatttggaaaagttagagaagaaatactaatgaagagggtctccagttggaaactaag

SEQ ID NO: 549327 - DNA, 675 bp, Homo sapiens
gatgaaatgaaatgatgagatgaaatgaggtgaaatgaaattagatgaaacgtaatgagatgaaatgacataatgaaatgaaaaaatgaaatgaaataacgacatgaggtgaaattacatgagatgatgaaattaaatgatgaaactgaaactaatgaaatggaaactgaaactggaaactgatgacgatgacatgatgagatgaaactgactgagactgagatgtaatgactgagaggcaatgactgagactgtaatgaactgaccatgacactgaactgagactgacctgaccctacatgacaggaaattgaatggagatatgagatgaaatgagataaaatgagatgaaataaatgatgagatgaaatgatgaaatgctgaggtgagatgagatgaaatgagatgaaacgatgagatgaactgaacgaatgagatgaacatgatgagatgaaactgctgaacatgagatgagatgagaagaaatgacttgatgagactgagataacactgactgacactgaactgaacgtgaaactgaacttgcacatgagactgagatgacatgagataaccatgactgagatgacaccgccgaagaaactgcgactgacctgactgaacactgactgacgatgagatgaaacaatgatgggactgaaccactgacgatga

SEQ ID NO: 549328 - DNA, 332 bp, Homo sapiens
tcccctgtatccccacccaaatctcaggtagaataggatctgtgtccccacccaagtctcaggtagacttgtaatccccagtgttggaggaggggcccagtgggaggtgatggatcatgggggtggatttctcccttactgttctcatgatagtgagtgagttctcatgagatctggttttttgagtgtgtagcccctccccctctcctttggctctcttcctctttctccggccatgtaagatatgcctccttctccttcaccttccaccatgatggtcagtttcctgaggcctcccagccatgcttcctgtatagccggcgaacctatga

SEQ ID NO: 549329 - DNA, 340 bp, Homo sapiens
tgctcttgctgctctagtactttcaatggtgatacgaggttgtcgagtgaaagatcttacccagcgttactccgtgtaggcctgtaatgctatgaatccccctctaaacactgctctagctgcatcgcaaagatactggtacgttgtatcttggtactcatggttttcaaagaacttatttatttctgccttaatttcgtaattaacccagtagtcatacaggagtaggtagatcggtttccatgtatttatgcaagatagagtgagtatcttaatcctgagttctcattggatggcgctgtagtcttgaaagactatttgtaatgatatccattctttt

SEQ ID NO: 549330 - DNA, 211 bp, Homo sapiens
tgcgccagaaagggcagagtacgctggagaggaataggggagtgcttatattcctccatgtcccctcatgtacactgagtaccggagagactttttctattttattaatatgcaagtgttacctgattctagaatgaccaataaagccaactgagatctttagagaaaattgttgtgtggatgagattctaaataaaaaaaggaaaaaaag

SEQ ID NO: 549331 - DNA, 173 bp, Homo sapiens
  misc_feature (162)..(162): n is a, c, g, or t
cctggccgtcaatttgatgcccttccattgtcctagacttctgaagagggctcactttacactattgtgcattacagaacaggctttatactgccgttttttttttttgacagcaggatgtcactctgtcgccaatgctggagtgcagtggcgctatctcanctcaccgcaac

SEQ ID NO: 549332 - DNA, 726 bp, Homo sapiens
  misc_feature (726)..(726): n is a, c, g, or t
aaagggagatgagattcgtcggagacaaatttcagaatcctttgagatgatccaattcaaggaaaaccctctataaaatttaataaactgtataagttaactataatgtgttatactttctttgtggtgtcttaaaaatttaaagaagcgaggaacatgccattggtgagtaccgttggaagctattttaatttctaggaaaagccccaaatatcactccaaatagattttgtttgcagatctcagttcagaatgcacacacacacacacacacacacacacacacacacacacacacacacacacagagagtatgtatatatctccccaaaggtggatttctggtcacagagattagagaggtgggtataatataattgaagggatatatctaaaacccctctgagagtcgcgacaatattcagagaacagagagtggttgcccatctctctaacaaaagtagtgtgtgggaagcgtgatctacaagatgtatcgtgagggatgagggtcatagagcatagtgagaaaccaagagattcttcttccggtggtaagaaattacaattagtcactctagatatatataatgtattccagtgtctttgcagcctcttttctcactctcgatgtatatccttagagaacctagaagttatcgatgtgggaaatgagtcgtgaagttgagaagaagagcctatcgcagatatcttagtatttgaggcccn

SEQ ID NO: 549333 - DNA, 142 bp, Homo sapiens
gcatcaacacgggattggtctgaaaacgcagaatgcacaggagactcggctgatcctgtgctggatgggagaagagactgtgatatgagcctggcccattctagtaggaaggggagggagcccgttcagtaggtcatcctag

SEQ ID NO: 549334 - DNA, 705 bp, Homo sapiens
ctgcagaagagacatgcagcaggaagggtagcagctatctgtcaaggagctggcggtctgccgttctggtacccgtggattctccccactgtaacgcctgttacacacaaactgtagtggagttcctgccaggcttgaagaacatgatctgaattttgtccatccttttggttatatatatgtaaggtttatttatgtgttttcttttctccttataggggggtattcagagtgggctgggcccctgggcgagacacagctacctctgttggcatctttataataccaggaacccagcggatactagccactgagcggctaaatgaaataaagtggaaaaaaacaaaaaagaggcaaaaaccaacaagcactaaaaaaccacagacacaacaaaacagaagcaaacacgcagcccacacgcgactccatggacaaccgaacacaacacaacacagcacacagaaaaacaaaacgaaaacacagaagacgagagacataacaaacaacacgcacaagaagggcaacagaaagacgacgcgaacagaaagaaacaagacaaacaatagaggacacacataagaaagaaacaacaatcacagagacacaaaaagacacaacaacaacacagagtcagaatagaaacaccagaatcaaagcggacaccaaagaagaaaacacccataagtaactaataacacaaaagag

SEQ ID NO: 549335 - DNA, 124 bp, Homo sapiens
attctagaggatccctgatgtctctcctcgtatgcctcatcgttggtgatgatggaatttgtcaaacgattgtgccagactttgacctgccagaggtccaggccctagcacgccaaagttatca

SEQ ID NO: 549336 - DNA, 437 bp, Homo sapiens
  misc_feature (57)..(57): n is a, c, g, or t
  misc_feature (121)..(121): n is a, c, g, or t
ggaggaatcgaccccggagatgggctgtagcaagccgcacctggagagggtgacccnggggatcacgctcatcctagattctgccccacgtgtgacttaggtgaccatcatagaaaagtcncctggtgaacgtcatttgatttcttcccggggacaagagactagctgtgtgatgcctggagatgtgaagaccttccacctgatgaccaatggcttccacatgacatggagtgtgaaggtgggtgagcacatcacaccactgggatgcatgggatttaacagcatctcaaatctgactcaggtcacccagccttccatgttttcactccctaatgcacccactctggcagacctggagggccgatacacatgaagccagtgcatggatcatgtcagagtaaggcctcactttggactctcgcagcgctgatattttg

SEQ ID NO: 549337 - DNA, 140 bp, Homo sapiens
actacctccactgccactgacatactacttacgagctacactcaacacttccctatacagcgctttaactacgcgcactgatagacagtgttaatacgaccagctgtgatagatcactatatcttatgagattgagctat

SEQ ID NO: 549338 - DNA, 437 bp, Homo sapiens
ggagtgttatcatcagtgtgagcagtagattacattgacttcatgctcatgttgaatcataggcatggacagattcgcatacaagtccctaactgtggtgaccgtaaagcgatggcataattctaccgttcatctagacgtcgtccactcataggagctagttgcgacgttgctactgccatagaccttgaatgattctcagtctgagagggcctgtcattactagtgtcagcaaagggcaggtctcaatcatgtttcgaatgcaacgcttattctgtaagtttgtcaagcaggtcagcttctgtaaatatggtatggaccatcttccaaggctcctccagtgtggccctttgacaaagaatctgcaataatccctatggttctgcacgttctgtccacgctacgataattccgtttgctgcacttgatctgttgag

SEQ ID NO: 549339 - DNA, 255 bp, Homo sapiens
accgaccgcaggagggtggtcaccgatggtcacacctgatcacccttcccagaccaccccctcctacaggagcgggacaagatcgcggctcccatcagtgactcccagaagccacggcaacagcgtgtgaccctcacactacctgtcctgaatggcgcacgacctgtcatctttgtggcaactggacaccgcaagcagctgttctgaagcgcatctcggaggaccaggaggaaaacgcgctgaccacctcctctt

SEQ ID NO: 549340 - DNA, 344 bp, Homo sapiens
cataatcatgtgcagctaatttttatattttagtagagacgggttttcaccatgtggccaggctggtcttgaattcccaacctcaggtgatccgtcagcctcaggcctcccaaagtgctgggattacaggcgcccaccaccacacccagctaattttgtatttttagtagagacggggtttctccatgttggtcaggcagtctcaaactccccacctcaggtgatccacccgcgtcggcctcccaaagtgctgggattacaggcatgagccacctcacccagcctacatacaattttaaccctttaaagcttatatatatgccaaactcagaaatgaacattaa

SEQ ID NO: 549341 - DNA, 738 bp, Homo sapiens
tctcgcctcgcctagtgcctcagtctccctaggttttgcttcgcggagtacagaagctgggatggcgccagcctcccgcccccggccactatggcaacggaagcggcgcgcgcaggcggagcattctttggctccgtcccgaagaggggtgaaagggagagggacaggcaggcgaaggggagggggagtgcggagggcggcaggggtgacgcgaggcaagggacggcggcaaacctgtctgctcaggacgtgctggttccgctcactggctgctggccccaagggcttgcagactcttctgtgacaggtgttacttcctgtacagactgggttgaaactgcagctcagtaagacgataggttaaaagccaagactagggaactgcaagatacgatcgtgtactatatacatgacatacactatatagttaacttatgtcgcttagtaagccaataatgaaaaaggccaatcaaccccagaatggaacaatgagcaagatattagaacaggcctcccagtgatccacaatagtcaaatcaaatatgccactaaggatattacaaatactgtttacacctattatttagactaagaatggaatattgatacacatgcaatgttgcgctttagtaactcggtttaagccaacagtatgtaatagaccttggtaactgaccacttgtcggtgtgacctactggggaaaacaggtttacattctgtggctggatctgaccaat

SEQ ID NO: 549342 - DNA, 777 bp, Homo sapiens
cttttgggcccacttacatgccttgtgacccttggcccagaaatgacgaacacttcgccgagtgtgtcttccccctggtaccaaagactttgttcaacacatcagaagtggttaaacacaagcggttgagggacctgccggggggaaccccccccggtctcgatgtttgagggcgccaagatgtaaccacataggcgggggttccccccctgggcggtgtaccactgcgtcttttctcgagaggttcgcccctctgggttgggccccgacctttggtctagtgagcacggcccttctttctacgagcccccggtgtcctgcgccccctttggtggccaccccacaccctgggagccccctgtcccccaccctctccgtgtatttgttgtcttgaagttgtagcccctccccacttgtccgcaacccctttctctatgcacttccccgcgggccctcgtaccccgtggccccacacactggtttataggagttcaggagttccccccctcggggttctggttcctctgcccacttccttcacggggttgccccccgttttccagaacaccccccacctgatggggggccaccaccgttttacgctgctgccttttactctctgcactccgtgccctctgccggcccccctgagtcagcctttttatctttgttttgcggagggggtgggggaccctccccggagcatttccaccctcccccacatgtgccacacattgtagataaacctcccaataataaaaaaacccttgtttccca

SEQ ID NO: 549343 - DNA, 595 bp, Homo sapiens
ggggaccctccgggccgggcggtgttggccccttagctgcccggtgcgtctggggtcggtgaaaaggccggcagaagggacgtgcacttgagaaatgtctttcctccaggacccaagtttcttcaccatggggatgtggtccattggtgcaggagccctgggggctgctgccttggacgattgctgctatggccgaacacatgatcagtgattctactgtcctaagactccacaggaaagcggccctggatgctacctggtaggatatagtacctgtaaaacactggtacaaggaaccaaaggactttcaaagcaatacggagctatggcgaaaaaaatgtgacgcatgtgatctatggcccgtgcggaggccaggctgtttccttctgtcgagaggaagctgcggatctgtactccctgaataagcagtgttggaccagcgtgggcgtccccaatctatgcagtggtaaaggagcacatcaggactgaagtgaaggatttccagccgttatttcaaaggacgcaaatcttcctggatgacaacgaaaagagttctatggtccacaaaggcggacacgatgatgtggatgggatc

SEQ ID NO: 549344 - DNA, 130 bp, Homo sapiens
ctcggcccagttcacagctcaccgctggttcctcacctgcttaccagccccagttccgggctgtcttgggccatcttctcacacagtttcacttcccccaagagctgttgtaactgggctgttgtaactg

SEQ ID NO: 549345 - DNA, 257 bp, Homo sapiens
tcgtgtgtactagcgggttcaccttgtgtctgtctgactccagcccccccacagtgtgacctgtactgtggtacctgcctgggttcctgaccttgtgtctgtctgaccccagcccccccacagtgtgaccgtccgtggtacctgccgggttccgaccttgtgtctgtctgaccccagcccccccatagtgtgaccgtccgtggtacctagccgggttccaaccttggtctgtctgaccacggtctacccctgcttgt

SEQ ID NO: 549346 - DNA, 175 bp, Homo sapiens
ggctcgcaccggttcagggttgatgctgctgcagtgtgccccttttggagggggaaacgttcaccttagtgctggactcggtgctgcagggtcacggcctcgtccagctggtagttgtgtctgcatacccgtgtgccggcactgcccgctcctcctccaggatgtccttctggct

SEQ ID NO: 549347 - DNA, 1158 bp, Homo sapiens
cctttcccctcccgccggactgccaggaggtgggctggctgcggaggtgagtggccctgtcccctgtccctttaagtgagttgagtggccaaactgccggcctagagtgcggcgtagcccccacccgccagtgccctcaccccagagcagctgcagcctcagcctggccgcccctccgacagccaagtccgcgcgcgtctgacccccggcagcaagtcagcccaccatggtgaagatcgtgacagttaagacccaggcgtaccaggagcagaagccgggcacgagcgggctgcggaagcgggtgaaggtgttccaggagcagcggccaagcgtacgcggagaacgttcatccgagagtatcatcatccaccgtggagccgggtgcagcgcgcaaggaggccacgctggtaggtgggcggggacgtgcggttctacaatgaaggaggccatcacagactcatcgactcgcatcgctgccgcccaacgggatcggatcgcgatggtatatcggacagaatggaatcctcgtccagccctgctgatatccgtgcatcattagaacaaaatcagaaggccaaagcggggatggggactcacgtcttggagcaggcgcacgtcacgcaaaaccgagggggcgcccacaagtgggccaattgcgaggacactcgcaaagtccagagagttccgtaggtcggaggggaccttgcgccgcgcgacggccaagcaaagagagacaacgaaagtagacggcagcagagtcgagggcagcagcacagaagtaacgccgaggaaccttcattggcgagggcttaggcccgtggaagccgtggaacgacggtacgcaccatgggggagcgggagccagaggcgagaacgcgagcgcaggggaagcggcagtactggagaggcaaataccacgccagaaggggcgcgtgtcccacgagggcgggaacaagcgaggcggagatgcgcgggaacgggaacccgcatggacaggcaaactgcgatgacgaccgcaagcgtaggaaaggacaaggggcccgctgcacaggacgcaaccgccggcggacccaaagcgcgcgcgcaacgaacccggagacgggggccccgatgggcatgaggcatagcaggcgacgccggaggcgcgacggacacacc

SEQ ID NO: 549348 - DNA, 285 bp, Homo sapiens
cctcggtaccgattatcagctgcatctctgtctctgtactcctctctcccacaggtttggcattttttctggcaagcatctcagtgaagagatcccatctggagaaacgtttcaagaagcaagcaacagacgtatcccacatcctgacagagcaagcatgaatgctaccagttagtagggaggtttcttgttaaaaacaaaacccaccgcacaatccttttgcaaattctctgcaactggatggctcatactgacaaatatgctgcagaacaattatcttagcag

SEQ ID NO: 549349 - DNA, 100 bp, Homo sapiens
cctcttatgttttaagaataaaaaatctacactagtcccaaattcaaaagtgggactaaggatctgaatgggcattcctcctaagaatacactcatacgg

SEQ ID NO: 549350 - DNA, 830 bp, Homo sapiens
atgacgcccaataggcaaaattaacccctcccttccctacacatcaagctcgaggatggccccacccgggatgcaaattagctttactcaacatgcccgagtcaggaaactaaaatagctcttagtctaaatagacactttcaacctgaatacgtaaagacctttcctacagggtctgagaaggccaccgcagctcatttcttcccatcgtgtcagacataattcctcagtgtagccttcccacctctatacagtcgtgatacccagagcagcctttatagtcaaaatcagccaagcagtttccaggctcttagtatccagtgaaacccttatatcccttacagtcctccatcttcaagacacacgtcgcacggcactacaggtctttcacaaaaccacacctcaccaagcctcaagccaccaacttaacaacaggcagtgtacactgtgctttcatcacttctcgcttcctcagaattcaggcctgtcctcagactggttaccaccaagggtacagtccatttaagctccgtgtaatagacgctccttgttattaggccccaagtctccattcggaccacgcaggaacaaagtttaagagttgtggccccaaacacatctgtgtacatccccgtcactatcttgggactacagtccatatccttattcaaccattgctcaagtaatcactaacaccaccgtggtctggttacacgtggcggcttcacactggtcttccaaggcaatcacaaggtggcggcatctgggggtagcccaacgggcatccaggctaaaggaaacataacttggcgggggctagcggatcctag

SEQ ID NO: 549351 - DNA, 793 bp, Homo sapiens
  misc_feature (443)..(443): n is a, c, g, or t
tgtctgctgccagtcactccttgcaaagtggcttcctaatcagtatgcacttgcagcttatatagttctcgtgctgtggagttaaatgttcctctatcgtggagctcatgtcgcttttgagcgcgctagtcttcacggatatatatcatacgtcgttggtagctctaattgaaatcgattctctcttgcggtgaagatcaattgtgtccatatattattgaatagccctgtctttcagtacttaaggtttgatctgtagcttatagaagtcctatggccaaaaaattgaagtcactacacaatatagtacttctacacagactattagtgggcactcgtgccctcagcatcattgcctcatagaggctgtgtacaaccactgtctcttgagtatcatcatctcactggtgggtaaagtctatctttcagacactttgtcgtcnaaattgcgaaagcaatttgagcactattccatgtacgagagcccaaacagctatttcaatttcgaccacattcattcattcacactggatcgcactcagttcatttcatagtgcgaaccggtcgtaaaatgactgtgatttggtctagtgaagcaccaaacctactaaagtttagtcttgaacttatcataggttttcctacctagaaactgcctaacttgatttcgttaactggcattggatcccgtgggaatcagtgtcacagatgtttcccatatcctaggatataaccaataaactttgttagggagagccttgggccaccaataatttttgcacacggatttacc

SEQ ID NO: 549352 - DNA, 320 bp, Homo sapiens
tagataatatagagaatgccagatcatatcaaaactacagtacctatgataactgcattgggaagcagcatatgtgcagctgatatatgtgttcctcacatgttgcgaatggttccatagctctctcctgtacaagccccagacacgaagctgagtagatcgatgtcacgtgaagtgtactgtatattcacccgtataccttccttatcactgacacaacaggtaggattaagagatgggtcagacaaggtgctgtccctgttacatactgcggtttatgtggctgttattcttgttgtgccagtaacatgctgaccttg

SEQ ID NO: 549353 - DNA, 135 bp, Homo sapiens
aaaatgatggaggtgaccgatgaacaaggatgcatccccatctgtccaaaggctatgcgtacgtagagtatgagaatccagatgaaacacgagaaggcactgaagcacatggaatggaggacaaaatgatggcca

SEQ ID NO: 549354 - DNA, 144 bp, Homo sapiens
  misc_feature (130)..(130): n is a, c, g, or t
atatactaacgacgtcacgtacgtgtagagatatatttaagtaatatagctctatttaatgttggccataatttcctttatatcttactgttaaccagtagctgtaatgctaatactatcaacctattanttcagtaataacct

SEQ ID NO: 549355 - DNA, 1820 bp, Homo sapiens
gaggccaatgatcaggaaggccttgtgacaggcttcgcgaggaagaggcaccatgtctccagtcaggcatgcgtgacgagtgcgggagttccccgtgatctccgtggatggaggtacagccaaactgtcgagtgagtcaactgcgcccaggtggtaggaggcactatccagccgtgtcgtccgatgtcagcacgagatgagtgactgcgtccacgagtggcggaggagcagcgttggttccactgttctgatctcgaggtggttgaccagtaacagatcgaagacatgcggatgaggtcaacagattgtcccaagtgcagacagggggttaccctactggtgctggccagatagttgggagtaacaaccaagacttgacttgatgatgacgcttcaacactcagagatgaccggaggttatccatgtaggatctacactgctcgatgagagagcatacgaaggcaagcacgagagagcaaaacggtacacgagcgacgtggaattcaaagaggtggcacctgtaacagtgtgtcctgtattgtgccgtggcaatgtctccaggactcgaacagtgtgtagcacaaggactatggttatttgcatccaccagagatgagaagcggtatcaagcatgtgccccgaccaacatgaccggtgttggccaaccgagtcatatggacgcaccattccataacgagccaatttgaagccctggtgcaccataggattaaccaggtttgtgaaacaacacgccgaactgcggggagcgattttaacacttcaattcacaccagagagcacttttggcccatggcaggatgtgagcgccatacacatctctggaacgttatccaccattcatattcgcacgcgacgtcacaaatccacctgtggagcaaccagacaacgcagagtaggagcacgcaccacatatccgcgagatggaacagcaccgaacgtggtacacaacaggaagacacgggaggggcgaatccccgagggagagagctgcccacacgggagacacaaccacccacgagcagacctcagtacgagacacagcgaggtgaacgacagcaggagtcgcccgacatcaatgacgaagaagatcgaaagacgacaaaacaaaacagaagcgaagcacagcagatggatggcaacgacaaacaggcagagctagtccaccgggagctaaccaacccagccgagcacaccatatgaacacacaagcgggcagaccagaggggaaatctcaatcagaagaaaaagcaacaagcagaacgggacaccagcgaggaggcgacagcatggagaggcaacaatacataagaaaaaaacgacgcagcgacaggaaccaagaggagaatcagagacggacacccaaccaagaaacagcacacacaccaataacggaaagacaaagaagcaggaacgaagggagacacccgagcgtgaaacagaacagcagtagatgtgcgaacacaggagagacagcagagcgaaagtgcgagaccacaaacaagacggagcacaggggaggcacggcggccactagcgacgcacgcccacgacacaacgaagccgcagggcggcgagggacacatggacccaaacgacgaacaaccagagtgcgaggggcgaagacacaacgaaataggcctccgaggcgcagacgatgacaatgagcaggaccacacaggaagcacccgaaagacgcgaggagcgagaggagagaaccaggacacagcgacagaccaacagagcgcggcagagcgggtggtggagtgaccaggaaacaccaggagcaaccagcgagaac

SEQ ID NO: 549356 - DNA, 302 bp, Homo sapiens
taaaagcccccccctttttttttaaggagaagggcccagtcttttcccaagtccccacagggggggggaaagcattgtttttgggtaaattttgaaaagcaaacatttttttaattttcccctaaaaattctttttttttgtttttttttgaaagatgggccttggggcccccccttcccccttttttgtcccccaacttgagaggtatgaggggttttggtttccctgggggggggggggggcagccagggtttccctggcccttgatttgagcccagttgaataaaaggggcccccttta

SEQ ID NO: 549357 - DNA, 982 bp, Homo sapiens
gagtgccagcacaggagctgtatgatgaccaccccttccaagcagaatgtataccaggtgggactctctgcaatctacgtgaaagacccacaagccctccttgctgggaatgtgtctggcccttcagcagtaactctgtggcagcatcagttgggctgctatacttggtgtgtggccccaggtgtcaaaatgacacaagctgtctgtactaagacaaggttaccaagtgcggacatgggttactaactaacagagagattggctccattcctcttgggaataaacaggacagtgctgtatagatacagggcagaaggttggctctggtacccatgtgtacaggcctacccattgcagggactggggattcgaggacttccatggcgcatagggtagaaccaaatgatagggtaggagcatggtgtactttaggggccttggaaaggctggtacctttaggcatctggaactgactatataatggtcttcaatggacgagtaattccacttttggcatataggcggagcaacagagagatttcaggctctggaataagggggaatcacagttggaacaacaatatctggataactccattggaccacttgggacactactggatctggattcacttggccagtgtcaggagagaacatggagtaggaataatccctttgctggggcttaaaaagacaattatcccaaggtggacaacagaggcagaatgcccatatcttaacacggtgataaagagcaaaaagccaagatggtgacccatgtctaagatcccaagagggcaatattggccggcacttttgtgattatcccagttggtgtggactctttacgggcaccatatgattcatctaagaaccggtgtatggcgcaagacatctaagccagttacagatgatgtcacccacaggattaacccgctggagtgtgtgaagtgactgacttgtaacattatggaggacgcga

SEQ ID NO: 549358 - DNA, 103 bp, Homo sapiens
tgctgcaatcacgttgatcccagagcgttacccaatgcacccctctgacatctggcctgcttcttctcacatgacgaagaaacgtaggggtacctgatgcact

SEQ ID NO: 549359 - DNA, 348 bp, Homo sapiens
agaaacccccccccgtgggcccctttccacagggggggggggggggccctttttttttccccccgggcccccaaaagggctctttggggggtccccccccccccgggggggggcgaaaaactccaggattttccggggggcccccccccgggggggggggggccccccccccccccaggggaattggggtttattttcacccccccctttccccccctaaagggggggggggggggctccccccaaatttttttttgggggggggaaccctccccccctttttttttttggggggggggccccccctagggggggcccccccccgggcccataaaatttttcttttta

SEQ ID NO: 549360 - DNA, 449 bp, Homo sapiens
  misc_feature (2)..(2): n is a, c, g, or t
gnggagctagggcaggccatctgcatttgtcacccaagaactcttaccatggagaccctcctactgtggcaggacatggcgggggcctactgcaggcccatgggaatttggtgaatttccacagaatgatcaagttgacgacaggaaaggaagccgcactcagttatggcttctacggctgccactgtggcgtgggtggcagaggatcccccaaggatgcaacggatcgctgctgtgtcactcatgactgttgctacaaacgtctggagaaacgtggatgtggcaccaaatttctgagctacaagtttagcaactcggggagcagaatcacctgtgcaaaacaggactcctgcagaagtcacctgtgtgagggtgataaggctgctgccacctgttttgctagaaacaagacgacctacaataaaaagtaccagtactattccaataaa

SEQ ID NO: 549361 - DNA, 154 bp, Homo sapiens
atacgtacccgggaagaggtacatcctccattcctgcaggtatactgttcggctccgctgcggagggacacagatccgctgcgcttgtgacaaggctccgaagcggttgagctggctagaacgtcttgggtgtaagcacccgagtatcttctac

SEQ ID NO: 549362 - DNA, 407 bp, Homo sapiens
  misc_feature (231)..(231): n is a, c, g, or t
  misc_feature (246)..(246): n is a, c, g, or t
  misc_feature (333)..(333): n is a, c, g, or t
tgcacagcccttaagtcacctaagcatttctggcatctccactgggcataagctaaaacctcccaggtcaagatccagctagtggccaaaagatgcagtgccaggaccccttaaacagtggcacagcttctcagttcatctccacggcacccgggattggcttacttcctccaggatcccattggattttttaagtgacaaacccatggtgcttcctagagtgcatatatntatatttggccggtnaaaaggaaggtgagcagggtaagctaagtcctctttggaggtaggtaataatgataagcttggtcacggttccacaactcagcaggnaaccaggatgaattcccatttggtaggtggggagacaaatttggtgatccattaggtaaccaataatggtgctg

SEQ ID NO: 549363 - DNA, 184 bp, Homo sapiens
gaagacaagcaccgaggaagctgccgacgaagacgaaaagatcagcgaaatcgtcgacatttcccaactaccacctggttaggttagtctctcggccttgcgatcgccctcgggactctcctctatacatctatataacgtatctataaccatgagcctatttactcataagttgctatgattg

SEQ ID NO: 549364 - DNA, 1286 bp, Homo sapiens
  misc_feature (238)..(238): n is a, c, g, or t
gacctggctgtattgccggtcctgctcggtctgattcctctcgtgatgcacgtcgttcttcttgtctcctgtctcgtcgttcgtcgtcctatgcgtaagtgctgtgctcgcaagacgctgaatggaagatttcgactggaactagtggaccattgaggctgctcctgaaggaccacgagaatcgtatcttatctgggttgtgaacgtaataggccagatcaaatgattcattcatctntatagagggttcgcgactaactgtattgatgaccacttgacgacaaccatgctatactactgttaaagcataccggttccacgttatctcacgagcggctcgtgcttgcaatacgcgatgtaggctccgccacattcttgtttcgcacaggcagggacgcgccatctggacactttaccagacacgggcaagctcctcaaagttctccaaaaaggttcatatccaccttggcggccaccccggtgtctaggagaaagatgggtcctggtaagcgaaggcccacaacaaggttatatgcccccttttgtgagtgggccattctcggacaaaattaaaacggagcacgaaatctaaggcttagggtacctatgcaacacgcggttttcgcacaaggtcggtgcgggtgtgccaattggggacgcccatcattcggccacgtgtatttcaaggtgggtgcgacgcaaggacaacattgtaaaggctcaaggccatggtttgcggaagccagacacgtagttggccgaggaaaggtcccacgcacagggactcgaaacggaaccgagcaaggcaaggcgacttgtttgaaagagcgtccgtgtaatacggctaattactccgtgccgcacaagaggccgtggtccgtggcccccccttcggaacgtcgccgccgctaagctcccaaacgggtttttccctagcggcatgcctcacagcctctagttaccaaaacactcctcgcctcggacgtggacctgcaacaggaattggcattgcaaccgaacttggagtggaattgacacggaagcggcctgcagtggcagcggcacagcgaatggactgcaactgcaacatgcaactcggcatgtctgggactgcccacgggagcgcatcagcctctgcatcggacaaacaaccgccgccctcgacgctggccaaagaataacgttataacttcgcgacgagacctaacttccgcaggggcacacccaaaatgtagaggaagacaagattgaacaaacacaagaaatgagcacaacaaggagctcgc

SEQ ID NO: 549365 - DNA, 100 bp, Homo sapiens
ccgagaggtagaggagtgccgtctcgtgtactctacgttttagcgtggctttgacggctaccctttgctttggtctcatacgatgatcagtaagcctata

SEQ ID NO: 549366 - DNA, 306 bp, Homo sapiens
  misc_feature (37)..(38): n is a, c, g, or t
  misc_feature (122)..(122): n is a, c, g, or t
  misc_feature (126)..(126): n is a, c, g, or t
  misc_feature (131)..(131): n is a, c, g, or t
gggaattttatcgaattcgacggttctctgctgactnnagaccaggtctcggcctctcggactctgctcagtccctatgacgggcgcacgtggcagggtgaggtggtgcgctcgccgtcgcngcgntgcgntgagctgcagaattccaccaggtcgctgttgtctccccttgtgcaccagagcttccagtttgacgaggacgacggtgacggggaggatgaggaagacgtggatgatgaggaagacgtggttgcacgatgcccatgattcagaggccaaagtggcgagcctgaagatggaatggag

SEQ ID NO: 549367 - DNA, 327 bp, Homo sapiens
gggcctggagggcagaacattgagccaatgattattctcaagccgcaacatttcatgttgtttcctctgttgggtttcagacttacttgggaccagtcactgttttcttctttcctatttctcccttttaaaatggaaatatctatcctatgcccatcccaccattgtattttggaagcacagaacatgtttgtttcactgctagagagcagtttacctcagaatgagtcatactttcagtctcacctatatctgatttagatgaaactctgaactggagattttggagttggtgcgttcgtgcgacttgggcgctcgtgccgggta

SEQ ID NO: 549368 - DNA, 658 bp, Homo sapiens
  misc_feature (620)..(620): n is a, c, g, or t
gcgcgctcattatgcagaaaagacaaatcagacgaatcatatcagcatgattccactcatagaaaattcatagaaaagcttgtaacaactaaataatatattatttaggattatacaaactacaaagcaaaactagagaattaacaaaattcaggatgacagttacatctaagggtgagagaaaagtaatagaagaggcccacgggttcttcagaggtgttttaagcttttagttctcaaactagatcatggatctaccagtgtacaatctatcattcttctttaatctgtggatactttttttttttttaaccttaaattccaggagactgattcactttcctcatggattaattgtaaagattatggagaaccctatggtaaatgaaattggtgagatgtttcctcaaatatatgcggtgcctgtacttatatacggtcttccaagagagatacaaacagggcagaaccttttaaactagtattaagggtggtttcccaaagcttttttggttttcttaccttgaaaccacagacccgttaatccctgggttaaagcagttgctaagtttggtaatttaaggctcagaggaccattgggggtttcaggatttatgttnagcccgataggtgaggccttggatatcgggaatttgac

SEQ ID NO: 549369 - DNA, 868 bp, Homo sapiens
tccggaccgtagccagacctttggcaccaagaaggtgcaaaacgactgtccccgccggatccccgattgtcgcccaccggccccgaacgctgggcaggaccccccagagaggcggacccctccgcaaggcgacccaagaaggggttaaccaaggaagaagaaattctgaactgagaaacccattggtgcccccaacgacgtttttccgcccacatattctggaaggggagggagaacaacaccaaaacctgagaaatccgactcaaagggctcatccacacatgacgtttccccattcttagaggaatccaagagccaggatggttgtggacaaagtcatggaaacacctggaccatgatggagacggcgaatgtgacttcccggaattcatggcccttggttgccctggttactactgccctgccacgagttcttttgaacatgagtgagattatgaaagcagcccaacctttctcttgtacagagacggtcatgccagaaacgccgacacccagggcttcagcctagtaggagctgaggctttcccagccgtgttgtagctaattaggaagcttgatttgctttgtgattgaaaaattggacacctctttcccaaggctgttttacggcctgcatcattctttctgctatattaggcccgtgtgtaagctgactggcccccgggagctcttgttacccgtaacttaggagtccggtctcagtgataaagcgtgccccgctcagccccccatggccgtgtagaccctaacccgggagggaaccccgactacagaaattaccccggggcacccctttaaacttcccactaccctttataaaaaccaagccttatcccacccaacatta

SEQ ID NO: 549370 - DNA, 377 bp, Homo sapiens
ggaaagggggacccccctttgggggtgccagtgtttccaaaaaggctcaaggtccccaaggggggggcaatcccgtaaaggtcaacccccttttttttggaaaacctggcaaaatcttgggacccctggaaaagttaaagtttggggttggattcaatgaaggggcccccccgtatagtgaagataaaacccggcaagggggtttcttgggttggaaaccccaagggtccctggtgggcccattttaaaaacccgcatttcccttgcccgtaagggggggggataagcctgggttttcaccccccccggtttaaccaaaatttggatttcatatttttttgggggagggaaagaaataaaatcatatgaaaggctga

SEQ ID NO: 549371 - DNA, 681 bp, Homo sapiens
tgtggtggctcatgcctgtaatcccagcactttgggaagctgaggcgggtggatcacctgaggtcaggagtttgagaccagcctgactaacatggtgaaaccctgtctctaataaaaatacaaaaattagccgggtgtggtggcacatgcctgtaatcccagctacttgggaggctgaggcaggagaatcacttgaacccaggaggcgtaggttgcagtgtgccaagattgcaccactgcactccagcctgggcaacgagagcgaaactctgtctcaaaataataataataataaaaaggagtctggggattggagggatttaggagtgctctacaccaggaaaccccccaccaaatcttctaataagggacacagtgtggaatgcttccaacactttacaaaacactctcatttcacttccatttataccgacagagtctcactatgttgctcaggctggtcttgaactcctggcctcaagtaattttcctgtctcagccttcctaatagctgggattacaggagtgagccaccgcacccagctccttcaaacactttaacaaggaagctcaggtaaatgtgagaagagggtccatcgaatctccctcactgcattcaactgtccaagctctttacacccatccttactaatttcttccctccatgtgactaagggctca

SEQ ID NO: 549372 - DNA, 775 bp, Homo sapiens
tggaaatggagtttggctcttttggcccaggctggattgcaagggcattggtcttcagctggttgaaacctccacctccggggttcaaggcaattctcttgcttcagcctcccaagtagctgtgatataccgggcatgccccactcaggccggggctacatttgggtactttgcggggtacgacagggggattcccacggtgtgtgcgccggggcgggtcctcaaattccttgacctcaagtgatctggcctggcctgggcctcccaaggggttgcgggtctcacgggctgtgacgccattggcactggtgcctggcatcaagtcctttatgggccttggtccatatccgggtttttggcccttggaaacccaaactgtgttcgctgtctcatgttgacctcttttgaaccctgttgtccacatttttccccacatatgtgtttcacacgtgcccggcggccaaaacttgggcacccttcgcggccgacacagcttgccctgtatctaatttgctgacgtgcacaaaatgttctcatctacactgttgaccccagtcacctacggttacttcgaatcttcgtggacacacctattccctattgggtcaacgtcttgggtttcacattcacatttacatttcgcgggggcattcaaccctgcaaactgcctactgcgttagcggccctgtttgtttttgaccacactcttcttttagagccggttccaccattcggagactggcggtattttcgccaacaagcgcccttttgggcg

SEQ ID NO: 549373 - DNA, 1019 bp, Homo sapiens
accttagccaaaccatttacccaaataaagtatagcgcgatagcacacattgcaaaccatggcagcacatagcatcatcagtcaccgcaagggcacacagcatgcaacaaattataacccaagcatcaatatagccacggcactaacccctataccttctgcatcacatgcaattaactagaaataactcttgcaaggagagccaaagctaagacccccgaaaccagacgagctacctaagaacagctacacaagcagcacacccgtctatgtcagcaaaatagtgggcaagatctcataggtcagaggcgacaaacctaccgagcctggtgcatcagctggtcgtacaagatagaatcttagttcaactttaaataccgcccacagcaaccctctaacatccccttgtaaacccacaccgccagcccaaccgaggaaccagccctcagcacccctaggcaaaaaacctagcaccagcagagctaaaaacacccacacaccatagtaggcctacaagcgagccaccacactcacagcacagcgctccacgcctcaccacgccacctacctacaacaaatcccacacatatacctgcaaccactcacagccaaacggacccaaccatcaccctacccaacgacacccaccgccccgcatacgctcacaccgcccacccatcaccccccgcactcaagccctcccgccccaccaacacaccgcccctcgccacccccacacgcccaaacccacccaacacaccaccagccccaccacccccacacaagacaacccaaccccacgccgcacccaaccgcaaggaaaccacagcacacaggaccaggcaacaccaccccacagcaccaccacaaccccccctaaaagacacacacaatcacgcccgcacgccacgcccgtaccaccccacgcacacacgcaaaagcagagaagaacgaccaacgataccgacaccggccccacagcaccccaaccacaacgccacacaagcacacaaagccaa

SEQ ID NO: 549374 - DNA, 514 bp, Homo sapiens
ccagtgcctacagctcagctggtacatcgagtaacatctgtgatgcagaatatctgcagtcaggttatgacgtccatctggagtttcttgacttatgtgtggaaggaatgagggacgaccatctttatttcagtcagatccatctggagcttactttgcctggaaagctacagcacatgggaaagaactcatgtgcactgggacagcatttccttgcgacacagctatcatgaagctctggaacttgacgatgccattcatacagccatcttcaaccctaaaggaaagctttgacgggcaaatgacagaggataacatagaagtctggcaatctgcaatgcaagctggatttaggaggcttactccaactgaagttcaggattacttggctgccatagcataacaatgaagtgactgaaaaatccagaatttcagataatctatctacttcaacatgttcaagtatgtaagttttgcagacttttgcatacttattctactggtttaatcgctg

SEQ ID NO: 549375 - DNA, 291 bp, Homo sapiens
actctgaccgagttcctaagcgataagtgtctaaggtgagctctagtgaaggacagaaacctcccgttgtgagcagaagagtgtaaaagctcgcttgatcttgattttcagtacgaatacatggaccgtgaaagcggggccttcaatgatccttctgatccttttgggtttttagcacggaggtgtcagacaagtttgccacagggcattatctggcttgtggcggccaagcgttcatagctacgtcgcgtttctgatccttcgactgtcggcgtcttcttagtcattgtg

SEQ ID NO: 549376 - DNA, 153 bp, Homo sapiens
aaaaaagtaaaaggaactcggcaaattttaccccgcctgtttaccaaaacatcacctttaggcattaccaggtattaggaggcaccgctgcccagtgaccaatgtttacaggcgcgcgggtacccctaacccgttgaaagggtaggactatta

SEQ ID NO: 549377 - DNA, 218 bp, Homo sapiens
cctgccagagtgactgattgtgcatcgcgccgtagatgctttacttggattgatccacgctcgcgttcatccttatcaggcgtggcatcgcccacatttggaatagttgcccgcgcggagactttggttcctgtcctcgcgtgttccgtgagaatcagccaatgcttcccattggcctttcagacatcccaggttaagccatggtgaagctcttattg

SEQ ID NO: 549378 - DNA, 400 bp, Homo sapiens
gctcctattcttcaattctgagatgagtctgatacagaaagattttttgtcacaggtgatctgtagagaaacatgacagattaagtgttattagtataaaatgtgaactttttacttaagggtttttttggttttacttaaaaactacccatttggaaacaacagatggtcttttgattttttttttattagaaaaatgacacaggcttattgtaataagtgaaacaatgcagaaaactacagagaaaaagttaatagtttcctgcctattaaagaaacaaacttttgttgaggctaagatgggaggattgcttgagtccaggagtctgaagttacagtgagctatgattgtaccactgtgctccagcctgggcaacagagtgaaacgctatctctaaaa

SEQ ID NO: 549379 - DNA, 272 bp, Homo sapiens
ttatcttttatctagataataataaagaggcagatctacgtcattgtatgcatttcctgttaccttgaaaaaataaaaatgttaacaggaatgcaggtgctcattctccctactgtatcctacaagctgctaacttgaacgttgtctaaataggctctgagactggatgtgaatttaatgttttgagatatagccttctttcttggttaggactagtgtagcaagttgattcgtgccactcccttcactgtggcagacacggtaaagccgag

SEQ ID NO: 549380 - DNA, 276 bp, Homo sapiens
cccccccccaaaaaaaaggggggggggggggggggggggggggcccccccccccttccccccaaaaaggggggttttttttgggggggggtttgggggcccgaaaaaaacccccccagggggggggggttaccccccccccggggggcccttttttgggggttttttccccaaaaaaaaggggggggtggggggccccttttttttaagggcccccgggggggccccccccccccttttttgggggccttttttttttttttttttccccttttta

SEQ ID NO: 549381 - DNA, 263 bp, Homo sapiens
ataaatcactactaatataaagacacatgcacctgtctgtttattgcagcactgttcacaacaggcaaagacttggaaccaacccaaatgcccaccaatgatagactggataaagaaaatgtggcatatatacaccatggaatactatgcagccataaaaagggatgaactcatgctcatttgctgggacatgaactgaacgctggacaacccatcattttcaggcaaacataacagaacgaacatgtaaaaccaagacacca

SEQ ID NO: 549382 - DNA, 494 bp, Homo sapiens
gtggttcttacttccatctgagaatgcgcagttcatataaggttagatgttaacgcacctgtcagcataccttgcagtgataagacagttaatcaaagcaattccatcttgcccggttcagacagtctgactccgactttcatgcctttacgaagtgaaagggggcacaatatcatatctccccaaatatcgagacacctcttgcggtctaaactgagaaatcgagcagtgctgtctgctgcaccattcatagaagaactgtccgcttttttacacagcaaggaagcagtgaattaactaagcaagggagactgctttccagaagtctttctataagtagaaataaaaccaaacaagtacacttatccaggaagaaaaacaaaattcaagctgaaccatagccgctgactcaaggattccttcaatatttcaggtttgcaaggcaactaagactgatagcagctaagccagatcagttgattaagtgtcccgat

SEQ ID NO: 549383 - DNA, 1106 bp, Homo sapiens
ggtgagtgtgaagtgccagaggctacggggcttcaagaccgctgtctggagtccccctattccaggacatgatcggggcccacactggctgcccccgaagcagcacggagccctgccagagcccctcagggagagggctgatccaccctgcgtgcacccctggggccaccagactggcaccacggagcatgggtgctcccatgcagacagggggggccttcgcccatggaagcctgtgacgccgagatagcacttgctgagcagcacgctgtgccgagctgaatgggggtcggggtcatgcgtcacggagaacagaccgacaggcatatgagccacccgaacacactccatgcactacacggacggggcatcccatgaaagccaaaatccagacactcgcacgcatcccagcgtctccctatgggggacccactcacagcctacttacactaccgccagcaccccggatggcccagccttccccgtgcaagtgaaggtggcacagccagtgaggggctgcaggaccacccaggcaggggagcctctcaggcctctgggcccctcccggagaccccaaatttccctctcccaggacgcaggtgcaagtcaggaaggaactggcatataggacgcagaacagagccagagcccaaagggaccaaacgaggaagctgactgggatcacctgagaccctggcacggacagaaggacagaaggacggacgagcacacggggccccagggtgacacccagaagacaagacctcccagaggaatggcgctggaatcggcggccgacagaagcgcaggatcaacgcacatggacacaaccgaccaacgggtgtcacaaattaggccaagaggtgtgtaggacatgcgggagaaaaaaagtggaatgggcaattggcctagcgagtctgccgccccaggaccgcgaacaaaaacgcaggggacagcaaggagtagaacaagagaaggagccaacatacgcggagcagcatctaaacgcacagataagagagcacaccgacagcgcacagcggagacccccagacagagcacggagaccacgacaacagaaccacccgggcgcacagagccgcccc

SEQ ID NO: 549384 - DNA, 556 bp, Homo sapiens
gcaggagcatcacttgatctcaggagtttgagaccatcctgggaaacaaggtgagatcttgtctcaatgaaaaagtaaatattaaaaaaaaaagtaaaacagatttctctagagtagaaaaagagtaaatgctactgtgccgctctctgagtctagtatgactacagtatcaaaactagggatggacagtaacaaaaaaaatttgcaggctagttcatacggttgtagataggaaaagctaacattccagcaaatcagattcagtgttttaaatgcacatagctaagtaacgtttttggaggagctaaaaaatggaaaatattttcatggttggaaatcagttcaccattggaaaatacacgttactaattgattatattaaaagactaaatgagtacagctacatttgtggtcatctgcatttcagcaggcttggggaaaactgatctagttctattttgaatcatttgcacttcaactgatgtctaaaataagatgttgtttggggaagatactgcagaataaaaataaaggacagcactaacactttgttaaa

SEQ ID NO: 549385 - DNA, 915 bp, Homo sapiens
ggcacagcccgggaatctttgttagcgtagcccgcctggtccactaggatctgatcaatgggatctctcggagcacgtcataggcgcaggctcgctttactagtgtgtgtgctcggccattgtggacacacctatcaacgacgcccgctcccgcgcaggcgctggaggctcttcccctgctgaggccatggatggctttcctggctctagtcgcgctatactaccaatggtgactactaagtcgcggtctatgcctcgtcaatccactgcacggtcatgttctggtcccgccgcgcgtatattacagaagtggccatctacaggagtctgggtgctctgagagatcgttgcgacgcacacgtgccagtcaatatgtgtgcgttgcggagtgacccatcgctggttgcctcgaactctcatgaggtcgtaccgactctggccggagatgttgcgtctacagttgtataccatgatggtgtactgtagtctggcgctagccatacgcgtggtaaaggccagtacactctccgcaaactcgcgttcgccatggcgcgagtgtaaaccacgaagatggatagcacaggccattgtgtcgcctactgtgtgaaagtgatcaacgagcaggcaggctcatgacatgggagcactggggagccaatcgtcacgcacagatcgcagggtgcctctggccttgagtcatccactgactggtccaagggccattcccaaggaacgcgccccttcactgatccaccctttcaggctaaggagctgccctatctacgcctcagccccacgagacagccccttcaggatttccactggaccttgcccaaatagcaccttaggcactgccctaagctggggtggaaccggaattttggtcaatacatccttttgtctccaagggaagaa

SEQ ID NO: 549386 - DNA, 378 bp, Homo sapiens
  misc_feature (378)..(378): n is a, c, g, or t
gggctgtagggccgcgtgtgacagagctgttgcgcagactgtgttcggactctagataccgcgctcgacggcagctgtgcccagacttttgtgttttcagctgcagtgaaggctcggggctgtagaattgcgaccttgccaatggacctgagacgggtttggttatgcaacccttgtgacatttggaagcatttttggatatatagcggagagagggtggtccgcgtttgaatgcgtggtctttttggtggatgtgttggccgcgtatggagcttacacgggcttcaatgacaaacgagatgtgaaagtgtcactgtgtacaggtttcttcctggctaccatgggtgtgagatttaagaggtccgactgtgttgttgn

SEQ ID NO: 549387 - DNA, 331 bp, Homo sapiens
acccgcctgatcacggcggagggaagtaccttccgtgctccgtcacactccttctctgccggcttcgatgaagacaagccgatcgccatcactggcacttacaacttggactttgacaacattgagcttgtgcataccttgcagaccttggagcctcgtgcatcagacgctaagaatcaggagggcaaagtgcacacacgtaggaagtccacggattccgtacccatctctaagtgtacactgtcccggtcgctcagcctgcaagccagagactctgatggtgcttcttcctcaggcaatcccgaggccgtggcccttcccccgtagtgag

SEQ ID NO: 549388 - DNA, 304 bp, Homo sapiens
cagacgtgtccactcctggactgagagagaccagcattttttaaaatgccagcttttccactgacacaaggggggttttttcagaagtccccactggcactactgctgagggctccaggacagaagtcacctcctctgggagaacatccatccctggcccttctcagtccacaggtttgccagaaatatccacaagaacaatgacaaggctctttgtctcgcccaccatgacagaatcagcagaaatgaccatccccactcaaacaggaccttcttggtctacctcacaagatacccttacctt

SEQ ID NO: 549389 - DNA, 897 bp, Homo sapiens
tatgttctacgagaattcatttaataccagtcctggagttccatgtacgcctgcccataactgacatatcagctattccaatcattgcaacaactgggcctgttaatggaattctgccacaacaaggaattcataaggaaacagatctactaaaatgtattcaaacatattcgtctctttctcgatctcatggccaatgaaccgcatctggacagtcagacacaaccgaagccctactcagtcacaaccagtctttcttggccactaatgaagaaaaatgtgccagcagagcaacagttagagaggccacaagtgaaagaacaggatttaaacatacatgtgcgagatacaaaaacagtgaatggatgtacagaaggccaaaactgtgatccacgacaagctgaaaatgttagcaattcataaaatatttcgttgggagagctcaaggccctggtagcacgcaacaaccgaggattcagaaattcagaggtttgattacagaaatggaggcatgtactatctgtacttccaacagtaacgtggaaccccagatattcgacgttgagatagcactggcatgcgaccattaagaagtgagaatgctcagtgtacgaaggctagttgagaattttgaaccagcaactcagagaacaagcagaaaaatcaagaccatctggtgctgttggatttgcaacctttgaagttgctttctctttcagtccatcgaatatttcactgcgcaattccctgtggggagtcctaaagagcccggaagttactgcgcggtaacagtggcaccctgttccctgtgtctgacacccgcgcgctcacaccacaaatcccttgtctattcaaacacaccctttcatttgaaaaacgcgcttatattggagtcca

SEQ ID NO: 549390 - DNA, 474 bp, Homo sapiens
agtcagcttctgcttagctccatcagatcccaattctctacggagtcgagaattatgaaaactaaagctatctacagctcttaacaattgagtaaagtatactgttaccagaattgggagcatatttgtttctctctacctggtttctccagaatttggaaactatttagtcactgaaaactaagctgtgttttcttaaaaccctgcaaactgaagccagacaacttgaacttcagaagaaaataacagcaacctatttacgtacataagccactttcatacctgcctactaatgtatggacttcagagtaatgtggcttatatcgatttttctaggattgttcttttgtttgttgttgttttttctcccttcctccttgctattttctcttcacagaatgtgagacttcacaacctactaaaaatgagcttttgggacttacccatctaggaataaaccatcatagctatgag

SEQ ID NO: 549391 - DNA, 255 bp, Homo sapiens
tagaagataatattagaaaaaccccttctagacattggcttaggcaaagacttcatggccaagaacccaaaagccaatgccacaaaaacaagaataaatagatggggcttaattaaactacaaagcttctgcccagcaaaagaaataatcagcagagttaacaggcaacctacagagtgggagaaaatcttcccaatctatacatctggcaaagggctattatccagaatcttcaaataactccaatccacaaga

SEQ ID NO: 549392 - DNA, 125 bp, Homo sapiens
gttaaaaaagtatgtacacgttatttttagagtaattatagcaaaattgaatgtgaaagtttggggaatcccatatattacctgtccccgtgcacatgtcatcatgtccccctactttaaatcat

SEQ ID NO: 549393 - DNA, 316 bp, Homo sapiens
catacgaaggactcgctatgttctttacttcagtgtccagaattgccgggaggctgactcgaacattatcagcgatctctgtcgttgtgccgagtccttcattgacatgtctatataaagaagcaagcgcaacatactgatactcagatatttgcttcacctaaagtctgtctcgtgtgcaagacctctagaagggtcaaggagaaggtagttttagcttctctggtgtattgttcagttatgtctgtttttaacagcattatagatgtgccccaattttgaccttacacttcccttcttattatcctctaacacc

SEQ ID NO: 549394 - DNA, 365 bp, Homo sapiens
  misc_feature (231)..(231): n is a, c, g, or t
cagaatctgtttcacacaacaactgctatttgaaggaaaaaaaaaaaaagaagcaaatgataccaagaacaagctcatatacaggagatccaatcagcagtatgtgtacggcttgaaagatacaggtgagatgaggtcagaaaaccgagccaaggaagggctcccagtacttctccagaaaccagtaagttactccgaaactagttcaagcatacacttgcttgcccgccngttcacctttcctctaattccaagaaaggagcatagtggcatcggaaatacagcatctgtaagaagcggctgcttctaccagaagaaagaggaggactggatctgctgcgccttgccagaaagaccagaaacca

SEQ ID NO: 549395 - DNA, 533 bp, Homo sapiens
ccatcggcgcggcacttctctcccggtcactgcaggcgtttgtgcgctactacgtcgaacgcggggagatccgccgttttgtgatcaagtgtcgggtggcgaatcagcacagcaacagcgttgccgtgcgtaacggttttacgctggaagggtgcctgcgggaagcggaatacctgaatggccgctttgacgatgtgaacatctacgggaagatctacgccctataacgctcccagcagcggggtgcgggtgatgcgctggtcgccgttaatcaccttttcgccgcgcaggtgaatgctctccccggcaaaggcttcaatgaccgcatcatctgtgatttcaacccggtgctcaatgagcacatctccgctgatccgcgcgcgttccctggatcaccaccttatcgtccagcatgatcggtccgccgcgcagccatgcctgaccgccaatcagcacgtggtgcttgatgacgcagtttccttccaccacggcattctcggcaatctgagagctgtagcgcaccgtcggaatag

SEQ ID NO: 549396 - DNA, 1145 bp, Homo sapiens
  misc_feature (235)..(235): n is a, c, g, or t
  misc_feature (308)..(309): n is a, c, g, or t
  misc_feature (347)..(348): n is a, c, g, or t
  misc_feature (351)..(351): n is a, c, g, or t
  misc_feature (355)..(356): n is a, c, g, or t
  misc_feature (358)..(358): n is a, c, g, or t
  misc_feature (374)..(375): n is a, c, g, or t
  misc_feature (395)..(395): n is a, c, g, or t
  misc_feature (399)..(399): n is a, c, g, or t
  misc_feature (409)..(410): n is a, c, g, or t
  misc_feature (1140)..(1140): n is a, c, g, or t
ggcgaaagccccggactcgtggagttgtgaacgccgcggactccggagccgcacaaaccagggctcgccatgaagccaggattcagtccccgtgggggtggctttggctggccgaggtgggctttggtgaccgtggtggtcgtgtgaggccgagggggctttgtgctgggggcctgaggtcgaggcggaggctttagaggtcgtggacgaggaggaggtggaggcggcggcggcnggtggaggaggaggaagaggtggtggaggcttccattctggtggcaaccggggtcgtggtcggggcaggaaanngaggaaaccagtcggggaagaatgtgatggtggagccnncantcgnncntgagggtgtcttcatnntgtcgaggaaaggaagatgnactnggtcaccaannaacctggtccctggggaatctagtttatgtgcatgagaatgagagtctcgattctcgcgaaggagtatgacaataattgagtaccgagcctggaaccccttccgcatcaaagctagcagcagccaatcctgggtggtgttggaccagatccagatcaaaccgggggctacggttctctagctcggggttgcctcgggcgagcaggtcttcccagtgctcttgacatcgttggtccggatggtctagtctatgcagtcgagttctcgcacgttctggcgtgactcattaagttgggccaagaagaggaccaagttcattccttgtggatcgcagggttgttcgaaacccataaaaattacgggatgttcatcgaaaggggggatggacaccttgggttgatttgcccagcagaacgaaccggatatgtggccctaaatgcccacttctggggtagggaggcacctcgggtacgttccctttagggccctgggtttgatccccggctcatacgaaggcgcgttgctcccaagtaaaagtgccgcgcaaaatacccacaacgagcctgtgctaataagaccacggcgtgtggatgtgcccccaggatgataaaacatgacgtgagatgtgcgacagcgtcatagcaccaaaaaaaaaggcggtaaaggccctcctagcgtaccatgtcgttgcttgtgttgaatactaccgacgtgaacaagtcgtcactaancgggt

SEQ ID NO: 549397 - DNA, 252 bp, Homo sapiens
agggtagacagtcacggagtatgtgcacggacatgagggggtgtaggggggcaagagatgaaggtgagaggacagccaacagctactgcagtgatccatgtgggaggtagtggtggcatttttttttttttttggaaaaagagtctcgttttctggcccaggttgtagtgcaggggtgcaatctcggctcactgcaaccttttgccttcctaggctcaagcagattcttctgcctcagcctcccgagttagc

SEQ ID NO: 549398 - DNA, 514 bp, Homo sapiens
  misc_feature (120)..(120): n is a, c, g, or t
tgtcggggggagggttttaaaaattttatttgatttttggggggcggggactgaaagatacaccattggactctaaaccaaaaccctgaaagatataaaacaacatgaggcttctttttnaaaaagtaccccacacaccaccagcccttgaaaaattgtgctttataccaaaaccaaaaaccttaagggggcaggcacacaagggtcacgcctggaaaccctattatttgggaggccaagggtgctggaacacctaggcgggagataaaaccaagcttggccaaaaaaattaaatttctttttttattaaaaaaccagaaattccccggcctggggacccctgccctggggtccaatacatggggttgggccgtattccaggacccccgggtacccactagtttagacgggccccacccggaagattttagcttttttccctttgaggaggggaatacccactttgggtaaaaaagggaatccctgggccctgggggaaattttatccccttcg

SEQ ID NO: 549399 - DNA, 909 bp, Homo sapiens
gctgcgcctgcgcgccgctggcctgacggaggggagcctgaccgatgcctgagcgggctgctacgtcccgcggtcggagccgcgtcttctccctggctccgccaccagcctggggcatcggtgtggtggtgcccaggtgtgcccctggtgtgcatggcccatcctgtgagtgctgcatgggctgactggccccaccatccgtgccactgggacggcgtgcgcggagaaggcagggaagaacctacggcagatgagcaaggactaccaacaagtgttgctggacgtcctggcggtcattgcggcggttccctcctggcatgccagaggaacagcgagaagggctccaggaagaactgcttgacatcatcctcctcatcttggagcgcaagcctcagctgcactactaccagggctaccatgacattgtggtcacattatctgctggtggtaggcgagaggctggcaacatccctggtagaaacctcatctacccaccacctcaggcattacatcggatccaacaatggccaacaccaagcatatatgagcctatctgatgcccatcattgaccaggtgactccagagctccatgacttcatgcagagtgctgcggtactggaccatctaaggccctacagctgggtcatcaacctggtaacgggacatgtactgtctgaataccagcacgtcgagcggataaatgactatatcctggacctggcgaccccatgtgtactgcgcgcaatttcaacttcggccggtgcggtgagagtgggcggcaggacatccggcgcgaggaggcgaagatccactgtggagcattgtggacgctgtaggaacggtgggacctcggcgtcccgcccaaaccttgggtggtcacagggaattcccataaggaggagcattgc

SEQ ID NO: 549400 - DNA, 879 bp, Homo sapiens
ggatgggtgtctgcatggttctttgttcatatgcatcagcgccaggggtagccatgcgttgggttatgcattgtttcaagctacctagaggtcaggactgtcctacggacgacccatcctactctacctcacgcactccacccgcctgccagcctccactggtgctaccaccttacctgaggagctgcggagcacatgggtctataaccacagccaccaggccgcatatgagcctgggtctcaccggctcatcacatggccctgcttcctgcttagccaaggctagaggcctgggctgggaaagactttaggaaccagactgcttgcctgtttccgcagggcccactgtggcgctcagagactagggctccagcccctcttggagaagtctcagctaagctcacgtcctgagaaagctcaaaggtttggaaggacgcagaaaatccgttgggccagaagtaccagactagatggacctgcttgcataggagttctcggaggaagcttggagttttgtttcctctgtgtcaaacgctgcaggtgtcccgtaccgccactggtgctaggaagaggacgtggaggtgagtgtcagaccgctggaaggccccaaacggtgtcactcgcctgagctcctcttccatggcctgtgcgccacagggactgggaaggaaggacttgccctgtgtagtttgtgctgtaaagagttgcgtttttgttatatttaatagctgtgggcatgggtgaagaggaggggaagaggcctgtttggcctctctatcctctcttccatcttccccaaagatagagctctcatgctcttgagtagcccatcctggcctagaccagcagacagagccaggagaggctcagctgcattcg

SEQ ID NO: 549401 - DNA, 319 bp, Homo sapiens
caagatcctggtgaacggtggtctgggtgaacggtcagtcttatagaatgtagaagctgtagatggagatgtggtgttggaagtctaagggatgaggtgtgggaaggtgagacacagaagaagcggataaccctgaagatgtgatatgcagactgggaagatgagtgagaagcctttgcatcgcaggagtagggcacaggacatcttcttgagtgacgtctgtgcaggcctgtagtcgcaagggctctgagctgactggccggtgctggatctggtgagcggaccatccctcaatccaaggccatgactcactttgtac

SEQ ID NO: 549402 - DNA, 409 bp, Homo sapiens
agggaaggcagaaacaccgtaggtatcaggcaggcaggccccccctgttttcctccttctgagacagaaagttaaaaatctagttagatctgttcctcaccctgcgaaacaagaggcggccgtatcctggggctcttcccggcagccgtatcctggggctcttcccagcagcggagtgccctccagaccattgtttcatctcccgcactttcgtcatctcaggggaaggagctgtactgaatgatgcagacacaactccctctaactcccactctttgactctgcaaatgggccacccacttcttcatttacatcttcctgagcgttctgtggggaaactcaaattcggataatctgggatcttgctcagctccattgctgagaagtactgtggagcaggctgacgagg

SEQ ID NO: 549403 - DNA, 1091 bp, Homo sapiens
  misc_feature (362)..(362): n is a, c, g, or t
  misc_feature (365)..(365): n is a, c, g, or t
  misc_feature (547)..(547): n is a, c, g, or t
  misc_feature (719)..(719): n is a, c, g, or t
  misc_feature (1091)..(1091): n is a, c, g, or t
tgtgtgaactgctggaagcagggtgcccgtggcagcttcttgcagttcatgcccttcccccccgtttcggaactggttaagggttcaacccatgtccaagccccaaaggggtttttgccattcagggccttaagctgcccttggccccgccaggtggctgtaaagccattgctgcactctgaggggcttggcatggccccagtgggggctggggactggcgcagccccaggcggcctccaagggaagcagtgaggaaagatgaggcatcgtgcctcacatccgctccacatggtgcaagagcctctagcggcttccagttccccgctcctgactcctgacctccaggatgtctcccggtttnttntttcaaaatttcctctccatctgctggcacctgaggagtgtgagcaacctggaccacaagcccagtggtcacccctgtgtgcgcccgccccagcccaggagtagtcttacctctgaggaactttttagatgcaaagtgtgtatatgtgtgtgtgtgtgtgtgtgtgtgtgtgtgtgtgtttntgtgtattttgtaatatgtgagggaaatctaccttcgttcatgtataaataaagctcctcgtggctcccaaaaacaaacaaaaaaacaaaaaaaaaacaaacaaacacttgtgttgcgcgcgcgcgcgcctctcggcgcccctcggaataacacctttctttagaacaccantatccggttgggcgcgcgcgcggggcgcccaaataaggggcatacaggtgagaacactttggcgccaatagcgggtgtgtgtccaataagagaagagactccggggcacattgagacaacaggcggcgggggggtctctctcacaccacataatcaaacaagcgcgcgccgcggggggggaaaacagggccggagagcgcgtttcgcgtgagaaacacaaagatctccagagagagggggacgagtatctggcggagagggctccaatcataacgcgggacaactctatattacacacgagggagagtctcacaaggagagaatctccatatatactacaaaatttttgcgccccccgatcaaaggtgggan

SEQ ID NO: 549404 - DNA, 903 bp, Homo sapiens
  misc_feature (17)..(17): n is a, c, g, or t
  misc_feature (23)..(23): n is a, c, g, or t
  misc_feature (63)..(63): n is a, c, g, or t
  misc_feature (127)..(127): n is a, c, g, or t
  misc_feature (136)..(138): n is a, c, g, or t
  misc_feature (141)..(142): n is a, c, g, or t
  misc_feature (177)..(177): n is a, c, g, or t
  misc_feature (186)..(187): n is a, c, g, or t
  misc_feature (192)..(192): n is a, c, g, or t
  misc_feature (210)..(210): n is a, c, g, or t
  misc_feature (223)..(223): n is a, c, g, or t
  misc_feature (840)..(840): n is a, c, g, or t
  misc_feature (902)..(902): n is a, c, g, or t
gccccgtaagaaagacnatactngggtaatccaacaaagtctcccatctcccaagtaaaatanaagaaaggtgtatcaagtcaaactgaaagtcccatggacattcctgggatgtcccaaaaaaganaagtgcccnnnaannataagggtggtcaacaaaaacacagtggggagganccagacccnntcatngactttttaaaccgacantaagctcttaaanaaaaatcaagcctgaggattcaacgaaagccagctgagaatacaggaaacatgtttccagccaaaccctaaactacttgggatggtctgggccccctgaagctaataccagtcacatcagatttcaaggattctgtgccaagaaaaatactccgtgggatgcaaggcagatgccacttgccacttttcttgtttggggaaaaatcagccatctataagctgtgtcatgcactctcctcctggatgggctcgagaagtgagactctgcttgatattaaactattctgggataagtcgtaactgaaatgttatgaaagtcaataagaactacatatagaaccaactcagaatgagggaaacaacatagaaaaaaggaaggaagcaaggaaagaagcctaaacaaactagtgtctctgagtcttctagccaaagatcatctggatttactaagttttgttaaacatcagaaagtactgttcaggctgggtgcggtggctcatgcctgtaatcccagcactttaggaagccaaggggtgtggatcacttgaggttaggcgtttaagaccagcctagccacatggcaaacctcgtctctactaaaaatacaaaattagccangtgtggtgcatacgcctgtagtcccagctactcaggaggctgagccaggagaataattgaant

SEQ ID NO: 549405 - DNA, 334 bp, Homo sapiens
  misc_feature (43)..(43): n is a, c, g, or t
tgaaggaggtcattgacagagggcagatctcagagtaagttgngggagatgaagtggagatatactgtgacacttccttggagctggagatgggaaatggacatacttagaaatttagtggatttaattagcctggatttccctctccaaaacttttagaatggaaaatcccatccccttccttatatagtgacttctacccactaccttctaccattttctactttgggcttaggatgatgggcattatctacatgtgttttcagcacctggttggttctaaatgggatctggagacccagcttcttggagatttttaagaggaagtattaac

SEQ ID NO: 549406 - DNA, 324 bp, Homo sapiens
tgctatcatcttcaactaaaccagaaaacatcggaccctccccaagaacctgtcagtattatagttccaatcatatataacatggcttcaggatacaacccagcaggcagacatacccaagacagcagaactcttctgtggctgctcccataatggtcagcgacattctgaagaggttagcagagatgaatccaccacgacaaggtgaaatgcacaatatatgcagctgctacgtgatttcactggctaaatcttacactgcccactggtgggcgtccatagacactatagtatatacacccaggaaggctgacagatgagaca

SEQ ID NO: 549407 - DNA, 659 bp, Homo sapiens
tgccttcagtggtttagtgcgggaaggccagggctatgggaggcggcggcgggatgaacctaacgccatgactatcacaccggcaaagatcaataccaccaagaagcgccctcatcgttcattatccaatgcgtttaccctgtatgaccagtcacagatttaggagttcactgaggactgttgcacaattgagcagaacacatgtggcttgatcgacgaggtcgaattgcatgatatgcttgcttctctagtgaagaatgctactcatgcataccttgatgccttgatgaatgagggcccatggtccatcatatgcatcatgcctctgaccatgttagcttataagttaaatggcgcagatcctgaagacgtcattagaatcgacttcgcttgctgtgatgataaggtgacaggtaccattcaggaggattacctatgagagctgctgacaaccatggtcgatcggtttacagatgaagatgcgtatgagcttgacagagaagcacctattggcacactggcgaatttgactctcatcgaagtcacatgcaacctgaacgatgggtctaagacaaagtgaatggaagaacttaggttcctaacttatcataggctactctatttactttttagatatgtcataaccctgatgcctgtcg

SEQ ID NO: 549408 - DNA, 148 bp, Homo sapiens
aaggtggaggacctcttcctgaccatcgccaaaaaggctttctgcctaacaacagctggatatgaacctgcagaggaggacttaacagaccccgtgcgctgtaacatcctatgaaagaaatacaaagctagggtcacgacgcctcgaa

SEQ ID NO: 549409 - DNA, 686 bp, Homo sapiens
attcagagcattattgatttgcactaacagagcaacaagatggctattcaataaactaacattcggttttgagactcggtgagagctgtacacctacaaaaattccttaccgacgagattgcaacagatcgcattatctccaatgtcttaataagggaagagtgacatgatttcacatgtgaggtaatttggattgcgtggatcgcatggcattcaccagatatttacatatcatggttacgcaggcttacgaattaaaggacgtgtatttattactctgatgggcttctgggacatccataacagatgcaacatgcagggatgatgcctcggcctagggataaatgcgcctttttattgtcggtagtgtatccatatgttatcttttacgcgacagaggaggaaactcctgatggtacggcttgttaaagcacatactctcttggaacgagcgcctgatgtcttgccggaacttgatagcattagtctgctgttaaggaaagcataatcgagccccactaggtgctattgacaagtacttgcgatggactatgaccaggcacctaatttgtggcaggatcccagggatatgggtgcttctttaggaattgctgtttagacctgggaatttcacaaagtaactgtccacctttaattaggccggaaagccctgtacaaatttttgg

SEQ ID NO: 549410 - DNA, 103 bp, Homo sapiens
ttaaatatactgccttacctccacttttgacgttgactttttgcttactggtgacacgactacaacgtcttgttttaacttactttcgcatgtggactgtcac

SEQ ID NO: 549411 - DNA, 1041 bp, Homo sapiens
gagccaggtgtcagtgccggacgtgcctggagcagcggattgggagggcagaggtggtagcctttgactaccaatccaaaatgctggcatttaaaatgtccctcttccagtggaaagcccaaccatgcagcacatctgctcataaactatacagtatgtgatcagaagtggaacataattcatagaccgaacagaaaccccatcctccctttagcattcactcaatgtaaagataagcttgccagcacaagcacggcacagagaaggaggagaagctgagccaggcctatgcactcagtgactggtgtctactctagagggccagcagctacttccagaccattcacaagaccattaaaagactgtacaatggcaagacaaaaaacatcgtagatcatggaagaagtagtaatcacacccccatatccagtggaaaactgtccaaggcaaagagcgggacatgcactgagccatgtacgcacaactacgtgcacaaacattcaagacgacgtggaaagccaaacgatactgcaacgataacacaacgcccagcaaccacacgaaggagcgatgaccatgacaatcctgaatacagaaacaatggaaggacacatacagcaatccacgacaacggaagcagcatgaggagggaaacagcaacacacaggaccaaaggaagcacagcatcaaaatgaccagaaggaactacaaccagatcagcaaaccaccattacacaaaacaaacacaaaaccaaaaacaaaaccacaacacaaccaaacaccccacactacttgaccaaaaattaaacaaaaagaccttacaaaacacaatataacacaccataaaaaacacagaaaaaacaccaatgacctaaaaaaaacaaacaaaagcacacaaggaacaacggcacaaggaaagacagtaaataaacaaagaaaacaagagaaacgagaacgaaagaacaaaagaaaagacgaacccagagaaagaaaagaaaaagaacatcagcgatccagacaaaacaaagagaacaaaagaag

SEQ ID NO: 549412 - DNA, 120 bp, Homo sapiens
tcttgcattctgtgacagccatgtctgtgacttgcacgtactcccctgccctcaacaagatgtatttgccaactggacaagacctgcgcctgtgcagcttgtgggtatgattccacaccc

SEQ ID NO: 549413 - DNA, 206 bp, Homo sapiens
tttttttatgggcagggacacccccccccagggtttggggtttgagcccaggacattctcctgccccttggtccccttgggtgtggggtgtgaacattccggggccctggggattttttttaggtccgggcagcccaaggggtagccctttttattgttacatgttgcccccccccagccttaaataaaaaggttcctgttgttga

SEQ ID NO: 549414 - DNA, 828 bp, Homo sapiens
  misc_feature (339)..(339): n is a, c, g, or t
  misc_feature (356)..(356): n is a, c, g, or t
  misc_feature (378)..(379): n is a, c, g, or t
  misc_feature (392)..(392): n is a, c, g, or t
  misc_feature (394)..(395): n is a, c, g, or t
  misc_feature (406)..(407): n is a, c, g, or t
  misc_feature (419)..(420): n is a, c, g, or t
  misc_feature (458)..(458): n is a, c, g, or t
  misc_feature (581)..(581): n is a, c, g, or t
  misc_feature (583)..(584): n is a, c, g, or t
  misc_feature (607)..(607): n is a, c, g, or t
gtagcggtgtagctgcgcagcgtcgcgcgcgctacggacccaggttcgggccgtaagcgtctggcagcccggcgcccatcttcattcgagcgccatggcctgcagcctggcgggccggggagcggccgggtaactggttgctcctctggcttgcattttgttttcttggtgaaccgcggtgccctggtcctggggcgtggagacgaaccctgtacagacatgtttgcttgcgtggactgtaacaacgctccttaacacctctcacttatagacccgcttattaccaacctttacccgcagtgcttgggatcccccatccccactatgttgacaattgtngttctggacgtgcaccngactgagtatgtagacttctanntatataccccaanannaggtcatacanngttgtccagacnnacaaacgtgcttggtgacttggggttattgacttgttnacaggtgtgtgacattggtaacgcaccggcagcgttagcattatttgcgattacgaaaacttttggcaacaaacactggtgtgttgaaagctggtgtaagtgcgtactgcaggtcccttctgnannagaaccaagtattgtaactcaangaagaggttctatggtagggctttgggaggtatacactcttacgcatttattacatgacactttgtgggcttggccaggctgtgacaggaggtcctgggacaaggccagccacgggcgttttgggcgtctatttcctcctgactgtattactatatggtgtggccctcgcgcagggattccctggttacactgaggtggagttggagtcaccagtggtgtt

SEQ ID NO: 549415 - DNA, 182 bp, Homo sapiens
agaaagaatgggaaacctttgcaattcacagattcgcagttcctggtttcaaacacttgccttgatgtatgttacttatacttctcagttaaaacctctaccttcggggctagcactgtatgttcaattatatgcattctttacctttccttatcgtctctttttattactgcacaacaatt

SEQ ID NO: 549416 - DNA, 260 bp, Homo sapiens
taagatcctctacgagctagctctcagctctgccagagtcctgagcatcggcactatcacgcaccacagtgcctgctgccagggcgctcgcactacctagcgcgagcatgcagccagtgcagtggtacacgcgctgggcgaccctccttcagctgtctgtcgcgcgcagacctcccaccagacgagcagaagctatgtgctactccagccacttcagactgccgtgcagccgagatcttccccaagctggtgcccccgcc

SEQ ID NO: 549417 - DNA, 121 bp, Homo sapiens
tggagcatggctaggggatttaaaacaacacatacctgtcactgctgggagtcaaactttataaaaagccttaagtggaaggtgtcccaaacggaaactctgagttaatagaggagttaga

SEQ ID NO: 549418 - DNA, 466 bp, Homo sapiens
  misc_feature (65)..(65): n is a, c, g, or t
agttcttcattgatagccatttagattgtttcaaatctcttactattacacataattttgcaatntggcacatatatccttttgcatttcctgatgaatattcaatggtgtgctaagatgggtttgtgacagccatttgtgaaaagttcaggaattctgatatcagttgatgttaggacagtagcttgaaattggtgtggtggaactacttacaccactaaaattggcaaagtctacaaataaaaggcttccattacccttttttgtggggcgaattgattgttaagtatttacagttcccactgaataccttcccagtagtagaattgctgggtcaaagggtatgtgaatgtgcaatgtttttatataatatatatatatatatctccaaattgcccctcatttattttatttagttacataaaaagctttgaataatctgcattgcaaaaaaaataacaaattt

SEQ ID NO: 549419 - DNA, 235 bp, Homo sapiens
aggggggggggggggggacccaaccccctttgccccactctttttaaggttcccttattttttttttaaccccttttgatttttggccttggggttggggaataaaatgaaaaaactaagccccaaaaaaactgggtttccaaaaggccaaaccccccccctttgtttcagaagggggtgggcctttcccccgggcccgattccaataataaggtaatttttggggaaagggtta

SEQ ID NO: 549420 - DNA, 346 bp, Homo sapiens
cgtcgacgtttctgatcattaggaagacatgtgtggcgtacagtgtgttccaggtgaacgtccccaacaggaagtactgcagcaggactgccactgcagtacagggccctctgtcctgctctgtgtgtgtgtcggacggggggagaatgttgtcctcctgtattttaggtttgccttttttttttttttttttttttttttttttttttttaaccactgtaaatttattatgcattaggaagcttaacctaaaaaccaatagcatagtaaaaagatattttgaaacctgttctgctatgaacagagataacatatcttttgtcgacgcggccgcgaatttagtagt

SEQ ID NO: 549421 - DNA, 780 bp, Homo sapiens
taccacatatcctgcttatatgagaattttaaaggtatttgactacatttaagggggatccaggactgccgggtgatatgggaaagaaaggagaaatggggcaacctggcccacctggacatttggggcctgctggacctgagggagcccctggaagtcctggaagtcctggcctcccaggtaaggcttgagtttacaattctaaaagctggaagcattactcagagtatagccctccccaaatcattgtggtaaacagaaagctatttatacttttatgctgcagttgcttttattcaactttgaacttcaaattctaacacactaagagaattcattaagagagcccaattttactaatcagcccatttggactgaaatacaaaaatatgttcctataaaaaacacttttgaagaactgcctcaacaaattcagcccaaggatacaaaatgttagccgatatacaatcataatgtttgtattactttgtccaggcttccatagtgaattccacagactaggtggcttaaactacacttgatgttagccaaaaggctgagaagcgattaggtggcttaaactacagatgtttattttctcacagttccagcagctccgagtctgtgatcaagctgtcggcagcgttggtttcttgtggggcccctgttcttggcttgtggatggctatcttcttccagtgttttccaagtgtctgaatcttcttttcttataaagacaccactcacattggattagggccaccctactgacctcatttt

SEQ ID NO: 549422 - DNA, 132 bp, Homo sapiens
tagagtaccccggtcatccgctacacacacacacacacacatatgaatatttaattaactggagataatgttaaagcaaggtctctacaatttttccattaggttgtgcttcaaatagtctataataaggac

SEQ ID NO: 549423 - DNA, 217 bp, Homo sapiens
ttttttttttttggggaaatggggtttcgttctgtggcccaggttggggtaaaggggggcaatttcggttaattaaaagttcccccccccggttcaaaagaattttcctgccccagcccccaatttagttgggattaaaggaaccccccaccacgccccgttattttttgggtttttttaggagagcccgtttcgaggggccgttcgaaaattattt

SEQ ID NO: 549424 - DNA, 157 bp, Homo sapiens
cgtggggagcggaatgaagcgaacagattttcgttcatttaggttctcaggattcgtccatagattttttattatccatcgggctttggctgagtggcaggtagtgtggtatgttagctgtttaatactgtttatgttggggcctgagctatagcat

SEQ ID NO: 549425 - DNA, 170 bp, Homo sapiens
tatgtattgatgtaaatgaggggcatgggtaaatatgattatcataatctaatgagtcgaaatcattcgttaagttaagactatataccaattcagtctcagatctaatgctttatgtagtcactcatagggcagacttagggctaggatgatgattattaagagggatg

SEQ ID NO: 549426 - DNA, 765 bp, Homo sapiens
  misc_feature (239)..(239): n is a, c, g, or t
  misc_feature (271)..(271): n is a, c, g, or t
  misc_feature (285)..(285): n is a, c, g, or t
  misc_feature (294)..(294): n is a, c, g, or t
  misc_feature (364)..(365): n is a, c, g, or t
  misc_feature (370)..(370): n is a, c, g, or t
  misc_feature (375)..(377): n is a, c, g, or t
  misc_feature (382)..(382): n is a, c, g, or t
  misc_feature (416)..(416): n is a, c, g, or t
  misc_feature (433)..(433): n is a, c, g, or t
aaccaagcaggagacgacaggcgagagaggagccagacagaccctgaaaagaaggacgggttggggccgggcacattgggggtcaccggccgatggagacaccaaccgacaggccctggctgagggcagctgcgcgggcttatttattaacaggataacccttgaatgtagcagccccgggagggcggcacaggtcgggcgcaggattcagccggagggaagggacggggaagccgagntccagagcaacgaccagggccgaggaggtgcntggagtgccccccngggagacanaccccaccatccagcagcccagcctgttcacagctttctgctcactgctcactacccaaggaggtggggnnaggcnggccnnntgtantaaataacgcaataaacgcattatcagccaaagntggaatggccccagcanaaaaaaaagaaaaaaaaaaaaaaaaaaacaaattttggcaccgcaataggagccactgagaaaaggctacataagccacaagaagagacgaccggggcaccccacaagggacagccgaaacgggggcacaagagacggaccacaggggagcccgcgggaacagaaacgagggggagaggggaaatcgccaccgaataaaaacgaaggcctcgcggggacagcacggacgaacgatcccacaccacaatcacaggaggacgtagaaggggaagaaaacggagacgcacagcaccagaggagacacacacgagagagcaaatagaaaataaggc

SEQ ID NO: 549427 - DNA, 199 bp, Homo sapiens
agcgggcacaatcatttaagttaaaaaaaaaaggtaaagcagtatgtataataggcctttggttggggttacaaatatgtatatatataggccagacgggggggctcacgccggtaatcccagcgacttgggtgaggccaagggggggcgggatcaccgagaggccagagagttcgagaaccagccgtgaccaagtatg

SEQ ID NO: 549428 - DNA, 195 bp, Homo sapiens
  misc_feature (25)..(25): n is a, c, g, or t
  misc_feature (78)..(78): n is a, c, g, or t
  misc_feature (115)..(115): n is a, c, g, or t
  misc_feature (145)..(145): n is a, c, g, or t
  misc_feature (159)..(159): n is a, c, g, or t
ggcgctggaggcttatctttgccgncgctgccgtcgacttcctgggattggagtctcgagctttcttcgttcgttcgncggcgggcttcgcgcccttctcgcgcctcggggctgngaggctggggaaggggttggagggggctgntgatcgccgcgtcnaagttgcgctcggggcggtcatgttggccggcgagg

SEQ ID NO: 549429 - DNA, 763 bp, Homo sapiens
  misc_feature (239)..(239): n is a, c, g, or t
  misc_feature (271)..(271): n is a, c, g, or t
  misc_feature (285)..(285): n is a, c, g, or t
  misc_feature (294)..(294): n is a, c, g, or t
  misc_feature (362)..(363): n is a, c, g, or t
  misc_feature (368)..(368): n is a, c, g, or t
  misc_feature (373)..(375): n is a, c, g, or t
  misc_feature (380)..(380): n is a, c, g, or t
  misc_feature (414)..(414): n is a, c, g, or t
  misc_feature (431)..(431): n is a, c, g, or t
aaccaagcaggagacgacaggcgagagaggagccagacagaccctgaaaagaaggacgggttggggccgggcacattgggggtcaccggccgatggagacaccaaccgacaggccctggctgagggcagctgcgcgggcttatttattaacaggataacccttgaatgtagcagccccgggagggcggcacaggtcgggcgcaggattcagccggagggaagggacggggaagccgagntccagagcaacgaccagggccgaggaggtgcntggagtgccccccngggagacanacccccctccttgggtgatgaaccatgaaccaaaaattgtgaaacggttgggttgttggaggtggggnnaggcnggccnnntgtantaaataacgcaataaacgcattatcagccaaagntggaatggccccagcanaaaaaaaagaaaaaaaaaaaaaaaaaaacaaattttggcaccgcaataggagccactgagaaaaggctacataagccacaagaagagacgaccggggcaccccacaagggacagccgaaacgggggcacaagagacggaccacaggggagcccgcgggaacagaaacgagggggagaggggaaatcgccaccgaataaaaacgaaggcctcgcggggacagcacggacgaacgatcccacaccacaatcacaggaggacgtagaaggggaagaaaacggagacgcacagcaccagaggagacacacacgagagagcaaatagaaaataaggc

SEQ ID NO: 549430 - DNA, 102 bp, Homo sapiens
  misc_feature (41)..(41): n is a, c, g, or t
cttatcaagctgcagactgaggaaggtcagcgacacaaganccgggagtgaaacgaacaggctggggtggccctggggttaagagcccacagtccactttgc

SEQ ID NO: 549431 - DNA, 294 bp, Homo sapiens
ctcgagagccctgggggggactagggcgggatttacaataagtaacaaagaatttttacttgaggtgactactgcagccgtcaaagggtgaatatcatatgcaagagtggttcatttacaggctacggaattaaaagctatacaactagcgaacctgaaaactgctacaaatacagctcaaaacttgacactaaagacaaacattttctgtaggacgcaatacctaacctctatcaatagagactctccgttagaatcaaaacagaaaaaaataccacaattccactcttagaa

SEQ ID NO: 549432 - DNA, 419 bp, Homo sapiens
cgtggacatgatggcttcatccgcaacatgttcgtcatcgcccatcgtggaccatggcaagtccaggctgatgtatctgccctggtgtgcgtggcgcgacgtcatcgcctcgcgcccgggccgcgctaggacgcgcttcactgatatccggacacgtgacgaccgggaccgttgcatcaccatcaaggtaacctggcatcgtccctcttctaccaggtctctctggacaatctgactctgaactgtcatcaagctcagctaggacggctgccggcttcctcttcaacctcattgactcccccgggcatgtcgacttctccctcggaggtgattgttgccccccgaggtaccgatggcgcctcgttggtggtggacgtggtgtccggcgtgtgcgtgcggacggagacagtgctgcggta

SEQ ID NO: 549433 - DNA, 94 bp, Homo sapiens
  misc_feature (7)..(7): n is a, c, g, or t
  misc_feature (62)..(62): n is a, c, g, or t
acccccngggcgcttgagaccaaaattctaactatttgttgaatttatttttccgtcagttntgtaaaataaacatactcttcttcctcccctc

SEQ ID NO: 549434 - DNA, 247 bp, Homo sapiens
agtgctacctccacaacaggttcacaccattctcctgtccgtcagcctcttcaatgtagactgggactactggtcgcccgccaccatgccgtggctagtttcttttttaaaactatattagcacagagaataccatgttgtttcagggaagggctaatgtcactaacagactatcacagaagccagactgaaatttccatggggaaaaacaagatttagcttccttgctgtttgtggaggtagcact

SEQ ID NO: 549435 - DNA, 806 bp, Homo sapiens
  misc_feature (506)..(506): n is a, c, g, or t
  misc_feature (725)..(725): n is a, c, g, or t
cttctgacccaccaatgaatttctgttagccttcaactttaaccctaaaagtaattctctgctgttcacatgatatgaagattcagacaaagaaacagcaaagattttgttcatatagtggagatggttcgaataaaaaaattcttcctgtgatagaacatttttcttttttcaagctcttgaaacaataataccatttcctaaagtagcaaacttagatgatgtgtaaatctcttatttgtatctagacaaacaaagatagcttccctttcttttggtacaaatattttcatctctaatcttattgtgcttttgataaccaggctgacttactatgggaggatagtttgtcactctgaacccagcatacagagcttcatgtgagatagtgtccttgaccttggcctcactagtactcccatcaggctttcttaccagactgcctgagtgtattaacttgaatatttggttgaacattgtattaactttaatgtaataactgcctngtgggtcagcattcaagtagtgtggttgtttaatgctgtatacttagctgtttttctagaaaacacagatcatcagcagttctaattgtacatactcatcaactcagacattccacttgtaaggaatttatcctacagtcttatttgttggaaataagtataggatcatcatcatcattataagtgacataattcaaagacctgatcatctgtaaaaanaaaaactgaaaattcaagaagactgggttccttgaaaggctttaactatttcttgcaggggatgattttccaaggcaaaat

SEQ ID NO: 549436 - DNA, 140 bp, Homo sapiens
acatcgctcaccatccctacgcattctttacatacagacgaggctctacgatccctcccttaccatcaagatcaagttggccaccaatggtactgaacctactgatatacaccgacgtacggcgtgactaagtcttacaa

SEQ ID NO: 549437 - DNA, 911 bp, Homo sapiens
cgaaatggctatgtgggagaaataggggttgggccgggttggtcgttaatggggcacaaaagcgtgcggatgcgcgcgggcgtattggccggaaagggcagaagaagggtccctgcaaaaaaggctcgggaagggcaacgacaaaagggccatgatgatgaactggccaggggacgttgggccaccaaaggtaagcgaataaccgccgcaggggcgtccacctcaacctggtcgacaaactagacccagtttttggcattggtcggagctgccgataaggcgagaacttgtgaaaaggggctgttaaaaggaggataagccaaagagggtttgtgttgttgtggtctggtgtaaagaagatgtttgtgggtggagaagtgggttgcgaagtggttgaaaggtgtggtgggttgagtgggtggaaggggttttgggtggcgagaagcttaaggcgccgcttgagattgtgtaagtgggatttggggctcgattggggtgtagtgcagtttgctcaggggcgttagcgcttattggggtttctgattttatgttgtatgatttggtcacttatacgtagcttccaagtaggttaacgtggaaataagtgctcaccacacacttatatgatttattaaaggaagtgacttttgttgtgtatcaatagtggtgaagttattgttttcattttcctcctaataatgtttctcttttgttaacttatttatatgtttcgagaacatctgagccatagtcttaaatttaaatgctaaaaacaattgtatcatgtagtcgggcagcctactttgataggctgtcaggggaagaaatgggtcagaactcagcatctgtcatgaaagaataatcagagttgaaaaacaggcagattttgaattaattgcaatcaataatgg

SEQ ID NO: 549438 - DNA, 115 bp, Homo sapiens
ggtcgacccagggccggggtcttgggggtatagtggctgcaaagggcatcccggaacgtgatgcgctggcgcacggacagcctccacatgacaaggacatgttccggggccctat

SEQ ID NO: 549439 - DNA, 100 bp, Homo sapiens
tagaggatcccaaacacgcatctgtgacagcacattctcagcattcaatgatgacctctagatatgcagcagcatttttatctgctctgtcatttggcta

SEQ ID NO: 549440 - DNA, 981 bp, Homo sapiens
  misc_feature (743)..(743): n is a, c, g, or t
  misc_feature (757)..(757): n is a, c, g, or t
  misc_feature (789)..(789): n is a, c, g, or t
agcgggctagcggggttctcctagcagcgcgggccggtcggaccgccaaggcagccggcgctggcgatgggaagcggcgtggccgccgacacaggcagtggcaaagtttcccagacgtacacatctggacgcgcggctgccggctacccgtgacccctctaggaagggttcagggatttttaatttggaaaaaaatccacctggtttcctttgtcaaggtctctccgggtggccagcggcaggagctgcaaacttgggcacggcggctacaccggcagcggaccgggctttggagaacctcgggactcaggtgctgaggtgcccagcggctccggacgtgctacggggtgcgagcgcgggggagttcggggcgcacgacaaggaagggcccccgggagctctatatggaggaaggagcccagaatggtgtgcaccaggaagaccaaaactttggtgtccacttgcgtgatcctgagcggcatgactaacatcatctgcctgctctacgtgggctgggtcaccaactacatcgccagcgtgtatgtgcgggggcaggagccggcgcccgacaagaagctggaggaagacaaaggggacactctgaagattattgagcggctggaccacctggagaatgtcatcaagcagcacattcaagaggctcctgccaagcctgaggaggcagaggccgagcccttcacagactcctctctgtttgcacacactggggccaggagctcagncccgaaggccggcngcgtggccctgaagcaattccagtactacggntacaacgcctactcagcgaccggctgccctggaccggccctgcctgacctcagaaccagaggggtgacgaaactctcatagctggacagctgcagaagtgacatcgaggacacgacgaaatgagcggtcaggcaggagggatacatcaacggcacggaaggggcccaagaaggcacgaaaccagggagacca

SEQ ID NO: 549441 - DNA, 865 bp, Homo sapiens
gctcctcttggcgctgtcctgtgtaatggcgggcagtatccgcggatgggattgcagataagcgattcccgcacggggaaagtctaccctgcctgcgcagtttctgctcgccgtgagtgccggaggtcggcagttatgtcatgtaggtacgcgggccaagtcgctcgctagaccggtgtggacccgaggggtggtcgctcagtttctggtctaacaagtagcatcacgagcacgacgagaggtgctcacttgctagcctggagcggtcaccatcaatctgtgaccctctttaccaattatactttggtacaaaagagcgcctctacgagaaggacaggtctgtggcagatcagatttcgagtgcatgagggaagaattgataataatggggatgaggaggagtgtagaaggggtgcctgagtgtgcatgatgcacaggataatcccatgtgttgatgtgtgcagatggtgaacaattttctgtcaacactactcgtggtggtgaactttaagccaggagaagatgagtcgaagggctagaagcttaatgagagagatatgggtcgtaaggatggagtgtgccagaagtgggtcagttgacgattgcttggtggcttggggggagaccgagttttggaagcgtggtcaggatccaaataatgcctgggatattaagaaaggcaaggacattaggaaggtgggttgggccagtcggaaaaagctgtgtgggggcctaaagttaagtggtgttggcccctgttttggattggtttccaggcgcggggttggccacatttagatcccagggggaaaggtaaatttaaacgagtctggggggagaaaacagggggtggaggagtacggag

SEQ ID NO: 549442 - DNA, 361 bp, Homo sapiens
ccacgaaaaaaagacaggacagaggcttcacgcagaatactaacaaacttaaaaaaagaactaatacataatacatcactcaaactattacagaaaatagaaagggagaggatacttcacaaactctacgaggccagcattaccctgacaccaaaaccagacagggacacaacaaaaaaaagagcactatggccagtatccctaataaatacagatgcaaaaaccctcaacaaaaacaccagcaaaccaaatccaacaacacgttaaaaagattattcaccatgatcaagttagatttatcacaggtatgcaaggatggttcaatatatgcaaatcaataaatgtgatacatcgtatcaac

SEQ ID NO: 549443 - DNA, 1401 bp, Homo sapiens
ggcacgaggcttttgtggactggttgactatacctttgtggactcggtgaatatacttctgcggaccgggtgaccgtgcttctgtggaatgggtgaatatacttctgcggaccaggtgactatgcttctgtcaaccaggtgaatatacttctgtggaccgggtgactgtacttctgtggaccgggtgaatatacttctgtggaccgggtgaatatacttctgtggactgggtgactagggaggagccggcgtgttagcgccagcatatgcagtccctcaggacagccagcctgccgtgatcctgtctgtgtggtcgtggcagtggcctgcagcaagccatcgtggttggctggaactagacgtgtgatttgaatgcaggagttcagtcagcccctcagtggcctaaaaggaagaaggtgtcagtcacagggctggttctgggccctgccttggggggaccccagttccagggttctgggccctgccttcgggggacccgagttccagggtcctgggccctgccttcgggggacccgagttccagggtcctgggccctgcctttgggggacccgagttccaggtcccggcctcagcgttgcagtggccagggtcagtggctctttggccctctaggagtgagcagaccttagtgaaatagatccacagggtcctgactttgtacctggtccaagctgttggggaattgctgctgttgacccaggcaggagtctgactagagaacaaactaaggttgctgcaacaaacaaggacctcttccaagaagggctcccaggcctggcgcagtgactcatgcctgtgatcccagcacttgggaggccgaggcgggtggatcatttgaggccaggagttcgagaccagcttggccaacgtgatgagaccccgtctctattaagaatacagaaattagccaggcgtggtggcgcctgtggtcccagctactcaggaggttgaggcgggagaattgttgagcccgggaggcggaggttgcagtgagccaagatagcaccactgcactgcagcctgggtgacagagcgagactccatctcaaaagaagggctcctgtgtctacgtcatggtggggctagagagaggtccccgcagctgggctgtgttgagtgagggctcgtctcttcagcgccaggcaatagtttgtcttgtctctgtcccttttctgtgtccacatgacatttacatcttgcgagttgcataatttaagttgtttatttacattatacatttaattgcattctatagcgatgctatgttgaatgtattctgatcggatcgtttatggttatttacaatgcagttactcttgaagattattgttagaggtagactgttgatttgttttgataaaataaagcttttgtgtttt

SEQ ID NO: 549444 - DNA, 840 bp, Homo sapiens
gactgactctcttttcggatcagcctgcctgcaccaaggtgaaataaacagccttgttgctcacacaaagcctgtttggtggtctcttcacacggacgtgagtgaaatttggtgctgtgactcggatcaggggacctccctcgggagatcaatcctctgtcctcctgctctttactccatgagagagatccacctacgacctcgggtcctcagaccaaccagcccaaggaacatctcaccaattttaaatcggatcatccgacctctcccctcctccccaggctgctcatcgccaggctgagccaggtccaattcttcctcagcctccgctcctccaccctataatccttcgatcacctcccatcctcacacccagtctgtcttacagtttggatccaagactagctcttctccagctgcccaacaatttcctcttagagagtggctggagctgaaggcacagtcagggtacatgtgcctttttctctttcagacctctctcagatcagtcagcactcagaccctactgaatatatacaggaattccaatatctaaactctgtcctacaatttaacctggagtgacttaaatgtcatctaaacttctacctctcccagattcacaggaaattttctctggcccatctcacatgacaaccgtggtcctgaacagactcaaggaaggattgcgcagtcccggagatcccatggacttcagccgatcccaagtaccagggaataaaggtcggcataaggataaggcgttaaaaggtttttgaactgaatcccggagaaatccctagttgtttggaccttttccaaaaggttgttaatataccc

SEQ ID NO: 549445 - DNA, 523 bp, Homo sapiens
  misc_feature (162)..(162): n is a, c, g, or t
  misc_feature (349)..(349): n is a, c, g, or t
tacaaaggccccctgggctcggtgttaattgtccaaggaggtggccccccccctctgtggggccattattctgggcaaacttccctcggtccccggggcccggggggtttggggaacaaagttggccaaccccccactgtccctttcaaggggacaggcccntttgggtttttggttgggagccttatccccgcacccaaggggaaaggggtggtttccgcccctttggcttaaaaaatggtccagatgggtgggatacaatattggtgcccccccaaccgggggggccctgcccccctgggggaatttgccaaggccccctttttttcccttttttaaaccaacaggnccctggccccccgcctttggaagggggctggtttcccccaggttccccttccgggggtcccggtcccccctttttaaaccccccccaaagttttcggggatcgggatcaggggcccacttggggtccaaccaaggggttttttccccaaaaaataaaattaatttagcgtgcca

SEQ ID NO: 549446 - DNA, 1424 bp, Homo sapiens
ggcacgaggcttttgtggactggttgactatacctttgtggactcggtgaatatacttctgcggaccgggtgaccgtgcttctgtggaatgggtgaatatacttctgcggaccaggtgactatgcttctgtcaaccaggtgaatatacttctgtggaccgggtgactgtacttctgtggaccgggtgaatatacttctgtggaccgggtgaatatacttctgtggaccgggtgaatatacttctgtggactgggtgactagggaggagccggcgtgttagcgccagcatatgcagtccctcaggacagccagcctgccgtgatcctgtctgtgtggtcgtggcagtggcctgcagcaagccatcgtggttggctggaactagacgtgtgatttgaatgcaggagttcagtcagcccctcagtggcctaaaaggaagaaggtgtcagtcacagggctggttctgggccctgccttggggggaccccagttccagggttctgggccctgccttcgggggacccgagttccagggtcctgggccctgccttcgggggacccgagttccagggtcctgggccctgcctttgggggacccgagttccaggtcccggcctcagcgttgcagtggccagggtcagtggctctttggccctctaggagtgagcagaccttagtgaaatagatccacagggtcctgactttgtacctggtccaagctgttggggaattgctgctgttgacccaggcaggagtctgactagagaacaaactaaggttgctgcaacaaacaaggacctcttccaagaagggctcccaggcctggcgcagtgactcatgcctgtgatcccagcacttgggaggccgaggcgggtggatcatttgaggccaggagttcgagaccagcttggccaacgtgatgagaccccgtctctattaagaatacagaaattagccaggcgtggtggcgcctgtggtcccagctactcaggaggttgaggcgggagaattgttgagcccgggaggcggaggttgcagtgagccaagatagcaccactgcactgcagcctgggtgacagagcgagactccatctcaaaagaagggctcctgtgtctacgtcatggtggggctagagagaggtccccgcagctgggctgtgttgagtgagggctcgtctcttcagcgccaggcaatagtttgtcttgtctctgtcccttttctgtgtccacatgacatttacatcttgcgagttgcataatttaagttgtttatttacattatacatttaattgcattctatagcgatgctatgttgaatgtattctgatcggatcgtttatggttatttacaatgcagttactcttgaagattattgttagaggtagactgttgatttgttttgataaaataaagcttttgtgtttt

SEQ ID NO: 549447 - DNA, 271 bp, Homo sapiens
accagtatctctgtctacttccaggatcaggagttagtggtgcaagaagccatttagggcagcaaaacaagtagacatgaagggagggtccctgtgtgtgtgtgtgctgatagttacctggagtgccctaggctcctatgcaagcagggactggagcctgcagagacccaaggactcactagcagacgcgactcctagacccctaccctgacagggagctaacgttaagacagacccagacacactagcttgacctaaataggctttacac

SEQ ID NO: 549448 - DNA, 763 bp, Homo sapiens
  misc_feature (312)..(312): n is a, c, g, or t
  misc_feature (598)..(598): n is a, c, g, or t
gtgggcgcctgtagtcccagctactcgggaggctgaggcaggagaatggcgtgaacccaggaggcggagcttgcagtgagccgagattgcaccactgcactccagcctgggcgacagagcaagactctgtctcaaaaaaaaagccaggcatggtgtatttggactgtggtcctgggagatggaggctgcagtgacctgacatcacactgctgcattctagtctgggcaacagagtgagaccctatctcaaaaaattaaaaagttaggtgaggctgggtgctgtttacacctgtaatcccagcactttgtggngctgaggcaggcagattgcttgaggtcaggggttccagaccagcctggccaacatggcaaaaccctgtctctactgaaaatacaaaaattagctggtcgtggtggctcacgcttgtaatctcagctacctgggaggctgaggcaggagaatcacttgaacccaggaggcagaggttgcagtgagccaagatcacaacactgcacttcagcctgtgcgacagagtgagaccccatcttaaaaaaactcaaataaaaactcgagactagttctccaagcatgtggctnccggtcagcggaattctaaactcacggatattctctgttgggggagagccacattttgtgatttccaaaattaaccaggaattctaattgatgagtataggccatttccccaggttcctaccggggaaagtttcaaatcctccgtggttcttcggggctccttcc

SEQ ID NO: 549449 - DNA, 838 bp, Homo sapiens
  misc_feature (8)..(8): n is a, c, g, or t
  misc_feature (118)..(118): n is a, c, g, or t
  misc_feature (155)..(155): n is a, c, g, or t
  misc_feature (181)..(181): n is a, c, g, or t
  misc_feature (196)..(196): n is a, c, g, or t
  misc_feature (207)..(207): n is a, c, g, or t
  misc_feature (210)..(210): n is a, c, g, or t
  misc_feature (227)..(227): n is a, c, g, or t
  misc_feature (242)..(242): n is a, c, g, or t
  misc_feature (267)..(267): n is a, c, g, or t
  misc_feature (337)..(337): n is a, c, g, or t
  misc_feature (339)..(339): n is a, c, g, or t
  misc_feature (342)..(342): n is a, c, g, or t
  misc_feature (344)..(344): n is a, c, g, or t
  misc_feature (386)..(386): n is a, c, g, or t
  misc_feature (427)..(427): n is a, c, g, or t
  misc_feature (430)..(430): n is a, c, g, or t
  misc_feature (459)..(459): n is a, c, g, or t
  misc_feature (472)..(472): n is a, c, g, or t
  misc_feature (479)..(479): n is a, c, g, or t
  misc_feature (494)..(494): n is a, c, g, or t
  misc_feature (504)..(504): n is a, c, g, or t
  misc_feature (514)..(514): n is a, c, g, or t
  misc_feature (566)..(566): n is a, c, g, or t
  misc_feature (668)..(668): n is a, c, g, or t
  misc_feature (835)..(835): n is a, c, g, or t
tgcaaaangcagtgtaccttaaaaatgtctcacctagaaggcctctacctgtaatcacattaatttttctaaaaacaatttggtgttttgaagataaatgtcattagtctatgataanagcatcataggacaattagccattttagacttgaccntattttctctttttagcatatagccntcttgatatttaggngggggactacnccnatggggccacagtttcnttttacatgattggntttagaaatttacaaattttaaacncctaagaattctaaataatttgaaaatggaaacatttgcccccccgtctcgccgcctaaatccctttttnanatncntccttgttgatcttaggtccttgatttaaaaccgaatttggngcctttgggccgggggggggggcccgtgagggaggtataanagngaaatctttttgaattgtgttccgattgnttttgtttaaacntaatatnttcctggttgtttcncttatttttnatcccccccncccctgaagggggtccccggggggggtccctcttttccctcccctatttgcntcccctctcctcccgtggctgcttcataaaaatcttataaacttttattaaccaagttcagaaataattagaggggtgatctccctggatcagaactaaaanaagtgagatcaattaagctcctttgaaataggtctgtccacacttaatattcttttttagaccaatttagctggaaatctattacttaacccacattcattgatatcatagtcttgtcttatatttctttgccttaggcaggatttttctgtgattctgattgtgtntga

SEQ ID NO: 549450 - DNA, 262 bp, Homo sapiens
gcacgaggaaactgatctttactcaacaaagttttacccaagtggaatttcacgccccctcggcgccaatccccagcccagcccagtaacaaatggacagacccgggagcccccagggggaaaagggtgaggagggaaaaagggactgtggctcaaggccagtttgggtccccagccctgggtaggggaaaaggtttaaaaactgaaacttcattgtgcaaaaaacacccaaaaataaattaaaaaattaaatagtttttta

SEQ ID NO: 549451 - DNA, 139 bp, Homo sapiens
ctagaggatcctgtacatgacccaagcatgcatattgcgtggtttcgacgtgtattcaccactgcggtgttgctccctgtacaagttccgtcgacacgtgagccctgtgctgacctccaaatatcgtaagctggagcct

SEQ ID NO: 549452 - DNA, 283 bp, Homo sapiens
  misc_feature (74)..(74): n is a, c, g, or t
  misc_feature (283)..(283): n is a, c, g, or t
gctaaacgaaaatcaaactgatgattataagagaatttaaatcattatatggaagtccatacctcgtcagtatngaagataagcaggcaaataagattagcagccacagacaattaagcaacccagttacatacttgacctaataaacagtcacagaacacccaacaatcagcacattctgatcagttgctaagcaacaaaagtggcctcaagaaacaccaaaatagccaatcccacgcagagcacagtctctgaccacagtgaaacagcactaaaaatcaan

SEQ ID NO: 549453 - DNA, 1791 bp, Homo sapiens
taaaagagagaaaaccgggggaggggggggggggggggggagtaggagaggagagaaagggggggaaagggtgtgttaagaacaaaggaggggtggtgttccctgggggagaaagggggtgtaaattgttggtgaaagtgggggggtggtggaggtggagccccacatgggtgtgtgtgggaaaagtgtgtgatgagagaggggagataagagaggggtgtggtgacacaaaagagaggtgtgtgtggagaccccgcgtggaagagagagagagaggagagtgagaaaaatgtgagagacacagagagagaaaagagcggtggggtccactaagcaacaccagcagagagagagagatctcctctcgcgaggagaggtgtacaaaagagaggggtgtgtgtaacagggtgagagtgttgtatacagaggagagtgtgtcttgcgagaagagaaagctgtttcctctacaaaagacagagcgtcatatataagcgtgtgagcgagagacaaagagtgttgagagagactctctctctgtagagagaagagagagtgtgataatgagagatgagtagcacgagcttgtggaaagcgtcgtgtcgctatcaacgagaaagagctgtgagcgagaatgaggagcacgagcgccagaaacaaaaaggaaacatgagagatgagacagggcgatgatgaaataacacaacgccgcggtggggtggtgcggacagaaaaacaaacttgataaaagacgaacaacagaacacagtgggcccgcccgactggggacagaaacaagcacaccaaacggagaggggggagggtgattatgagtaggacgacgaaagaaaagcggtggtgcgcgggtgttaacaacaaatcacgagcagagaggagggaacatacagatggtgtcgtgagcgcgatgagaatcatcgagcagcagagaagcctacatcgcatgacaacaaaggtagagcaacacgaagaaaactataaacgagaggccttcataccgtagtgtggggtcgcgatagcactacaggagcaaacagacggtgtcggacctacacgttgtctgcaataacaaaacatagcatggccaccccacaagagcggggagtaaaatagccaccaagcaagcgcgaagaggggggggggaagacaagccacaaagacgagtgacgtatgacagcaccacggagaggtgcgagcaaaaccaaacactacagtgctgctgggtacgagcgcggcaagtaaaaacaaaacacagacaagcaggagcgacgcacaagaagataaaaaaaagaaagagtaggctgcgcggacagaaagacactcaacaagtgtcgacaccccacaagagagggcggggcgcgcccaccacaaaggcacgaactactagggccagaagacaaacaaggaaggtcgcccaccctcaagaagagtagtcatctacaacaacaacagcagacatacggtaaccacagacaacaacaaagatgggtgtgccacacgatcggcaaaaatccgtcgcgacgcgaacagacgaagatcaaccagcgtgacgacaccgcgcgggcagcggcggtaacagacacgaccggccgaggcaaggagcagccacgaacggcaacaaaaccagtcccggccatcggtcgttacgtgggtcgctcagtgagcacggcgaggccgacgcagcaccaaaaaacccgcgttgagacaacacaaggacaaggaagcaaacaagcgtggacgcacagacacagacagcaaaggcacacacagaaggca

SEQ ID NO: 549454 - DNA, 827 bp, Homo sapiens
tgggctctaaaggggtgtaaagggggtgctatagggtaaatacgggccctatttacaaaaattttaaggggaattaattctagtgacgaggggcatgaaatctggggttgtgctccacaagatttcaagatgcattggaccggtagtatacccccggtcgtggtaggcgtggtagaaatgtgggttgtgggttataagactgtcctggagaattggcatctggttttataacgcctaattggtggggagacacgctcatggagtggcaaagactgtctgtgggacatggtaatatttattatataccgaatatggggtgtgtcttccatatcgctgggaagtacactacactcgcgataagtgtgcaaaagcgtccagaggaatgtccgccaagtgtccgcgccagggttccctaaaggaatataaattggggggacatgtatatttgtcgaggaatgttttgaacaaatatctatagtcccccggcgcgtaacagactcgggggtgtataacactcgcaataagggtgtctcgacgtgatacacccagtgtggtggtgtggcccaatgtgtgacaacttgggcacgtggcatacaaggggcaagcgggatctcggtagtgcaccccactccggatcgtggagtacacagtgtatacacagggggacgtgggcgtacaagggggccaagtgcgcgaaccgcgggcccaacaacggcgaggcgcacccaataggggcgactatgacagaggcggcgggggccgcaagcggacctaggttccccaaacaaacgggcgtctcccataatttcccccgtgaagggcggcta

SEQ ID NO: 549455 - DNA, 185 bp, Homo sapiens
tttgcccggtttggaaaattttaaattttgggggccccgggggagactttttgttaataaacccttttgttttaaagcgggggcaatttggattttttttgcccctaaaattttttgtttgtttttttccgctttttttggaaatgtgaaaaaataaaaaattatttttgtttcttccccaccca

SEQ ID NO: 549456 - DNA, 232 bp, Homo sapiens
aagcttagtagtggagaaactggcagataccacttattcaaataataaaagttaacctcatgaatatgagaacaaattgacatcatgtgcctcaaataggatgcactgagaacacaacattgttttagtggtaatcctccgaaaaatgcatggtctgaatctaatcatgaggaaacctcagataaacccacactggggaacattttacaaaataactggtctgtactctttg

SEQ ID NO: 549457 - DNA, 87 bp, Homo sapiens
  misc_feature (59)..(59): n is a, c, g, or t
aaccggtattactatgtttcggggacttattatagcggagactggttcgacccctgggnccagggaaccctggtcaccgtctcctca

SEQ ID NO: 549458 - DNA, 354 bp, Homo sapiens
tgcacgtgaagccatgagcagtagaacctgttgcgacaccctatactaacaggctctcaaagctctgctcgctaaccagataacgctccgctagacactgtagacagtccagttgaataccagcatgcagaactattatcctgaaaatgtcaagcgcttttggaatacctgagtttaaaaccagtttgcggccttggtgctttgtggcagccaaggggtacagcccttactgggctaatgctaagcctgaaatattcgcctaatggacatggcaggacttgactgaacaaggagtagctacttttaaagcttccaccaagtcttggaccaagttttaagaatgcatgtttgcct

SEQ ID NO: 549459 - DNA, 310 bp, Homo sapiens
cctagcttcaccttattctttaaagggcagaaaattttagacggtaatcgccgtaacagtaaatttggcttacaattggggcccccctccggtttaggaagggggaccaccaattttaccacattcccacctaggaaaatttttctttgcgtaatcaggcctcacctggctcatttggctttcagtttgatcgtcgttagatttgaggaaaccatctagatgcagcgttcgctattagatacttcttagatcgtctagatcttcttagaccattggccaaaagagggtcgacctggcaaccttgcaaggt

SEQ ID NO: 549460 - DNA, 151 bp, Homo sapiens
ccacgatgtgatctgtgtactcctcattcccacctcctccagaagggcacttgctgctttctgtataagtgagatggtttttttcccctattccagtggaatacggtacaaatccttatcccttcataatgggcttacctgaaagtgatgg

SEQ ID NO: 549461 - DNA, 322 bp, Homo sapiens
cacgaggcctcctccagtgtacacgtttcctctcacacattgtgctgatacattctacctctatctcagcctctctgggaacatcggtcatcttcacttgcattctgaccattatccaaatcatcaacgccatcgcatggcaacacaacctttaaattaaaggccatgtgtattttatctcgcttaacattgattgaattgacaacaagggggactggatctatgattacttctcatgctgcagctcaggcgttaactcctacatcattatctcaattctccaatctgaagatgacgttgaatacttttgtcttacctgtga

SEQ ID NO: 549462 - DNA, 201 bp, Homo sapiens
tacccatatacagcgagatcaccaccaggctccaaagaggtatcttgcgttgacgcgcaagttcacttccaagtcgaacaggccgatctgtgggacgaaacatgaacccagggcttgcgatgagctggtgtaactatatctcaaagcttaaccaggtgttggcggctgcaagtgagactgagccttccactggttctaact

SEQ ID NO: 549463 - DNA, 436 bp, Homo sapiens
cgggaccgggtgcattctggactcatggcacctgtcactggcctgcgtctgtgctgtgccctgatgctgtcccaggagtgaccttcctgtctcgggggtctgagcgaagacggggcatacaatacaatctcaatgccatccgcgctggccgcttccctgaccctgggcgcttaccttctcctatgatcgtgccctgctggcctctgcactcaatgcctggcgagagcaaagcgacaatagcgtggggctgccactgacgagggtcaatcaagcgaggctgaggtgaatgggcttgcagcccaagggcaaagtataaaggacatgggaaaaaatagtggagaagcagcacagtaactcaacattgacaaccatgcctactgagtattcactccataccacagcccttggggccaggccatctgcacccactttagct

SEQ ID NO: 549464 - DNA, 455 bp, Homo sapiens
aggcagaatctcactcccatcactcaggctggagtgcggtggcactaacacagctcactgcagcctcgacctctcggactcaggtgattctcctacctcagcctcccaagtagctggaacaataggtgcatgccaccatgcctggctaatttttaggatttttagtagaaatagggttttgccatgtttcccagactagtctcaaccttctgggctcaagcagtcctcccatcttggcctcccaaagtgctaggattatatgcatgagtcaccggacccagccttttcttgacatttttaaagccaaacctttttctaaaactaccaaaccatcttttgatggcattaagctctctagcgttagatcctcaccttccttttgctttaagatgtcatataatgacttcactttttctcacatcatattagagattacatgtacccttttgccgaat

SEQ ID NO: 549465 - DNA, 157 bp, Homo sapiens
tgtataaccatatacttctgcatctgaattatctagcactactttgcacggagagccaaagctaagacccccgataacagacgagactaactaagaacaagctaaaaagagcacgcccagtctatgtagcacaatagtgggaagatatataagtgta

SEQ ID NO: 549466 - DNA, 190 bp, Homo sapiens
tacgggcgtcgtttgagatgcaggagaagctatggagtggggggtcgtttaatacgcgcggaaacagcaatgaccgggaagcggctctcctaccagtgagccctacaaatcaacgtgaggcgtgcgcactaatagttgtgtcatccctcttattgaagtcatcatcctagccctaagtctggcctatgag

SEQ ID NO: 549467 - DNA, 316 bp, Homo sapiens
caatatcggcaacgatgggtcagataggaccaaaagcagcaggataggtggcagataggctaccatactcgaagctagcataaagctccatactgtaaacgaatcaattccagctagctgccgacaagtagctagagtacacaagatagctctcggggatagccaagtagtcaggactcggctgccaaacctaagagggcagaggcttggagagcccgggagccaggctggagtacccaaagcggagggaccccactgctaatataaggaatgtaggtccataaaccgctcaaacactaggacccgatgcccggtg

SEQ ID NO: 549468 - DNA, 571 bp, Homo sapiens
ccctgagcttgaaatgtgttagtgtgtgtgtgtgtgtgtgtggtatatgggactggctgcagacgtaggctcagaaagacatgatccatgctgatctatctccgatggcctggaaagcactagtacagtcgagtccacttcataactgggagagacactcacagtggagacatgcacccatcttttatgtatgtcagttctcacaaggagagggaacgaaacgtgctttttcgtgtggatccataaaatctccgctgaagtcagacccaagttgctggactaactccaggggcagtggcttttgtcctttgaccctgcccctctcctgccagccctcggagtctccccataataccaaaccctcccccgacataagactcctgcttcaaggtaaaaatacttattttcacgtgagatatcaagaactcggtttccctggtaactcgggcagggaaagagaatttaagatgatcagaaatattcattctgaccagctagatccattctcctccttactcctaaggctttatctgcaacacagggcagggtcccaagcctctccaagtcacta

SEQ ID NO: 549469 - DNA, 654 bp, Homo sapiens
atgcatgaaatcaaaatttgtagaatctgcaattttatgcactcactcactcacaccaaaatgtgagaaccataaatctactcatatttcataactaatcagaaaacttggaactatgggtgcagataacttgttgatggtgacaacttatatttttgaaatatctcgtcttctacgtttctttaagggaagctttgaagtagaaagacgaaattttggttattctttttttttttttataatttatacttggagtctcggggatacttgttgcagaacgtgcaggttgtgtggcataggtatacttgtgccagtggtggtttgctgcaccgtgtcaacccattcatctaggttttaagcccgtgcttgctttaggtatttggtcctaattgctctctgtcccctttgccccccaattccccaacaggccctggtgtgtgatgttcccctccctgtgtccactgtgttctcatgggtgcaactcccacttatgagtgagaacatgtggatgttgggttaacaggtcccgtgtgtagggtcgagaatgatggttccagcttaatccatgtacctgcaaaggatatgaactcatacttaaatggctgcatagtatccatggacataaatgtgccaaatttctatatccagtctata

SEQ ID NO: 549470 - DNA, 176 bp, Homo sapiens
cacacttgcagtgcaacatggtggccaactcggggagctagccagcttcgagactcgctcagctgcgagcgttagtgctgcttcctaaccgagaacggtcggaaccagctaccgccacgatgtcctgtgcagatcgcataccttgaacgtctgtcatgggttcatgggagccggac

SEQ ID NO: 549471 - DNA, 1339 bp, Homo sapiens
  misc_feature (354)..(354): n is a, c, g, or t
  misc_feature (484)..(484): n is a, c, g, or t
gaactgactgtaactacaacgggtagtacgagatgcggggtcgtactggcgcgagaaggtcactgggaaacgagggacgagcggcaggggtgcccatcggagtcgctgcttgggtctctgataacggtgcagaagaccagtgagatcatcctacgctgggtcgttccctacgacgatgagggcactacgcatgagggaacaggcgtcggcggcttgtatctatcttcgcgcaagggcgctgacctgtggtcgagccagttctagcacttggtcacattgtgcttgtgtcaacatagggccgtgtcctacgaaggtagccataggtgagaattagtcgaacagcccgtctgaacnagctcacctggtcaggtccttgtcaggcgcgagtcatgcgcatggggagtcgtcgatagcctgaagccacaggttgcctgttacgacaggtaccgtgcgcttctggggaatgcaaatggacacgacgtancgcgtcgatggtacccaaggcaaggactgcgaaaagctgcgagggagactagcgcctgcatctggtgcccttgtgcgaggggaatggcgtgtataactatgaccttccatgggttagctcgatagtcgcgccatacgttggccgcccacattttatacaaccaacgcccctcaattgcgcccacaagtggcttatcctagagagagaagaggaggaaccaaggccataaggaaacacaccacaaaagcttagagcccccataggatccccacgaaccccgccaccaaagaggacctaaggggcggcgcacggcagacacacggggggggctttggtccccaggcggcgagggaacaaacccacgcgggggtcggaataccagccaacacgaaaggagcgtgtgaccagaaggagaccacgaaagtaccgcggcaatgccaagagcaacagccgagcacagaccaaagtttaggggagacgaattagccaggaagggaagcgccgcaaacgaccggcgggcggcggggaagaagcggaacagaagccaaacgcgggcccccagagaggcagccgaaaaatagcccgcgtgggagagcaaacaccccaaaacgtaatgcaccccgtagggcacgcccccgcaacgaagccgcccaacccaagagggaacattacccgactggcaggagcaccccgcacggagtagagagccgacccatatgaccaaccaccacgggagaccacacaaggaagagagaccacagaaggcgaccggcgccacgaaggggacgcctatcgggccaagcgccacaaagcagagaagaggccccggcagacaatgtgtggggagcaaagccc

SEQ ID NO: 549472 - DNA, 167 bp, Homo sapiens
tcggtcctgcgatcttacaactgcggttgtgcgtaacctgggagtgagagcttgcagtgagccaagattgcaccactgcactccagcctggtgcagcagagcgagactccatctcaggagaataaaagaataaaataaaataaagaccgtgcacctatagtctcgct

SEQ ID NO: 549473 - DNA, 336 bp, Homo sapiens
taaaaaaaattgggggggggggggggggggcccccccttttttccccccccctggggggggtggggggggggggccccaagggggggggggttcaaccccggttgggccccccggggtaaaccccttttttttttaaaaaccaaaaattacccccggggggggggcccccctttttttcccccccccccggggggggggggcccccaatttttttttccccggggggggggggggcccgggggggggggggggcccgtggggtcccccccctccccccaaaaggggactttttttcaaaaaaaaaaaaaaatttttttttaaaatccccgccccca

SEQ ID NO: 549474 - DNA, 887 bp, Homo sapiens
  misc_feature (5)..(5): n is a, c, g, or t
  misc_feature (419)..(419): n is a, c, g, or t
cgccnggaaattaggctaggtacgaggctgggtggctggggtagctgctcacgattttggctataaaggggaggagagcccagtcatcgtaggctctgcgtctctagtgccctatggacgggatcgggtacctctgcagttaggcctgaagtctgtgcagaagctactggatgctgtggacacttacatcccagtgcccgcccgggagcctggagaagccatttcctgctgcctgttggaggcggttgtactccgcttgccttggccgctggcaccggtggatgcgcgagggtacactatgagcgttggcagttgttcaacagacagggagactggatgtgtgagcatccatagcgtacatagcaacgtaatcatccgtcgactgttggatgacaggcctctgtgaggagtgtttccancaacgacgcctggatgacgtggcctgccgtgccggtaggactaagcctcgcgtgggcccgtgggctctcgacggactttgagagtcggggacggatcttggcgtgcggggccttggctcactggctcataggccagcgttccagtcgaagccccagcatcaatggtggaggctcggagtgtcttacaattccatctcgctgagggatgggaacggtggccgcccgacgagagcgccttttgtgtcccatcttcgagtgcctgtcatgttctcccttggctttgggggacatggcctgtcggtattgtcctgggctcgccgaggaatggagctggcctggtccggcgtattgcctgaagttcagcctactcttgcggagcggaggtcctggagaagtgccgggttcccctgcggcatggacggacctttggcccgtcttaccaaaggtgccggttggaggaaaaccggg

SEQ ID NO: 549475 - DNA, 166 bp, Homo sapiens
caccggatcctgagatcacgccaagaaaaaacatggctaataaataatttctgatgaaaaaaactatttaatttaccaccaggagtcaacacacgtttccaaattccacaaatggggctttcttaagtgttcacacattttgactctatacaatgatcgcttgtgg

SEQ ID NO: 549476 - DNA, 115 bp, Homo sapiens
gtcgaccaaggtcaagcttctgcgatcccttcctcagcgtttcaagatggacgtgcacattactccggggacccatgcctcagagcatgcagtgaacaagcaacttgcagataag

SEQ ID NO: 549477 - DNA, 190 bp, Homo sapiens
tagtgaagtgtgactctgtcctggtctccttacccatttaccattttctttccacctactgggcggatgttctgtcctgagtcaaccctctgtcccactctgtcacccaggttggaatgcaatagtgtgatctcgactcactgcaacctccacttcctaggttcaagcaattctcctgcttcagcctcct

SEQ ID NO: 549478 - DNA, 556 bp, Homo sapiens
cagacggttgctccgagcgttcgttcccgacatgtgatacctttctttgatgcattgctgccactgcagccctcatgccaactgcatgattgagcaccagtgcctcatgctttgcacctgctgtcacccatcatcaccctattttaagggtcagccgcactctaaggagagttcaaagacctaggccttgatcactttaaggcgaaatatacggtgcttttcttctatccctcgcattttacctttgggagtactacacaccatgtggcttttagggacatatctaacgaatttaacgaccgctacctgtaccgcagacgctcactcagtggatccccactgtagccatcttgcctgtttacttgcaccatgatagaatggtcgataggcccacatgatcatcgcactcttggcagacgcaactatgcagaatatccgcgactacgtgtgggctgtcacaaggaatggacttagcactaagacggctgttcattgttgaccctatggactcatcaagcacttttgcgataacgatctcccacaggaccgatgcgtt

SEQ ID NO: 549479 - DNA, 523 bp, Homo sapiens
  misc_feature (182)..(183): n is a, c, g, or t
  misc_feature (211)..(212): n is a, c, g, or t
  misc_feature (285)..(285): n is a, c, g, or t
  misc_feature (303)..(303): n is a, c, g, or t
  misc_feature (321)..(321): n is a, c, g, or t
acttgccattctatggttaagaagcgggcattcgacagatgaatattacgttaccttgcagactcaatggaaactgagttcattttctgagaaaggtttttatgactgaaatattttctctacagggagggactttaacatgccctggctgtaactaagctcttctgagtgggctccaggtnncactgtcctgaaatgcatcatgatacgnnaccttgccgagctcgctcataaactaactagctctgaactgtactcaaaccgactggacttatagattagtgnttttacattattgtttgnaccagtccttgtcgttcnagttgtgacctagctctttccttttttttgaatccacctcacccccgctcttctcttttttttactatcgcccaattcacattttctcctttcactttttaatctccactctctgtctcgctctttcaatctattcctccctccctccccctccttcctcctttttttcttttctcccatttattattcctttattcatcct

SEQ ID NO: 549480 - DNA, 302 bp, Homo sapiens
aagaaggaccatgtgcatttgggggacattgtaattctagccgctttttatattgaaaaattccaggccgggcgctgtggctcacaactagtaatccaggactttgagagggcaaggtaggcagatcacgaggtcaggagtacgagaccagcctggccaacatggtgaaaccctgtttctactaaaaatacaaaaattagccgggcacggtggtgcacacctgtaatcccagctactcgggaggctgaggtaggagaatcacttgaaacctggagacggaggttgcaatgagctgagatcgt

SEQ ID NO: 549481 - DNA, 626 bp, Homo sapiens
cacttcaaggtttagaatagctcaagtcagagatgggaagggaagcacacactggtaagcatggagtgcatctaaaacatggaagtgatcttatctcaccagaaatggccaatctcttatgtagaatggtacagtcttcaggatagatggtgcagggtgtgcagcaacttggaccagcaagctccaattttctagcaaggggtcttttacagtactcttccagacttcaaagttggactccctacagcggtgtggatgacggcactaataatggcttttattccccatctcaccctcgtccctcttagctggaccaggtttggactggaggctgtgtgccaggtccagaaacactagtctttacattggagcagtagaatcttcaggcagaattagtatttaatagttttggttggttttggagacatagtctccctctgtcgcccaagctagagtgcaggggcacgatctcggttcatggaaacctctggcttcctgggctcaaggcaccttccctcctcagcctccccagtagctgggactacaggcacacaccaccatgcctgggtaatttgtgtattttttctggcacagggtttaccatgttgcccaggtggttcaaaccc

SEQ ID NO: 549482 - DNA, 243 bp, Homo sapiens
aggacaaccggagatggagcgcgatgtccaaacagttgtcatagctgtgacctggggaaccacctgccccggcctcccaaagggctgagattacaggcacgatccactgcgcccggctgcccagcctaaccgcccagcctaattgctttctttcttttctttttttttttggagggggagcatcgctctgtcaccaagcttggagggcaatgggccattcttggttaactacaacctcggcct

SEQ ID NO: 549483 - DNA, 512 bp, Homo sapiens
ctagtacaacagcagccaccagtacattcctcaactgccgttttgggcagtctgctcgatgtcaccatctgcaagatcctctggcggtcatcagattttacgtgggacatctctaagtgctggtcgagactattttttcatttggaatccatcagaccagtatcacagtgcccccatctgccccaccaccaactactgctgccactccccttccaacatcattccccacattgtcatttggtagcctcctgagttcagcaatctaccccctccctgcctatgttccgctgtgctagaagcacagatacaggccacttcatcagctttgcctgagaggccgggtgacagtgaggtctcaccatcagcagcctctcttctagaggagcatcagtctgcccagcttccccaggctcctccgcaaccttctgactctgttataaaagaacctgttcttgcccagcctgcatgctgcaactctggcactgcgtgatctagtactactgaggtgtaag

SEQ ID NO: 549484 - DNA, 854 bp, Homo sapiens
cgaactttttctgttgaacaaaatattcacaacaggcagttgtgatacgaatagaacaaaaaaaaaaaaaaaacatttaaacttggtaaggactccgatgaggttggggacttcaggaaaaatcaacccagcaccagcagtttaccaaccaccattccatctcttcacttgaacagctttagtttacgtccagatgtgggaccccttctcttgggaaaaagtccctagttggtgtctcagaccggtgtaaacaaaccagccagccgccacctttgctaaaccttataagctttttaaaatccaattatttttctgccaaaaaattatgccttgatagttagccctcagcccataggtgtttttggtttttaaccagaattatattttgtcggggggtgaaaaaacccttgcttccaaagggtccatacgggttactgggtttcatggccaccactttaggggattgtccagtttaaaaccatttggtctgctccctcggtggaagcctttgcgcagagctacttggtactggtgggagaataactgctgaatttaagctgttggagtgattcgcaccagtgcaccacaactcatatgaaacctatttacgttatttattatctggtggaacacgtttaccctcgaccctttcggtccctactggtatttctcccgtttgatgacaacgcctagatattttttcttcatcactgtcacttttgatgggcctttttaatcggcaaatgggggggtttgtctctcccggaattttgccttggactcctggggtttatgtgctcgtcccatctctctaagatgggtgcatttctatcttctgtcctattgacacgttc

SEQ ID NO: 549485 - DNA, 509 bp, Homo sapiens
  misc_feature (86)..(86): n is a, c, g, or t
gttgagttctattgtcagtcagcccggggagttgacagtcctagtgccactgaggactacttgccagaccaggaaccagtggaatngagaacttcttacagaaaactcaggatcaaaaggacacaagccttggatcactgtgtatcagccacagagcaagtgatctggagctgcagctgctgggtgggcgggacaaccttcaagtgaagtgtatgtaccagtgtacaccttggaagtctcaccttgccttctccaggtaaccaagaactgcatagaaagaactttacgagcttggctgtggtctcccaaagagctgaagtcatcatcagtgtcagagcccaaaaggagaatgacagatgcaattcttcctgccatgcagaactggacttgagtttgcaaggtgggaggctctttcaaggcagctcacccatcagaatagtcccggatctttgaattctctcagagtccccaccatctgggtctctttccctttttggaggctgggatgg

SEQ ID NO: 549486 - DNA, 262 bp, Homo sapiens
agttatccccccacagactctctcggccgaccgccaactcttgccgcgtccgccacatcttttccggccgccacagcttactacctgcctgtccacagcttctcctgctttgccttaagtctagcctcagccttctctaacttctttgcattcactggtctaaacggtccaaacacatcgacttcactctcgcgtgtaggctctgaaaggaaccccaagagagaacatttcgagaagctgtggcgggagtaccgagctcgat

SEQ ID NO: 549487 - DNA, 383 bp, Homo sapiens
  misc_feature (1)..(1): n is a, c, g, or t
  misc_feature (6)..(6): n is a, c, g, or t
  misc_feature (116)..(116): n is a, c, g, or t
  misc_feature (124)..(124): n is a, c, g, or t
  misc_feature (325)..(325): n is a, c, g, or t
  misc_feature (362)..(363): n is a, c, g, or t
  misc_feature (372)..(372): n is a, c, g, or t
  misc_feature (382)..(382): n is a, c, g, or t
nggagntccccatccgctgaggagatggatgaggatgggcttcctctcatggggtcaggcatagacctgacaaggtgccagctattcaacagaaaagaaccgtggcctttctaaanccagtttntggtgcacactgtgagttttctcaaccggttttccgcagtttgtgaggagaaactggcagacctttctctccggattcagcaaattgaaacaactctcaatattttagatgcaaagctgtcatctatcccaggcctagaggacgtcacagttgaagtgtctcctttaaatgtcactgctgtcacaaacggatcacattctngaaaccacttcggagcaaacgcagcagaatagcacgnnaagactctnggaggcacang

SEQ ID NO: 549488 - DNA, 311 bp, Homo sapiens
  misc_feature (64)..(64): n is a, c, g, or t
gatgagctggtaccggtgttatcgatgcaccctcgaactcctgacctcagtgtcgcccgctgtnctcccaaagtgctgggattactggtgtgagccaccgtgtcctggccagatttctacttttttaaagctcttacaggatatgagacactttttctttttcttttttcctcatatatatgtttgtatttttcatttggtttctttcgtttttaaatttaatttaatttaatttccagttccgagatacatgtgcaagcttttccctttttgaaagggccgtgcagtgggaggtgtggcatcgataaaca

SEQ ID NO: 549489 - DNA, 564 bp, Homo sapiens
  misc_feature (270)..(271): n is a, c, g, or t
ctagaaacagtctctccccagctcacttggctgaagatactaaagagaactagatgttatctagtgttatcctgctgatcccaatttcctatagttctggcaccagaaaatcctgaatgataggtttttctgaagctgctgacatcgggtcaccctcaacaccatcacctttggccatgttcaggaagtactcaaaggtaacactggcagccaagagcaggccaatcaatgtctggccacaccctaatcccacctggacagtcacacccnncctccctatgtgtgttcgcacagtgggggtgatatcatgtgggtctggcctgtcctgagcagaacctggtgttgggttgtcagaaacccagtgacccatcacgttcactcttcagatcatggctcaaaagtctgcagagcagagacaagagattgacaaagaggtgttgatgagggcaataaaagcaaaggtggctttatcacggtgagctacttctcacaggagtcgggatccacatctgcagactacacaaaaacaaacaacacagattaaaagcacaatcaccattgaaa

SEQ ID NO: 549490 - DNA, 100 bp, Homo sapiens
accggttacttgggagcacaattaatggtttcctacagcttacttgtatctgagtatctattggatagatttaaaaataagtcgtataaatttgatctct

SEQ ID NO: 549491 - DNA, 907 bp, Homo sapiens
tgccgcatcatggtgcggaagcttaagttccactgagcagaagctgctgaagccggtggacttcctgaagctgggaggtcaccgactcacaacctgcacggagctgcgcgtgttgctggctgttaccggctgctagcggcgggaggagttacacgcgcgtacgaaaccagctgagccgtgccgtgcgttgagcttggcagctggcgcacgtggcggcggacctgcccgaagcgcgaccatgtccggcggtgcgcgactccggcccgggcttgttggacaacgctgttatgctctcggttggggtgcccgacggccggcgggtctccgcgtggaaagccttcgtggcagacctttccgtcaagtggcgccttctggtccctttcgtagccggcgcggccccaggccgtcccccccagcgcgggtgtggcttcctcttcacaacgcctggggccggcaaatgggggctggcaacagccacccccttttgcgaagcgcgctggcagcggttggcccttttggggtgggcaccccagctggtggccactcgtctacggccagttggggagcccccttgtggacccgaggtggtggtatttacaaccgccggtagatcccacccgcagattccgacatttccctgttggtgcttcaccacccggccgcaagagaggatgcggcaacggaccactattttgtcgccccccgtatggggcgtggggagaccctccgggtacaaggaggacactccaagcggcgggactcgccgagtagagttgacgaagcttacccaattagagaggagagcggcgacagaaagtggaccactcaacgattgcctgggagaaaacccactttataaccgcccggggggaaataactaccgtcccaacgaaaagtgtatatagcg

SEQ ID NO: 549492 - DNA, 264 bp, Homo sapiens
atcgccgtatatcagcgtggatattacggaagcaacggcgcgcgtgctcgtttagctcattacgatttaccaccagctttattggttgatataagtagaattaagcagtatttgtcctactgtgaccgatgtatttcacttaacataatgtcctcaagggtcatctaaattgtcccatactgtaggattctctttttttttttcttttttgaggctgaataatattccattgctgtgatgtaccacattttcttcattcttctg

SEQ ID NO: 549493 - DNA, 173 bp, Homo sapiens
tatctcccaaagtatgcagtttcacaaacttgattctcagttggtaatttttaaataaattctgtatccttgggctataaggatcttctattttgaaagccggatctaaagcccgaaatatcacctctccttcagttgagggttccatgtcagaactatcgaggaatccactc

SEQ ID NO: 549494 - DNA, 434 bp, Homo sapiens
  misc_feature (127)..(127): n is a, c, g, or t
tcggagaggtccaaacttcaaaagtggcctcagtctggaatttttccacaggaaaagtcagcagtaaatattgacaccggaatcaatcatctctactgaggttccagattgctccagccagccaggncagctaggtcacaggtgacaagaataagacagccaccctctgaaagagctgtcatccagaagcctggagagaggccgtctccctgactctgggtcgccatcctctcagtatggagcaggcaatgctgaaagacgctggctttgttgggtgctgggcaatgcactactgggtgtgccacaaggtttcccggtgtacgactacgacccttcctctctgcaggaagctctcagtgcctcagtggcaaaggtgaactcgcagtccctgagtccttacctgtttcgggcgaccggagctccttgaagagagt

SEQ ID NO: 549495 - DNA, 465 bp, Homo sapiens
gtgcagagtatgccggtctcttacatacataaatgcgtaccactgtggtttactgcacagatcatctcatcacccaggtaccaagcccagcatccgcagctattcttcctgatgctctccttcccctcccccatgccatgaaacaggtgtccagtgtgtgttgttcttcctgatgtgtccatatgttctcattgatctgcttctgctaataagttagaataataataggtggtgtttggttttctgttcctgcattagtttgctgggagtaatggcttcaaattccaaccatgtccctgcaaaggacatcatctcattacattttatggcttcatagtgttccatggtgtatgtgtaccacatttcctttatccagtgtatcattgatgggcatgtagattgattacatgatgttgctattgtaaatagtgctgcaatgaacatttgtatacatgtaaaaaaaaa

SEQ ID NO: 549496 - DNA, 926 bp, Homo sapiens
gccccgtgctgcgctgcagcgtcctggcgcgcacctcggaggggaccccggcactggcgagagtcaggtcgctgggttccaaccacgcgtgccctgcagacgagcctccgacccggatttctgaagggagggttggactgcgctgccgttcttgagtggtgtcctggaagttctggacatggtgacttgaatgtgatgggtgacgtggtcatgataaaggtggcctggtggtgcaaagtggaagcggccaatgagcatccatgtctgtcgctcgagtgtgatgcctggggagggcggctggtgcaatgctgccccagctggatgtgaaggagggatcccctgtgatgcctcatggcatggtccttgtcattggagcttgcggctctgggaggcgtagcccctgctgttgccctgccgcactgcttgcctggggtggcccttgtgggcttgccttgcgcctgtctcgcatggcgtggggcccctgcctgcaaccatcccggcaccagcatgaccctttggctggcctggtgccatgggcgcctgtggtgcgcttgtggcttcgccttgaggcatgcctgttctgtgccctttcctccccactgttgcatgccccaacggcacatgtcagctttcggttgccccgactgctgtgccgccttaaccccgtttggggctgcagcctgtttctggggcttcagccccccgtggagcctttgggctactccggcgggagcgggggggcgcaacaagccgcgggtcttgcgcctttcataggcggcccatacttccactttgccgcgtttggtgccaacgctctgggttttccggcccaccattggagtacggcgttagggagttattcggtagcggtcggccggcgtagcttcgggggtgccaaggacgagccagagggtggcgtgagggca

SEQ ID NO: 549497 - DNA, 374 bp, Homo sapiens
  misc_feature (11)..(11): n is a, c, g, or t
  misc_feature (80)..(80): n is a, c, g, or t
  misc_feature (147)..(147): n is a, c, g, or t
  misc_feature (176)..(177): n is a, c, g, or t
  misc_feature (187)..(187): n is a, c, g, or t
  misc_feature (196)..(196): n is a, c, g, or t
  misc_feature (206)..(206): n is a, c, g, or t
  misc_feature (208)..(208): n is a, c, g, or t
  misc_feature (213)..(213): n is a, c, g, or t
  misc_feature (230)..(230): n is a, c, g, or t
  misc_feature (239)..(239): n is a, c, g, or t
  misc_feature (258)..(258): n is a, c, g, or t
  misc_feature (266)..(266): n is a, c, g, or t
  misc_feature (274)..(274): n is a, c, g, or t
  misc_feature (333)..(333): n is a, c, g, or t
atttccccttnccccaggagataggacccctaaacctcccctgggtcctaggaccacctgatccaccacttgtagtctcnagtgaggaggggacccttatttggaaagaaatgaacatgtaagcagctgtccgcaggaagaaaggangatggctgaaaggaatgaaccaccggagnngtgttttttntgtggaggngtggagaggncntccanggcccggccttcttggngtgggggantggctggcctgggcttgcngtggcagnacagcttntgttgaaggcttggggatggccaggctgccggtctggggaaagatcactcgatctccangatgaggtcgtcaccttccagtgtcatgtccttggtcacat

SEQ ID NO: 549498 - DNA, 407 bp, Homo sapiens
ggtactctctgctcccagattcacatgatcagtatcaagtaggtcccctttcttctgccaggcttggccctggtgataggactcttgtgtcactctagtataaaatcacagtggcccaaggaagaacctcctgagcttgattaccctcactatggagcagaaggacctggccctgaacacaggggcggtgcagagtagtaaaatagacagtggctgaccttgtagctttggctgaaatgccgcacagggctctgatttgaccaacttctcccacctgaggaagaaacaagttgtctgatactggcactgctggatactcagtgttgaaagtctatgtagagaaaggatattgcaaatgaaatttagaagctattccttaaggctaggatgcagactatgctatacgc

SEQ ID NO: 549499 - DNA, 190 bp, Homo sapiens
atcaggagagagactgggcgttcattagacttttatcataactatgtttccatcatccacagttactgtttgaattcttctctaaaaatattgtaattggcaatagtccaaattttcttttgttttctttcctgtttttgagacacagtctggctctgtcgcctaagctggagtgcagtggtgggatctc

SEQ ID NO: 549500 - DNA, 383 bp, Homo sapiens
  misc_feature (383)..(383): n is a, c, g, or t
ttttaacaaatgtatagattttgaaccactgccactgccaggatgcagaacagttctataacatcatgatctaacttaacagatttttcaatatggtcacatctttaacattttaggcttgtcctctatcttcaggttatttttggataaacggttgtaatattttaaaaataattatttttgacttgctttgtatttactatgtcatacagttagctgtttaaccagcttttttttctctctcaattaaagggtatattaagtcagagtcaggataaatcacttcggagaatagcagaattaagagaggagctccaaatgacccagcagcaaagaacatctgcaagagagtttgatgcatcttagaggagaaagacagtatn

SEQ ID NO: 549501 - DNA, 290 bp, Homo sapiens
  misc_feature (277)..(278): n is a, c, g, or t
aagtttaggataaattccagtgcggcgggggcaggcaaggctacccacattttttaaaaagaagccagcccgtatttttctccctttccaaatcctccgccccccagtccttcgacccaggcacgagcgcccatcgcggaggccacgatgcccgttttattccctctccacggcaaggaaaagcagcgaaatctgaggtcttcagaggttaaccctatctaggagcagaatgtgacgcattgtaaacaaataaatattgaaaactcgatgttaaacnntttaaaaaaaaa

SEQ ID NO: 549502 - DNA, 323 bp, Homo sapiens
  misc_feature (138)..(138): n is a, c, g, or t
tgcagctgctgctgtgtgtgggtctagaggatcccatcggcgaagactgtggcagcattttatggcatcaggcgaggagtgtgggcaggcaccctcggagcccgacccagatctgggctgtccctgatctcgttctanagggggaagagcctattccgtcgccctactccaaggagcagagccattctccgaaaacggcagcccccaaactgaggtccctcccacagagttgtctgtccacaccccatccccgcaagcagaacctcgtaggccctgaaactgctcagagaggaggtggcccccagccacagtcttcgcctgat

SEQ ID NO: 549503 - DNA, 622 bp, Homo sapiens
  misc_feature (472)..(472): n is a, c, g, or t
ctgcttctagctcggagctaaatgctgctcatgctgaaaagagtaatgtgtatatctttgtgtgggtattagctctattttgatctatatcacagatttgtaattcagatcattacccctgcactttgtaccacatgggcgtattctttctttccagacattgctgcaattatcttggctggtctttgtgtaatatgttctgtgtgagcctctgcattaaactcgatttcttgggcaattatggaaattccagtgtggctgcagtttaactttgcactctctatgcatatgagggttcctaaataaatgaggagtagcataggttaaaatatatatatcttataactttctacaacaaagaattattgagtccaaatgtcatcagtgctcaatttgagagaccctgctatcgatgggcgctacaaaccacgaaatactcaagttattatgtgtgtacacatgggtttaggtntatgaaacaatttaccttcatgagctcataggtaaaaatgtgataaatttaggaatattaaggggcaatatgggaaagcccaatttctaggcggattctgttgggtttagattttgtgtaagtcacaccccggaaggagttgactatctg

SEQ ID NO: 549504 - DNA, 637 bp, Homo sapiens
agcggatctgggcgcagcgcggacatggaggaggacttattccagctaaggcagctgccggttgtgaaattccgtcgcacaggcgagagtgcaaggtcagaggacgacacggcttcaggagagcatgaagtccagattgaaggggtccacgtgggcctagaggctgtggagctggatgatggggcagctgtgcccaaggagtttgccaatcccactgatgatactttcatggtggaagatgcagtggaagccattggctttggaaaatttcagtggaagctgtctgttctcactggcttggcttggatggctgatgccatggagatgatgatcctcagcatcctggcaccacagctgcattgcgagtggaggctcccaagctggcaggtggcattgctgacctcggtggtctttgtaggcatgatgtccagctccacgctctggggaaatatctcagaccagtacggcagggaaaacagggctgacgatcagcgtgctgtggactctgtacctatggcatccttagtgcatatgcgccgtgtatagctggatcctggtgctccggggcctggtgggcttcgggatacggaggagttccccaagtcggtgacgctgtatgccgagtaccttcccatga

SEQ ID NO: 549505 - DNA, 432 bp, Homo sapiens
atattacagttccatttcataaagaaagttaggtttttagaaaatatgctctcagctggccacagtggctcacacctgtaatcccagcactttgggaggctgtggtgggtggatcacctaaggtcaggagttcaagaccagcctgaccaacatggtgaaaccctgtctctactaaaaatacaaaattagccaggcatggtggtatgcccctgtaatcccagctactcaggaggctgaggcagagaatcacttgaactcaagaggcggaggttgcagtgagtcgtgccattgcactccagcctgggcgtcaacaagagcaaaactccatctccagaaaaaaaccagcctgaccaacatggtgaaacccgtctctactaaaaatacaaaaactagccagggatggtggcacatgctgtaatcccagctactcag

SEQ ID NO: 549506 - DNA, 249 bp, Homo sapiens
gggactacatttatcatactgcacactataatacagacatggccagtgcctgggcaaagagtggcccgacgaaacgtctacatgtaccatgctcctgaaaactacagccatggcaacctggagctgctggcggatgtacagattgccttggggactaccccttctaaccagactatgaggggcagtaatctctgagaagagaagagcctgtcagtgacaatcatgcagcacataacccactacatcaga

SEQ ID NO: 549507 - DNA, 416 bp, Homo sapiens
aaagagtccccaggttatctcaaggttccttctgcccatctttcagaccagccagcatgctgtgtccttctcggaggcttttctgatctccatgggcagcatgagtgatttctttccctgaatccttgcagtttcctgtcagtcccacacctgggcacctagtgccttccacctctttgtgggtgcctgccttccactcttgtggtgtctgtctgttcctgtgacagtgagtgtctcagggcaggtttaggtctgtgggtctgttttcccagtttctggctcatatcctctttagtgcacatgggctgctcctccctccctcacccatggctctagtgcacgcacacacacacacacacacacacagacacatatgtgtgtccacacacaacatatgtacatggcacgcgacatcg

SEQ ID NO: 549508 - DNA, 296 bp, Homo sapiens
agttctgatctcatgcagatgagtgatttctttcctgatctcgcgttctgagtcccaactggcactagtgcttccactcttgtggtgtctgtctgttcctgtgacagtgagtgtctcagggcaggtttaggtctgtgggtctgttttcccagtttctggctcatatcctctttagtgcacatgggctgctcctccctccctcacccatggctctagtgcacgcacacacacacacacacacacacagacacatatgtgtgtccacacacaacatatgtacatggcacgcgacatcg

SEQ ID NO: 549509 - DNA, 156 bp, Homo sapiens
  misc_feature (136)..(136): n is a, c, g, or t
gggctgctgtgaagttttaaatgaaagctcctagctttaggagctctgagccactttccctcgactgcactggcctggcagtctgggctgctgaccaagagctcttaaagaggggtcggagcccgcccgtgagagnggagcttctcaccatgtggg

SEQ ID NO: 549510 - DNA, 237 bp, Homo sapiens
agagaaatgttgggcaggtcatgggggctttggggtggtgggaaagttctattcttgacctgcgtggaattcaaagtgtgtttgtcttatggaaacccattaagctttatatgggttaatgtgcttttttctatctatgcttacttttatcgtacgacagtttagaaggacagctgtcaggcggtgagtggggactctgctgagggtcacgtggacgggccggccccgaccacgtgg

SEQ ID NO: 549511 - DNA, 268 bp, Homo sapiens
cgatactacccgctcaagttcatgacggaggcggagcagcagcagctcatcgaggaccatttcctcttcgaaacactcgtaacacccgagatactgctcttaggcatggcccgcgactggcccgacgcccgcggtatctggcacaatgacaatcagacctccctggcgtgagacaacgaggaggaccacctgcgggtcatctccatgcagaaggggggcaacatgaaggaggtgttcacccgcttctgcaccgatctcactcagattg

SEQ ID NO: 549512 - DNA, 242 bp, Homo sapiens
atacatatacaatcgagctggtaccctcatagggcaagcatgagaggagagcacatcaagtaagtactgggccatgcgatatatcacaatccccatattgcaggtcccaggaagatatcacctagtgtgctgggcccagaaacttgtgacaatgtctcttataggcaaacacagggtaagagaggggaggggataacatcaaacatctgatgagccaagtgatatgttggcccttatccgag

SEQ ID NO: 549513 - DNA, 425 bp, Homo sapiens
gaaggcagcagcagccgctatacaccttccccagcagatgcccgtcagcacccgcggctgcggccctgaaggaggagctcagacagtgcccgagatgcccgggagacaccgcccctgtcccccatcgacatggagtcccaggagcggatcaaggcggagaggaagcgcatgaggaaccgcatctgctgcctccaagtgccgaaagaggaagctggagagaatcgcccggctgaaggaaaaagtgaaaaaccttgaaagctcagaactcggagctggcgtccacggccaacatgctcagggaacaggtggcacagcttaaacagaaagtcatgaaccacgttaacagtggggtgccaactcattgctaacgcagcagttgcaaaccattttgaagagagaccgtcgggggctgtcggagctgctga

SEQ ID NO: 549514 - DNA, 384 bp, Homo sapiens
  misc_feature (15)..(15): n is a, c, g, or t
  misc_feature (269)..(269): n is a, c, g, or t
  misc_feature (363)..(363): n is a, c, g, or t
ggatcagtcacaggnttggggggtggtggggtcaaatcttaatatgtgaaagtgccacagggcacacacaactgtagagacaaacagaatgctcatcttctggcaggcacagtggtcagacctcagatggcctcccagctctgtgtgcgaggcttcttggacgtgcattgccaagggcactgatgaagctgagtggttggattcttttgtatccacattacattgggaactctttgtccttgcagcaattcctcactgaacactcaggntggtgatgaggcataaaaagaacaggcatcaacttggaaacacatgctttaagtcagggcagagaaacaataagttgcagccttcatggcctgnactacctctagccacagtctt

SEQ ID NO: 549515 - DNA, 105 bp, Homo sapiens
accaaaaccaatatttcaacttatggtgcctttgttgctgtcagttcaaaaactacctgtactttgtttccttgatatcaaatgacgtcagagtaatatcctccc

SEQ ID NO: 549516 - DNA, 611 bp, Homo sapiens
  misc_feature (408)..(409): n is a, c, g, or t
ggagatatacctaatgttaaatgacaagttaatgggtgcagcacaccagcatggcacatgtatacatatgtaacaaacctgcacattgtgcacatgtaccctaaaacttaaagtataattaaaaaaaaaaatctcttccaattctctcccattcatccaactccatagtccctgttccaggaaccatgggcaaaactgccttactgtactaaaaagtgataacaaactctgagtcctaacttttactcccccacttcataacaaatgctttaaagaacttaagcagaatgtctgctttcactttgtcacattgttaccctggttcttccaagcactcagctttcccaccgagcttcttttagacatcttcgggtatcctttgatgatgcatcttctgctttcacatgnnctctggcgttccttcaccggggtctttgtggccccacaatttcctcccacaacaccattacacagaaggggtattgataaatattagtaaatgattaaacagattagaatgaaaaataaggtaggttttacaggaatataacaagattttacatcagatgagcacgctccccttcaaagtaacgatttttgcacaatacatt

SEQ ID NO: 549517 - DNA, 228 bp, Homo sapiens
  misc_feature (114)..(114): n is a, c, g, or t
  misc_feature (178)..(178): n is a, c, g, or t
ggcacgattcggcacgagtgtatgtgttatatgctggaaaaattaagctgggtgtggtggctcactcctgtaatcccagcactttgagaggccaaggcgggtagattgcttganttcaggagttcgagaccagcctgggcaacatgaagaagccccatctttataaaaaatgcaaaanttaaggccaggcatggttgctcacacctgtggtcacagcactttgggagg

SEQ ID NO: 549518 - DNA, 1794 bp, Homo sapiens
atggtccagaagagcggcatgtcccggggcccttacccaccttcccaagagatccctatggaggtcttcgaccccagcccacagcggaaatacagcaagaggaaagggcggttcaaaaggtcagatgggagcacctcctcagataccacatccaacagctttgtccgtcagggctcagcagagtcctacacgagccggccgtcagactccgacgtgtccctggaggaggaccgggaagccttaaggaaggaggcagagcgccaggccttagcccagctcgagaaagccaagaccaaaccagtggcctttgctgttcggacaaatgttggctacaatccgtctccaggagatgaggtgccagtgcagggagtggccatcacctttgagcccaaggacttcctcgacatcaaggagaaatacaataatgactggtggatcgggaggctggtgaaggaaggctgtgaggttggtttcatccccagccctgtcaaactggacagccttcgcctgctgcaggaacagaccgtgcgccaaaaccgcctcagctccagcaagtcaggtgacaactccagttccagtctgggagatgtggtgactggcacccgccgccccacaccccccgccagtgccaaacagaagcagaagtcgtcagagcacgtgcccccctatgacgtggtgccttccatgaggcccatcatcctggtgggaccatcgctcaagggctatgaggtaactgacatgatgcagaaagctttatttgacttcttgaagcatcggtttgatggcaggatctccatcactcgtgtgacggcagatatttccctggctaagcgctcagttctcaacaaccccagcaaacacatcatcattgagcgactccaacacacgtccagcctggctgaggtgcagagtgaaatcgagcgaatcttcgagctggcccggacccttcagttggttgccctggacgccgacaccatcaaccacccagcccagctctctaaaacctcgctggcccccatcattgtttacctcaagatcacctctcccaaggtacttcaaaggctcatcaagtcccgaggaaagtctcagtccaaacacctcaatgtccaaatagcggcctcggaaaagctggcacagtgcccccctgaaatgtttgacatcatcctggatgagaaccaattggaggatgcctgcgagcatctggcggagtacttggaagcctattggaaggccacacacccgcccagcagcacgccacccaatccgctgctgaaccgcaccatcgctaccgccgctctggctgccagccctgcccccgtctccaacctccagggaccctaccttgcttccggggaccagccgctggaccgggccactggggagcatgccagtgtgcacgagtaccccggggagctgggccagcccccaggcctttaccccagcaaccacccacctggccgggcaggcaccctgtgggcgctatcccgccaagacacctttgatgctgacacccccggcagccgaaactctgcctacacggagccaggagactcgtgtgtggacatggagacagacccctcagagggcccagggcctggagaccctgcagggggaggtacaccaccagctcggcagggctcctgggaagaggaggaagattatgaggaggagatgaccgacaacaggaaccggggccggaataaggcccgctactgtgcggagggtggtgggccggttctggggcgcaataagaatgagctggagggctggggacaaggcgtctacatccgctga

SEQ ID NO: 549519 - DNA, 163 bp, Homo sapiens
aaaccttagggaattgagagggaaactttatggtacgttacctttttccttttatatgaattattttgtacaaagttcagagagccgtacctttctactttcctttctttgactctcatgtgagagaatttgtaacggtctcgtgtgagccctaaagggtttt

SEQ ID NO: 549520 - DNA, 664 bp, Homo sapiens
ggggcaaggtggggtctcttgagggggcccaggctggtcttgaactcctgagctcaagggatcctcctgacttggcttcctaaggagctgggatttacaggtgtgagccactgcgccaagctaaaaaaggccgttttaatttttagtgattctaagtcagaagagtgggtgaaaaatggaaaacattagtctggaggttagccattttatgaggcccagttttatttcatttagactttggaaatttttacccagtccggtgatacaagttcttagggaaggtgtaaattggccggcagacttattttttaaattgggggattatcagaaaacaatggcttaatcacttccctaaaagaagaagggaagagttaatctgaaggggacctatctttgttacccttgggttcccttttaatggcactgggtttgggttttggcattttgggggtcaaactttaacctaacttctttttcccccttcccgttaaattgaccacagttgcttttggttacaaggggggtacttccaagaaatctgcgcagggggaaatccataattatgctttatggccacgggggggtgccctgagtccgatttgaggcgggcggggtcataagtaggattgactctgctgactgttacatggcgggctacatggtg

SEQ ID NO: 549521 - DNA, 873 bp, Homo sapiens
tggatatgcagcgcagatgtgggtctacgaagacgccagttcccctatcatggaagagcttagtcacctttcatgatcatgccctcgataatccagttgcttatctgcttaaccaagtcctgtatgccgtttttccgtaagacgattctagaaaaaaatactaaattgaatactagcagtttcaagacgcgtcatggaatatagaagggcggttctgaagtattcgtgccctgacatcatcgctagttctttgtcgcctcccatccctacgcatcctttacataacagaaggaggtcaaagatccctcccttaccatcaaatcaatgtggccaccaatggtaactgaacctacgagtacaccgactacgggggacttaatcttcaatcctacatacttcccccattattcctagaaccaggcgactgggactccttgacgttgacaatcgagtagtactcccgatgtgaagcccccattcgttatactacttacatcacaagacgtcttgcactcatgagctgtccccacattaggcttaaaaacagatgcaattccggacgtctaaaccaaaccatttcaacgttaaacgaccgggggtatcctaggtcaagtgtctgacatctgtggagcaaaccacagtttcatgcccatcgtcctagaatattcccctaaaatctttggaatagggccgatttacctatagacccctttaccctttagaggcaaaaaaaaaaaaaaaacaaaatgggggggcggccaaaaattttaacatttggggggcgggccgggaagatggcatagtgtccagaaccggcgaaggggtccaaaaaggcgggcggtaccggtcgggtgtcaaggcgaccccgcgggc

SEQ ID NO: 549522 - DNA, 228 bp, Homo sapiens
caagcttggtcagcagaggcgactgttgactcaggagtcaagagcagcttgggtaatgtcaggtctctgagcccaagctaagccaccatatcccctgtgaccggcacgtacacactcagatggccttaactgatgacattccttcacaaaagaagtgaaaatggcctgttcctgccttaactgatgacattcccttgtgaaattccttctccttgctcatcctgacca

SEQ ID NO: 549523 - DNA, 146 bp, Homo sapiens
atcatttttaccgtgactgaatgtcatgtgatattcatctgcagcataatgaagcccggcgctgagtttgggctacggtctccgttggcgttaccatgtgccttacctgttcccgtgtttaaaatctccctgagccgcgagagttt

SEQ ID NO: 549524 - DNA, 466 bp, Homo sapiens
aaactcacgtctgtatgtctattaggctctacaccccatgtaaagcggattaatgtgcttcattgaacaagttattggccactttaggggtgatacgaatcttatcaaaacatataggcctatgggctaggctacatgaggtgtgcgactatgatttgaaaaagttgccaaaataaagcatgccctgtttgccttcagctggtcatcattcacaagtgataatatatcattcacaactaatcggttaatattgtcgcccatcacattattatttatttaatatggcctttgcctataataaataatatatgggtgaaattcgttgtgatttacaatgaaccattatcctgcacctgtaacgagacagaggatgtcatctatgcacttaaatagagaatggaggaagcattaccgtggctcattttcaatgccagccaggcaggatatactccgtgtggtaaagata

SEQ ID NO: 549525 - DNA, 299 bp, Homo sapiens
agcaaagcaggagtatacacggagaggacatcgaacaggttcagatgaaatctcgaggcaacagaaaggccgatgaggcagcaaaagaagcctccctttcttctgcctcgtgcccctctccttcctgttatcccagcaatcctacccaagaactctcccaccgagaaagctttgctatacagcaaggagcctcctttcaaggggactggatagtcaaaaatcaaaagctcgtcctcccctaagagcagaccaaagaaattctgacatctcttcaccaatccttccatatcagtgtgcgg

SEQ ID NO: 549526 - DNA, 120 bp, Homo sapiens
agacaaggggagagttcacccgactggggaggaagagggtggacgattgaacctctgggcatctggatcaacaggagcctaacatgtagatcacctggaacgtagcatctggatcagttg

SEQ ID NO: 549527 - DNA, 209 bp, Homo sapiens
ttggtctttttgtctgcagtgaatgttcaacagtttgcccaggaactgggggatcaaatatgtcttagtggacagggttttaaagtcccttggaatttctgaaaaacttgtttgttaaaaacaaaggtaaaaaataatgcctttttttacaaaaaaaaattttggaaaattgtatactgtcaattaaagtgtttttgtgtaaaaaaaaa

SEQ ID NO: 549528 - DNA, 280 bp, Homo sapiens
  misc_feature (70)..(70): n is a, c, g, or t
ccccccccccaaagggggggggggggggtgggggacaccaaaaacatacttttttcctctcctctctttngggacccagaaggggggcaacaggagggggtggttcccccccccccccacccggggggaggagggggttttttttttttcccccccccttttttccccccccccaaggagggggccccttttgggggggggggggggccccagattggcccccccgggggatttaagaaccccaaaaaaaatttcttttaaaataaattttgggtcccca

SEQ ID NO: 549529 - DNA, 1837 bp, Homo sapiens
  misc_feature (124)..(124): n is a, c, g, or t
  misc_feature (177)..(177): n is a, c, g, or t
ttcggtgctcgccactgcgcaagactgtgagctcggggcttagtcctacagatcttcgtatagtgcgactctgggacagtcgcaatcaccagacagaagcaactccgcgtcaagtagtgatgtngagatgctgcgcactctcctacgccgctagctatatagtcgtcccgctagcanacgattaatcagagtgcatatggtcacctgcactttccctcagtagcgcgagattgcagggataggcgcaccaggtccaagagtgctgatctgcgcgattcgaaggctcgaccaggggactgtacgagcacggatgcagcacgatgggacatggagcaatcgatggtctcccgtgaatagcggttgcatggacttgtagctcatcctgagactagtccttgtggcaaatctgacgcatgggcttggcatatacctcaaattgtgacacattagccgtaagatatgtcaactctctcgaggaacaatcatcggggttgacgttgcgttgcctccaagacctcgtgtcctattgggtacttaggctcgagaaccgtgagcgaaggaatgcgcggacttggagagtgtgtgcccatgcaccaggcgatcgttcacgcattggatgggtggtttgtaatgtctcccaactccttgtatcacgctagccctttgttcatgtaatgtgtgtccccatttggacccaattgcttgggcgccagaaaagctatacatccccgtgtaaatccctttagaacagcgcgcatgcgaccttatataaaaccccctttagaacgaaatttcccaacttccttaccacaggaatgttccccactttggtggctttacgcgccttagacaaacaatccaggacgtatccccctatatccccatatttgtgagaagaaaccaccacacaaaaacaaaacaacacccacgtatgcactttggaaacgcagccgttaggacacacaacgcagtgagaacgccccatccaaagcgatgttataattaccaacagggtgtgtaggacccccctaataggtgaacacctataccagaaagagttacgcaaccatttagcaagggaaacgccgcaatacacccaagaaagatttcaccaactttccgggcagcaggaaaattacacatgggggacaggccaagcacattcagaaccaggggggatatcaacattgaaacaggggggctaacgacaaaacaggaaacgacggagcagagaacaacgggggacaacacgcgtatcccaagagtcattcttaacaagagtatcggagggtcacaaaccccaacggaaaaagggggcaaccaccgccaaaacgcgcgcaaaggcgcccaaaagacccccgtaacagagcgtttcaaacggccttaggcaacgcaggagcgaattagacatcgccaaagccagaccgaaagggacaaaacacaaaggaacagacgcagctatcctcacagggacaacggccgacagggcgccacatgtcgagcggcagcacaaaacaacgaactcaagcccgattccgtgagcacagtcacactcttgagcggcgaggaacacgaacgaggtaccacacgtccgccgcagggctcgccaaagaaccgtatagccctacaaaacagacaccacgacactgggtgagatgaggagccctcatcaacgcaacacagagacacgacaggcccctcacacaagcgccacgcacacacaagacggaggcgagcaccccagtcactcagggagcacgcaagacacgaagtatcagaacaacagcacgccccatcgtgcggacagaccaactgagagtgacaacaacaacaccac

SEQ ID NO: 549530 - DNA, 1989 bp, Homo sapiens
  misc_feature (972)..(972): n is a, c, g, or t
gggctgctggttggccggggaggggtgagcaggttgcctgaatggctgctggggtctgcgaggtcatccgagtccccaggacggacggggactcctaagaagccacctgcctgtgtttacccggcagcgagcgcgcaggtgcctcccgcagcaagctcctggcagcgctcaggaaagtgccgttgcgcctcgcgaacggaagacagaggccgttgaccatggttgtaactggcagttagagcagacaagaacccggccagtatgtcagcaattgctggcactgagggtatctacgccagagtagcctgtctaagctgattgttgactactggcgattcatgtagttcctgaagcccaactcagagcgacggcacatattcgaggaatcaacttgccagagatgtggctataagatgctggagcaactgtctgtccaaatcagagcagactaccacttgggtgctcaaaggtccttgtccctgagaaactgacccagagaatcgctcaagatgtcctagcgtgctttcctcaacggagccctgcgagcttgcgaggtagtgttatgcacgtgaacttggacaattgccactgtactgtacaacagccctggatacaggaatcggtggtgtcgactcctacgccgtcgtatcctaccttgattgagcgttacactaggtgtcacaaagcaaggaggacctcgcccatgggacataggctcacgggacttaatctaaccccagaagatcgagcatccacatggcacacgcgcacccgagcgcccaagccaaggagccagactggtacgcaaaacttctccctgagtgacacactatgacgaacggtccccacacggcacatctcaatgtctacacaaacgcgccacaccaacacacacacaagctggacagcacacctacacaacagtagacctactgcgaccacagcacgcgtctctgacatctcttacccacnaccatatcacaccatacttccccccactcaccaccacaccacccacactacccactaacaccacaaacagcgtacagaccacaacccacaagtcacacacactcacaccaactaaacgccaacaacacccacaccacaaccaccaccacccacaacagcacaacgagagcactcgacacgaccggcgacacgcaagcagtgcggagaccaacgagacaacaggaaagcgcggaaggacagacacaccgcagacgagatcgaagaacgagaggggaagcagagcgagaacagacaggggacgcgcgcaaggacgaacaggcagaacagagccgaaggagaacggcacgaacacacaacgacctacagaccaccgaccaaccaggcccgctacgacgacaccagccaaggcgcacccagcaacagacagagcgctaggacgcgagcgcagaacccaaggcaccacagcgcggaccacgcacggaccgacagccgaccgcggcagagccgccgaagatcgcgagcggcacgagcagcgccgaagccgcagcgcgagcgcgccgagagagacggcgggcggaggacgcggcgggagagacggacgagcaggcgagaggagcacgagacggacggaggacgcgcgagcgagagagcgggcgaggaagcgcagcggggcgaagccagcagcgagggcacggcaccgacgaaacagcacggcacgagcggaagcgccagcgacaagcacgagacagccacgccgaagccaagcggcggcgcagaccgacaagcaactagaggacgccagagacagcagcgagacggaagggacagagacgaaaaacaggagagacaggcagaggcgagcggcatagaggacgacgccacaacaccaaagacccacacaagcgcgacagaagcgagcgacccacggcaagcagaacacaagacagagaaaccacagagagagacaccaactagcacgaaaaggacgcacgagcgcacgaagaacacggcaagacg

SEQ ID NO: 549531 - DNA, 387 bp, Homo sapiens
atctgaggtgatctagaggatcccgtgtgtttatcgcattgccaccttcagtgagatcttgtgtctgagctacagttctggagggatgcggaggggagggagaattctcactttggaagacgtagagccatgcttttgttcattgctttttttttttttttttttttttttaaaaaaaaagggttttttttttggcgcgggggtgggggggcgggggtgtgatcatagctcaggggagcctccacctcgggggctcaagcaatctttgtgcctcagcctcccaggtagtggggactccgggcttgcgccacagtgcggggctcatttttaaaagagaggggggctctggctatgtgcgcccggggtggtctcaacctcgggggctca

SEQ ID NO: 549532 - DNA, 1315 bp, Homo sapiens
  misc_feature (690)..(690): n is a, c, g, or t
  misc_feature (1191)..(1191): n is a, c, g, or t
tctgcctgtgtcgtttctgtagcctctgttttgttactctattgctccttgttattcgtgttgtgggggcgggtgttttgcggttgccccggttcccccgctcaatgttttttgtggacacactttgttgtgacagggtttgttctcgtggcgtgttatgcgctttttgttggtaagccccgctgttttagacccattttttgtcggcgctcttattttatattctccttgtacagaactgcttttgttgcaggatcaccgtttttcgccccccccctttttgtaagtatgacacacaaagggtctgctgacaggcccacaccagtgttttttcccggcgccattaatgtgttctaatagaatctccggcacccttgtggccgcttcttttgtgaagtaaagagctgtgttgttcccccgcgttttaaccgtggtattaggcacttctcccctcgacccattgtcgaatttctaagttgctgtctccgcctgcgtcggatttggtaacacattaggccctggcccagctttttatgattccccgccactttgctaatggatggaaaatatttggggtattgcccctccacggaaatttctaggaagaatcttaccccctggtgttttcctcacagaactccccaccccctgtggtttggaccactcctggttggccccggtgaggggagnctttttctgagcacacggtgagattatttttagcctctccataaatctaagaaggttgccacagcaccctaccacgttaaatttagtgtgtttaatatcttggtgtgccacgagagtatgtatttatcctttgtataatgtcacagaatatgaatacccctcgcaccactattggctctttgcacacttcttataaatgttgtgtgtgaactaaatgaaataagagaaaatattgtataatttctcttgaggtggtggaggctcttgaaataagatgcgcacttaatccacctcttattgttttgtttaacccacaaactcttttgctcccattatttctgattgcccatagttatttctggagcccagtcctcatgccacaataattcttgtataaatagtttgttatgggaagattaaattttactcttgtgtggtaagactatttccagttactgatatttataagttggaatattgataattcccagccaccaagtncccacagggtgatatccaggaatcccagttggtcgtccataaccatttccattttgatagtgaacattttttttgctttcctttgttttaagactcccttttgccataaacgttttgaccagta

SEQ ID NO: 549533 - DNA, 209 bp, Homo sapiens
ggcctgaggccctggaaaacagcattccttctgcgtggaacatgccaaccctcgtctgcgactttgcaaaactgcatgagaccgccgggcgcggtgctcacgcctgtaatcccagcacttcaagaggccgaggcagacagatcacctgaggtcaggagtttgaggccagcctggccagcatggtgaaaccccgtctctactaaaaatac

SEQ ID NO: 549534 - DNA, 749 bp, Homo sapiens
ctgggagcgcccgcgtccggaatctcagccgccgtctgagggctgaggcagcgtggggacgcgtgcgcagggcgcgggctggccgtcgcggacgccgctccgggcagccgagcctctgtgggagccggggccgcggcggcgcgggtgctccgggccgaggccgcgtctggctcttgctgattgaattcctttggtgcagtttagcatgttcctctgtgttctgcatctcctgtagtgtactgttcaagctcagaaatgccttatgtggatcgtcagaatcgcatttgtggttttctagacacttgacagaacacatgacaaacagtgggaaactttcttcgaacggtacttcactactggataccagagaagatagtttcgtgtggtacatggcataatccacagaacctaccttctggatcatcacgtgtcggagccattaagcttacctacatttcaaaggttagcgatgctactacgctaaggccaaaggccggagttctgtacagtcatgcaatgcacggacatgagcgaagtaccttcctacaagccaatgactcagcaggaccctagtggcaatgggtacacatgtgctaaaccaagctatacaaaattacagtaccaaaggcagtcagactcacagcctaattctgatcacctaaagtcgccatggtgcactgtgggaaacccgcaagtgtctaacagacactgatatggtcgggtcggcgtacccagtcattaactcccac

SEQ ID NO: 549535 - DNA, 633 bp, Homo sapiens
cgagagcgggatcgcgctcctcggtccttcctccctcccctcttgcggctcccgctgtcatctggagccgctcctgccgccccctggcggctgaccgcgggaagggccggcccccatccgcacccctgacccctgcgaggtcaacaacaggcgatggtccctgtgtgtcccagtggtgaaagacgactatcacccaagtaggacgtggaagtacaggtctaaagacagagtgccactgaaggtgctgtggagcgtggggccgacggatgcctggggacgaaagttggtgcccaccaatagacatgtgtggccacgatcggtgtggatttcaaggttcctttaccaatggtttggaatggaatggtgcaccacaacaaccgggtggtggaacggaacgggcggggcctaggaggtttgagaagcggaaaacaccaaaatggtgtgcgcgaccaccccttggtcaaacaaccgttttttcccacccagggcccctgggcgtttcttcccaaagattttcccctgtttattttaaaggttttcccgcccctcttgtgcggcacaaacaagccaggcggtctttcccccttttggggcagagttgtgaggggaggctgggtgaaaacacgaacccat

SEQ ID NO: 549536 - DNA, 346 bp, Homo sapiens
aatttctctctgtgggggtggaggggggcggcatgaggctgtgacacaggcagattaaagagtgggagggaacgggcagccgggtttctggaaatagttgtagctaaaatcagcctctcagtgaaggttcctgcccatcttaacttgaggatagtgtgatgtccggaacactcagacgcgtggcccacagtgaagtgagtgggaccggggggtccagttcctgttggcatctggctcgtggcacgctagtcaggtgtgccccacaggaacgctgcgccatgagagcatcgtagcagaggcatcctcggttccactggaacagacgtttgccccacagagagagcgt

SEQ ID NO: 549537 - DNA, 219 bp, Homo sapiens
aggccagcttgcaatgttctttttccggcgctgctcttccgcagttcccattcgggcagccagcgcacaatgtctcctgtgtgaagccagccatcactgtccaggcttcctgtgtcttctcagggtccttccggtctcctttgaacacgtttgtccccttgtctgcagacctctccttcattcttcactgtaccgtagttcatgtcagccaccatcttg

SEQ ID NO: 549538 - DNA, 377 bp, Homo sapiens
tgcgggtctcttcgaccaatatggagaaaccctatctccactaaaaatacaaaagactagcagggcagtggtggtgcatgcctgtaatcccagccacttggggaggcagaggcgggcggatcacctgagatcaggagtgggagaccagcctgaccaacgtggagaaacctcatctctactaaaaacacaaaatggccgggtgtgatgacgcatgccggtaatcccagctacacagctaaggcaggagaatcgcttgaacccagaggcagaggtggtggtgagctgagatcacgccatggcactcgagcctgggcaatgagcaaaaagagcaaaactccatctcaaaagaagggaaagcaaacaaaacctcccagccg

SEQ ID NO: 549539 - DNA, 299 bp, Homo sapiens
agcgtatgctgctactactacccattcttcaggtatttgcggagccactaaacgcacaggccatccaggtaggctctcagcttgctccgccttcacgggccgcctcccacttgcgctatggtgatctggagcctgccatgtcctgccgctggtccaatgagcgcagtgtcctcgattcagggctgatgtaatccttgcctgtcgtaggcgtcctgccggtacccgcggaggaagcgcccgtccgaccccacgtcgcagccatacattatctggatggtgtgagaaccggcctcgctctg

SEQ ID NO: 549540 - DNA, 155 bp, Homo sapiens
gggcgatgatagcgacttgcgggtagactcaaagaagtactgtactttcccaggacgactaataaaggccagtggtggaggtgggtggtgcagaaaataacaggtcagccggagtttcccttgtggccctggcattatagaatatcattctagct

SEQ ID NO: 549541 - DNA, 94 bp, Homo sapiens
ccccattttaaaaaattttggaattcaggaatgtttaaatagaaaacccaaaattcatgaccatttctaagagaaaaataaatataggatttta

SEQ ID NO: 549542 - DNA, 145 bp, Homo sapiens
gtgccactataggccattcatctgaataattcacataatatatatcctttctttattaatctttttattttatcctaattactaccgcattcctactactcgccttaaactccatacacgcacgatcgacatcttgtgcacctca

SEQ ID NO: 549543 - DNA, 134 bp, Homo sapiens
aggccaggaggaaatctcaggcaatatatttcaagccagtccagcatctctggccatcccgataaacgcatgcctctcactgcaatgaggttggctggagcatcaaattcagctcatactcctttgtccaggca

SEQ ID NO: 549544 - DNA, 131 bp, Homo sapiens
ctctagaggactcccgttattcacataagtgagaagaaaagctgagatcgagctttgtatgggcagctgagagttcagagtctctccataagtcctacttctgtacacgatattttgggagtaccgagcat

SEQ ID NO: 549545 - DNA, 214 bp, Homo sapiens
atctagaggatcccggatgggagatgtctggaggatcagttactaaaagaattaaacttgggtgggccaggcacaggggctgacaccggtaatgccagcagttggggaagccgaggcaggtggatcacctgaggtcaggagttggagaccagccgggccaacagggtgaaaccatgtctctactaaaaataaaaaaaggaggggtaccgagctc

SEQ ID NO: 549546 - DNA, 316 bp, Homo sapiens
catctccccgaatttcaatatcatacatcatccggtaggccccctcctcaacagagtcatctgcacctcagacagaatctatctacaaattagactcatcttcctgcagggagcgggtggtctgcccctctgctgaataattattcttccattcatcgctgcttgtctcgctctgctccttatcaatttccacgaggtcctccagaagagaatccacttgttggtattatctgggtcacctccttcttaatggccagaaggtcttctcctttcaactctccagagcttggatagaagaaatgagatggtaggaagg

SEQ ID NO: 549547 - DNA, 142 bp, Homo sapiens
atagtcccaggactctcagaggtggaggtgggagcatcatctgaggtcaggagtttgagaccaaccggtggcaaaaccccatctctacttaaaaaacacaaaagtcagtcaggcgtggtatcgcacgcctgcaataccagca

SEQ ID NO: 549548 - DNA, 176 bp, Homo sapiens
  misc_feature (20)..(20): n is a, c, g, or t
gccagagtcagcagctgggncagatgggagaccatctctacaaaaaatttaaaaattagtcaggcgtggtggcacttgcctatagtcccagctactctggaggctgaggagggagaactgcttgagcccaggaggttaaggctgcaataaaccgtgatgtagccattgcactccgg

SEQ ID NO: 549549 - DNA, 244 bp, Homo sapiens
aactcgggatgactcgtaccagtagatcacataaaggtcacaaatgacatgcatattgaattgaatacataccaccagaatctagtgaccatctacgtgtaggtcgaaccgcatcactgtaagcatgttctggcacgactgatgaacttcataagtctatgacaatcgtatggtaatgcaataatttatgaaaacattaccatgaatttatgaagtaattccataatttctgtgcccatttcaa

SEQ ID NO: 549550 - DNA, 306 bp, Homo sapiens
gagtggtggttgtcgcttgttgtggcccatgagagctattggccatggttgctccatctcctccatcagctcatcagaggccccctccgtgaagattgggtgaaccaatatacatccgggcagtgcagtctccactagcttccctgcctgtgctttggttgtaattcttggtggatgtacttctcctctccatgtcctcgtggttgctgaacacctcccagaggtcgtagagcagttgggtggtgcgaaagcttgtcatagggaggacagatggccaggggtgtgccggatgggcaggaacatgaa

SEQ ID NO: 549551 - DNA, 175 bp, Homo sapiens
atcctcactaagtagagatcttgtaactcttcgcagggcacaatcttacttctttctgaacagagtaccaggctggagatgcagctgagttggtatatgccttccctgcctcatgccaaccacaggctgcatctacagcactgtaaaactaggcatgacagacctagaatcccag

SEQ ID NO: 549552 - DNA, 414 bp, Homo sapiens
  misc_feature (114)..(116): n is a, c, g, or t
ggctccagcaacagcagcggccggaagacgcggaggatggcgccgagggtggtggaaagcgcggcgaggcggactgggaaggaggctaccccgagatcgtcaaggagaacaagnnnttcgagcactactaccaggagctcaagatcgtgtcccagggcgagttgggccgattcatggacgctctcagggagccgctcccggccactttaggatatacttggttacgaaagccacgcaaaagagattcttcatttctttaaggacacatattttatgggattggaggacctcgaggtggacggtcagaaagttgaggttcacagccactcagttgtatctcatgagctttcttgtacacaaatttagtgcgaattcttggtgattgcacacttgtgaagtttatcagtttttgtt

SEQ ID NO: 549553 - DNA, 545 bp, Homo sapiens
actagcaatgacctggatcttgccaaagctagtggtcagtctcaatgtaatgtatctaattatgacctctctcaccagcatatcacagatggccaactttactagttgtgacctcttagttgttcattctcattgtctatatgctttcgccagttgatctctactatcccagtccttgaaaatttggcatgtccctcaggtgatttcatccaatatgaggtatcaaataccatttatatgccgatgaggctcaaattctaatttctagtactgacttttatcccccttgcgctctagactcttgtaactccatgcctctccttggatgtctaatggatatctcacaggcagcatgaacaaaggagggctatgaattactcttcctgttggtgacttcttcctctacctcccccaagtctttaccatctcagtaagtggcatcatcatccaccacttgcgcaggccagaaccccggattcttcctcctccttgatttctttttatcctcctcatctcatgttaagtctggtcacctccttcatgat

SEQ ID NO: 549554 - DNA, 120 bp, Homo sapiens
catgatgtataaacgcaagccatgcattcggcatgctacaataaaaacttaagctgagttaaacttaaaggagttttatacgagcaatgactgattcgtgaattgggcacccccagaatg

SEQ ID NO: 549555 - DNA, 475 bp, Homo sapiens
gcgtttctttgcgttctggatccattggacaggtgatcttgtgtcaactcttagctctgtattgacctccaaatcttagttactatcacatagttctcagctattatcaaattcattaggttgaacagcttccgagccattagctctgctgccaggaggcaagcgaaattttctacgaagtaactcatgttacgtttctgcacatacatttcatccggttagcttatgtcaaagcaacttccaggaacagatccacaagcagattttatcctcaccatcatcatactaactttggcgaatgtatatcttcaccattgttatcatcatcaccctctccatcaacctctgcatcatattcaccaaaaacctctccatcaacctctccatcatcatctccatcaccctctctatcatcctcaccatcatcctcaccaaaaccctctccatcatcatctccataatccgcaccaaaacc

SEQ ID NO: 549556 - DNA, 102 bp, Homo sapiens
ctgagctcacgatagtctaatagaaacaccgaaacaataattcaagcactgcttattacaattttacttgggtctcaattttaccctcctacaagcctcaga

SEQ ID NO: 549557 - DNA, 153 bp, Homo sapiens
ttttactatttatatatagagacaatcagcatttgggatagttttacatgaccagttatcaaacggtcatagtatgaagtgtgcagttgttcattattagtaattatgttgattttaactattagaacaatagtgagatgaaactgagaaaat

SEQ ID NO: 549558 - DNA, 165 bp, Homo sapiens
agccttaccctgggacagaaacaagatggtcgatagagaaggaagagtggctgctcagatggggtggtccagaggcctctcgggcgaggtgactcctttttattttattttttttggggcatggaatctagctcatgtcgccccagccttgaagtgccagtcagt

SEQ ID NO: 549559 - DNA, 106 bp, Homo sapiens
ggctcaagttctctgcatcagaccaacacttgtctgttgtctgttttttctttgagatggagtttcactctgttgtccaggctggagtgcagtgacgtgattgcag

SEQ ID NO: 549560 - DNA, 271 bp, Homo sapiens
aaaggaagccctaagtaatctacctgacattgaacacagatgacagatgatactgacagacagcagtgacagcgacagatgactaccagatgaaggcaaatgaaagataggagattcaggagcagcaatggtactcaccatagctgctggaaacacacctgagaactgagatatacccatctatacccttgttacaaagaagaaaagatacggattaggtagaataagtaactgtgaagtacagtcagaacacagctgactaatgaaaata

SEQ ID NO: 549561 - DNA, 97 bp, Homo sapiens
gagacggagtctcactctgtcgccaggctagagtgtagtgagctatgattgtgctactacactctagcctaggtgacagaacaagacactatctcta

SEQ ID NO: 549562 - DNA, 304 bp, Homo sapiens
tgcaagatgagagccgtggaatgccaatggatccaaagttgaacaaaagacgaggttttgtgtatatcaacctttaacagaagaagaaccctgtgaagaaggttctggcagaaaaagttccatactgtcatgtggaagcacagtgtgagatcaacggtggcccatgcccaaacgaagtctatcacgcagcagcagtattggctcctgggggcctgtggaaacctgcaaccgaagggaacctgaggcagcggagggtggtggttggagtgtggaggtcagacgtcacgagtttggaatcacgggc

SEQ ID NO: 549563 - DNA, 159 bp, Homo sapiens
  misc_feature (73)..(73): n is a, c, g, or t
agagcacaagaggctgcgggttattggctggatgtctctccagctgtcagcgctttggagctctgcaccgtgnctggagcttctgatccctcctccagccgagaacggatcgagctggagtgcactgcctctggtgctgcctcctccttggtgccctgg

SEQ ID NO: 549564 - DNA, 424 bp, Homo sapiens
  misc_feature (1)..(1): n is a, c, g, or t
  misc_feature (76)..(77): n is a, c, g, or t
  misc_feature (82)..(82): n is a, c, g, or t
  misc_feature (92)..(93): n is a, c, g, or t
  misc_feature (185)..(185): n is a, c, g, or t
  misc_feature (218)..(218): n is a, c, g, or t
  misc_feature (241)..(241): n is a, c, g, or t
  misc_feature (294)..(294): n is a, c, g, or t
  misc_feature (306)..(306): n is a, c, g, or t
  misc_feature (315)..(315): n is a, c, g, or t
  misc_feature (326)..(327): n is a, c, g, or t
  misc_feature (412)..(412): n is a, c, g, or t
nggtgtcattcttctagaaccaggttcatttttccagttttgtagaaaaatagatgttccagccaccttttacttnnctgtntagtcttttnngaccaatcagtatgttccctggaaaggtgaataagtctcatgactaattttttaaaaattctttaagacaaagaaataactttctttttttnctcccaaagcacagtatctcaacagcagcagcnaacatggggttttagcagcttanctttgccccctaaatacagctttgtatgaggccagtgattttacgtacaaaancaccactgtccntggaagaanggggtggcagnnagacatcgagtgcaaaacttggaatgattagataagtaaacatggcacttacaaaaggtagcttattagaatattccacttaagnaggggttacttt

SEQ ID NO: 549565 - DNA, 479 bp, Homo sapiens
actctagacgatcccggtatgtgtggtgttatgctagagtcaccccaatggtgtgctcagctagagacttgcacacgagacacagatggtgaggggtctgggtagctagcgctcacagctccacaaagggctttgtcatttgtggagtgaccccctttcctcctgcttctggggactgcacctgccccctctgtctctctgtctgtctttctgtctctgtctctctcttcagtgaagtatagctgacacacactgttataccctcttctccgctggggttattgcttcccagtgtgtgaggtcttggagggacaggccagattttactgccctccaaagagaagccaaccagcctctttattctcaggatctggctcatgtgcagagaacttggagcctgaaaaaggtgatgctccttcagctgtaggggacaccctgagccactggccctccataacaccacacaattccggtaccga

SEQ ID NO: 549566 - DNA, 192 bp, Homo sapiens
acatttttttgagtgttgtagaaaaaaaatatgcgacagtactatgtggtcccataaaacctaaaatatttactatctggccctttaaagaaaaaatttaccaactgatgccttaagtctcaaagtatacaatccttgtttcaagttgaaggtcttccttagttctgcatcatcctttagtcattctccagg

SEQ ID NO: 549567 - DNA, 408 bp, Homo sapiens
atgtgtgtttactgtggattggtccctgatggctcctttgtttgagaacatgtgaaccaggcaccctggtttgtttggagcattgctgcccagaagcttctatgggataggtggtgcttgggtttgatgttttgtggccatgcagccctccctgaggattgacttctgcactaatccagtgttggaggctgtgtcaaaagaaggctctgaagacctcttttcagaggcaatgattcctgtcagtatgaggtcccttagttactaaaaagggacttgttttaactccagtatgatgatcctcctccgagtttactttatagtctaaaaaactaaagttttcttctctttaatgaaagatttgtgggtaatgtgccttataaattgtatatttgtttgattataaaatta

SEQ ID NO: 549568 - DNA, 104 bp, Homo sapiens
  misc_feature (2)..(2): n is a, c, g, or t
gntaactctggctcaagacatcctctacagaggacccgaaggtattctattaactttgatttacaactgcctcacaacaacacccctgtgaggtaggtcagtat

SEQ ID NO: 549569 - DNA, 735 bp, Homo sapiens
tggacaaggatgctggtgcgtgagggaccaatggcctgcccgtgcactctgggcctacctccagaccacggtgctgatccagtgcacttctgacctgctggccagccaggacctgtgtgggtgatggccctcctgctgccttggggtgacaatctcagctccatggctacatgggatgacctgtggaggatcacagatgccagcatgttacatggatcctgacagtgatcaacgctctgaacagcctcgtcaaggtgattctggataaatactacttcctctgctggtgcatgcctctccagcttcatcccgaggaaggcagctgtgtgactggacggagctgtgcactgtccacttggtggcgcaggacgacggagcactgtagtcaagagcttccccgaagggcctgcagtggcagtccgcctctccaaggaccgatccacactgcagagtgctggactcggccacagggaactggattctctgcctgttgtcgacaagcttcacagaagctctcgcttgagacaggcctgtaggcagactgggctacagctgagaaacccactttcagcagcttgtggagcacttgtccccatgaccaggatctgcgatgtaggttgaaatcacagacaaacagccaggagcttcgcatgcggaactcaagctgggccctgactctcaggctccctggtacaccctgaactgtctatgcctgtgggaagagcctgaatgatc

SEQ ID NO: 549570 - DNA, 514 bp, Homo sapiens
tctataccatatcattatcttcaaggaaggtctatccacccaagacgggcgccaggtatatcccattgctaatgtttgaagcaatatattataatgagtggttctttggatttgtaagtcggcatcattcactgagagtgccataatgtaagaatgtaagacttcatatgggtagtctaaggctctggaagtcactgctttcaggccctgattctgtcatttatatcggctgaataatcttggacatgtaatataacatctccatgtctcagtttatatgtcgaaatggagatcgtcatgatacctacaggattactgtgagaattaaacgaagttaacatcgggtaaagacttgtacacagtgccgggcacacaagtgcagagtcagttttagcagtcatgattgtaactattactataattatttagtcagtcattcaaatatctatagagagcctactaatgtgccgatactgtgcgaggtactggtgatacagcgatgagtaccacagat

SEQ ID NO: 549571 - DNA, 133 bp, Homo sapiens
ctatctgcccttgttgaaagaacctaccagctaccacagcagcccgggctcacttgcaacaacacacttcactgacagctccacaagctcaggcctctgttgaggcatctacacgcttccacagcagccctga

SEQ ID NO: 549572 - DNA, 162 bp, Homo sapiens
atccctgtgtcatagtttgatgtctgcctctgcaggcttgcggacatacttctggtgagcactgtgcggcaacttgaggataaatcagtgagctgcatcacttaaaggcatggcctgtctcctcacttgagtagcaggtccatcgaccaaagccctgttctg

SEQ ID NO: 549573 - DNA, 181 bp, Homo sapiens
gcaggaaagtgatggctgtcgtccggcgtctttcaggacaggacgtgggatcatttgcatatcttacaattaaagacaggataccacagatcttaactaaggtattgatacattgcatcgacataaaagtgaatttttttgagacacacgggggaggagggcgtggagcttaaaagaaagc

SEQ ID NO: 549574 - DNA, 288 bp, Homo sapiens
ctgcaccacagcgaatattatttcacacgacatattacaacttaaccattaaattagtacttcaagttgagcctatgtggtgcgactctttataaaaaatgccttttaacagcattaatggctaattgaagtattttatgtctcctcattcctggcccagagggttgtctttgaaaccctgcttctaacccttgtgtagtgtgtttctgtgtgaggacagtgggtgtgtactggcctcccgggagccactgtgaccaggcctttgagctcttgtcatctgtggagaga

SEQ ID NO: 549575 - DNA, 104 bp, Homo sapiens
gaggggtgtacccatgaactgggtctggttcaccgtaagatgggaaatacacagagagcactgttgtacttggttgcagccctgaacgagggatcagcctggtg

SEQ ID NO: 549576 - DNA, 747 bp, Homo sapiens
atttggccggagatgtcccgctccgtgtccttagctgggctcacgctactttgtgtttctgtcctgttgggtactcagggctctccaaagatctaggttgactcacgttatccaacagagtacggaaaggcaagttacgtgaattgctatgagtcggtatttcatccatccgacatcatacgtgacttactgtagattggtgagagaagtgaagaggtggggcattcagactcgtctttaatcaaggtctggcatggtcatctcttgctctacattgaactaacccgcactgaaccagattggtatgcctgccgagggaaccatgggactccatgacagtccaagacagccaagggtggtcgagacatgtcggcacaatcatgcaggtttgtggatgccggatgaggcctgattgaattccaaagaatgccagcttgctcttgattactgatatgcttagacactcacactctatgcccatattggcgcattatgatagtgtttacaagggcatgcacggccatatacttctacttagagcgctgtctacatgtgtgatgattctgggcaggttggtccacagtgagctataggagggcttacaacttataggtgcttagcagaggattctcttatccactataacatactggacagatttggactgttcaaacctttgcactcaaggttgtcaagtttgttagcggtgatagctaacttacattaacatcctctgcttacaatggg

SEQ ID NO: 549577 - DNA, 144 bp, Homo sapiens
aggaaaatgattttctatttccatgagtcatggtttgtaggttttttccttaattttattttgtgtttagagacagggtctcgctctgtcatccatgctggagtgcggtggcatgatcatagctcactggagccaggaactctg

SEQ ID NO: 549578 - DNA, 156 bp, Homo sapiens
tgactctagacgatccctatcgggtagctaggattacaggcacccaccaccacgcccggctaatttatgtatttttttgtagagacggatttcaccatgttggccagggtggtctcgaacccctgtttctcaagtgatctgcgtgtgccagaagga

SEQ ID NO: 549579 - DNA, 185 bp, Homo sapiens
  misc_feature (178)..(178): n is a, c, g, or t
tagagctgcgtccactacgccacggagaaggaccgggagatccgtaggcgggcattgcctgaaggcatgcttggcaatgcctgcccccccttctctttctccgccgggtccctgcaagacccttgtggcttgaccgaacaacctggaaggccacgtctcccaggctcccttctccgtngcgtggt

SEQ ID NO: 549580 - DNA, 1048 bp, Homo sapiens
ggggaggttgttttaggggtccgctggtttttgttgcggcactcgtttctagtgctacttattttttggtgggcactcttccctgccctctttattgttatgtgtgtttctgggggtcctgggagtattttgtgtgtggtgccctctgcgcggctctcccgggggttgttcccccactatagctcctctttttccacgggtagtcttttctgcgttcgctcgcgcgtagggggctcccgaatgattttgtccccccaccgcggtggttctatttcgtgctgtcgctcacatttgaacattgtttcgcccctcggggggtcccccggtgtcttctcttggtatgagaaagagcgttggtagagatctcgcgcgggtgtgttgatttggagacgccccgactcggccccctctcttctgtgtgtggaggcgctgtgtgaggtcccccctcctttctatagaggggttccactctgtgaagaataggctctcttagggtttggtctctctccccccgcgtgtactctctaggtataggctctgttttgtgagctcgaggatatccctgcccctctctgtgttcttgacacgacacgcttctccttgagaagagaatatttctgtgcacacatattttgcgtccccaaaagtctttgtgtgtgagacaacctgtgtgtagacttgccgcacaccagttgttgtgaagaagacatgtggaggcatgggggtctcccccacgtgggcctgtgtcttctcctgcttgtggcggagggcgctctttctcgctgtgcacccactccacttgaaggagatagtggagccacttactgtcctcaaataaatgttcctcggagcttgcgtggaagagttggtggcgtgaggcctcttggataatttgtgcgcctctaggttactagccactcttctgtctgtgttggtggggaacacatttttgtcccccccccagatccttgtactttgtctcgaggcacaccttttttcccggttgctccctttttgttgttcgaggataaatttctataattataaa

SEQ ID NO: 549581 - DNA, 585 bp, Homo sapiens
  misc_feature (2)..(2): n is a, c, g, or t
  misc_feature (24)..(24): n is a, c, g, or t
  misc_feature (117)..(117): n is a, c, g, or t
anccaacccaggatgctgtgcatnggtgcatagaagagtcaagcactcacactggcccattctcccagccctcctgacatgtttttcagtacagtggggtgtcaccccacgacgatngtgatgagtttgagaagggtagccctgatcagtacttagcaggattgctgagccttgctgagaacaacaaaggaaaagttgttgcaataggagaatgtggacttgattttgaccgacttcagttttgtcccaaagatactcaactcaaatattatgagaagaaatagagaccggtatgtgggtggagtgctctctgaaaactgaagctaacttggaagttctgaagtcaatacctagtgaaaaactaatgattgagacagatgcaccttggtgtggagttaaaagtacacatgctggatcaaaatacataaacgacttcatttcctaccaaaaagaaatgggaaaacgggcactgcttaaaagatagaaacgagccctgccacatcattcaaatattggagataatgtcagcagtcagagaagaagacccactggaattggccaacacgctctataacaacaccatta

SEQ ID NO: 549582 - DNA, 731 bp, Homo sapiens
gaggaggaagaggaggtgatggcgacggaccaggagaggggggagatgctccgtcttagctcagacgccatcgcaggctgccgtcacccttccgggtgacataccggctcttggggccatgattgattccggagcgcagattaatcaaggcataatggcgtggacttgacacagctagcgacagacatacagacatcataacagtccaggaaaccaatcaataaataatctctgaaagcagttgaagtgcagcgaaataacagtggatctcaagttcagacaagttccaggtgatagatactatttcgtagtcactgtgccatccaaaatccaaacgaatgtcagccatcatcattcaggtcagttgacgacgttgtggtacttggcatgaatctcagcaagtttaacaaacttactcagtttttcatatgtgttgctggagttttcgtattttacctaactttatgggtatttacaggaattgatatcttcagtggagggttccaagtcctgtggctggtaccttaccttagtgcagtttgccttttactccatatttggcctaatagaacttcagcttattcaggacgaaccggaggagaataccaggaaaaacctacatgataagtagcttttctaactgtgggtactatggggttatcagacacttccttgggctaccctgaattaccctacccaagtcatcttcaagtgctgcaaattgattcctg

SEQ ID NO: 549583 - DNA, 891 bp, Homo sapiens
ccccgtgcctggaaagggtccagaagggggcccaggacgcacgggggccccaaaacattctctggaccttaaaaccccaaaaccaggcccatcccccccaaacgaagccacaacagaaaggaggccaggttgtgacttggaactgggaggggccagcaatgggagcaatgggacaaatccagggcaaaatggtttcccaaccctgggtgcattgcagggacaccagcgactgtaaaccaggtgggcttaccatattccagatggtggtccacacggacaattggccacatccaaggggccaaacattacactctccattaccaggtagcatatactggttagcaaacattggggcctggggtattccggatggacggtgggtggggccattggtgggagcattcatccaaccaggtacagggatggtccacaggttccagggttaatgggggtaaaggtggccaaccccatattccatccaaccaacaaccagcatgggcgtggccatggccttaccctggaaccaagcaatttccctgggcattggtggaacatagatccagtgggcaaaatccttccggagcatgcaatggttcgtccatttccgtaccggaaaggcggggtggacctttcatggacattccccaggttccctggaacacgattcccagaacccctgatgggacacggggccagaaggttgggtcccccaccagtggacgcaaacttgggcggggataagcgccaaggtgccacagtgggttcctatggcgcctcccctttatacaccaagtggaataaaatcgggaatacagggggtccttttccttttccttctaaccttttaggctcttaacaactgtcttctccgtcacctaggtgcccaggttc

SEQ ID NO: 549584 - DNA, 307 bp, Homo sapiens
gttaactcagctactctttgtggcttctacatggcttctattcgggggctgccacgcccatttttatcaccagaatgaggcactcctggaagctaactagcaccatcagatttagatatcccaactctttgaaccatgacgtctgctaccctttatccttgatatactagaggacactcggtctactagcaatttcttcagcgtcatccctagtagacggcattggaaacttccccgtttatcacgggagtacttggtggtagacgtcgatgcatagagtacaaggctttctccaatctgtcaatca

SEQ ID NO: 549585 - DNA, 1339 bp, Homo sapiens
ggagcaggtcgggcccgctaggcagcgagccgcagcgcagtcccggcgcgcggcacaaggaccctggatgctagcgattagcccgcacgggcatgcgtgggcgccgatgagcgagcgtctgggcacgtgaattcgggacaaggtagctagcatctgatacaggaaacttggaattgccagagcccccaagattgcgtacgttagtcgcctgtaattgtcgcggaccgaggcacgactgatcttgttggtgacatcttcgtcatcgtagcagggagccacgggtagcgaaacggcggctgcaagcgattgtgttccgagccgacagctcagttgtcacccgaggcaggtgcagagcctaatctaccagaacgcgagatagcagctcgagggtccgatgctcgcgactctagtgcttttgttctagaattgtgatgagagctaacccaagtttccattgcaaagactcacgttgagccacgtcacttggacaacgacactgtcggatggtttcatgactcaaagttgcattaacgcctagtgtttttgaacggggggacccagaagaggtcttgacaatcgacttgggtcacagtagtcttatcctatgaaagatggggcattgtggttgcggaacaaatcaagagccacgaataaaggaaagcaaggagtaggtcaccttgaaagcggagagtgagcgcaagcgctctggggctcggacacaggatctcccggtggacttattcacttgggaaaaccccctgggaccaagagttagagatgtgggctcgtgcaccaaaatgatgggccattgattgccctttgtggcctagtcacattacattcgcgtttgtggtaaacaaccaccaccaatataacttggagggtattgtcttgcaagtgcccctccttaggagcgaccaacatttcggcagcattagtctacccaccttgggataagtatcctagtaacgctaacccacaaaggcaggagaacgggtgcgcataatccccttggaacacaggtggactggcgcacatttgggcactacatgtttcagtgggcacactttcccaaccaatcagcggcaaacatcgtactgcacgcgcacaaagttttccttgcgcgataacttacagccggacacgcctttggcgacagggggacaaaacccctatgtggcgttgcaccacaatcaccagggatgtagtgggcacctgtcacaaacacagccctattgagacgattgtgggcacggccaacaacctctttcggtcacaggatgatactccgagcgcaagcccaacagtgacccagaggtcacacctatagaaagatagg

SEQ ID NO: 549586 - DNA, 365 bp, Homo sapiens
tccctgactcacctgtgctgcttctcctcccacatccaggctaccctgtcctggttttgttgctaggtgctcttctactcaacctctcgatacggaagaccctccaggttggacttttctcatctctctgtccccgctccctgggtgatttcctcctcacctttggctttgaacatcatctacatactgatgatgcctaaacctgtttttccaatccgccttgctctgaagctccaggatcccacatagccaagtgccttccttaaatctccacgtggcatcctcacaggcagctcaaacttcactgccaaactcaacctcttcttcttcctcctcctcctccatattaagccagcccccttcaa

SEQ ID NO: 549587 - DNA, 101 bp, Homo sapiens
atatgatagaaaataccctgataccaaggctttagctgcatgattatcatgtgactattatatccacccaattaataatccttccttctttctctttcttt

SEQ ID NO: 549588 - DNA, 265 bp, Homo sapiens
tagcagggatagggcagaggatggacagctctttacagctgtgaagcatctccaagggcagttctgtagccacaggatccaggttatttctaacctaccctggactaggcagtggcattgtgacttttgtaatctccaccgtcctccggcacaaggcactttagtgaaaggttgccaaagactgtgtcatcctccacggtgccaccctgaagcctgcttcacagctccctgcggccgttggaaagagggagacagtgtgtgttga

SEQ ID NO: 549589 - DNA, 387 bp, Homo sapiens
  misc_feature (319)..(319): n is a, c, g, or t
ctgctccagccctgtcccagacattcctaatgacttatgttcctgtcagacatccttgggctcaacatctctttctctaaccctgaccagaaaaagcacaaaaatcaatcagtattttaacaatgtctgtgcactggggaggcatgatttcttgcttattgcaggatggtttcgcttctcatcttgactttgcccttcgagatcagcttccgggtctaattgtgtctgtcagatttgcaagaggccacttcgggtttgccaaatagaagaaagtctttctgagaggcctcacttgatcaccccagaaaaatagtcaccncacccttcacctgttgctctttaaccccttaccctcctttcttttctttgtggcacttgtgactacct

SEQ ID NO: 549590 - DNA, 231 bp, Homo sapiens
cagacatagggtcatcaggttaccccacagacacactttatttcctaagggcgggcaaggctcccatagaggcgcggtgtcagtgaagatgtacgactacctgtggggaaggacaaagggatgaggctccagagagagtgggctgccacagcctcggccaagcttggtcttgggggctggctgcagaaaccgggcctacggaagatacgacaccactggttagggatctgt

SEQ ID NO: 549591 - DNA, 476 bp, Homo sapiens
aaagtcaaaaaacccgtttttgtaattcccccccggggccccaaaaaggcggtccccttttttgggaaaaaaccacccctcccggagttttttaaaggcattttggggaagtttcttcccattttcccccggaaggccttccccccctgggtaccaaggaaggggaagggcaaaaaggggtttccccggggttaaaacacaaaaaaccccccctttttttagaatccccaggtcccggatcccccccccaaaaaaaagagggattttgggtggggggcccaaaagagggcctaaagcaaaaccccccccccccccgggttttcagttcccttaaccgtttttttcaaaggcccccttccccccccccaaaaattgggtttgcgccccccttttttttttttttttttttttttggggggggggttaaaaaaaggcccggcccaaaaaaggggccccaaaaaaatttttttttttta

SEQ ID NO: 549592 - DNA, 803 bp, Homo sapiens
gggcctggccatgcttcgcggtcctgtggctgccagctttggctctttctcctgctgctgctcccgggcgctgcctgagccccgtggctgcctccaggcctgtgggatgtggaacctgactgatgcctgtggctctgtgcctgtgtgctctggcctggtgcttccatgctgcctgcagtgagcagctcatgtggctggctgtgtgtgccctcttccaatgctggtacttggactgctcttcatgcttgccatgtgtgttgtgccctgactgacttgtgactgatgtgactgatgtgatgggcatgccagctgtggggcaccacgtgggcttggcctgccttcacatcttgatatgggtgaccagctgtgataaccatttgggacccttccagttgaacacgagctgatgtggtagctttgcccatgacattcaaaaatggaccttgcattgcacactaaggatgggggggagttttgcagagaagacgtacatcgcaaaggcgagacaacttttttacacagtggggcttatagtggagtgttggtgtgaacccccattatggaagcaactttggatttggcctgtggactatttgtccatcatttgtgggcgccaaagaggcccaagttatattgcggtacccgagtggcaactggaccagttgaggtttcccttcacattgcaacaaccactggtatggactggggtgtggccgataaccatttaattggagtggagctagcactcttcaaatgagaccagtggagacaaaagatggtgccgcgttttggcacttcatttg

SEQ ID NO: 549593 - DNA, 83 bp, Homo sapiens
tgacttaggagtcagagcccggcaggctgaggaggaggagcagggggtgctgcgtggaaggtctgcaggtccttcacgctgtg

SEQ ID NO: 549594 - DNA, 155 bp, Homo sapiens
gataggatagccatggaagaagctctctcgactcccgtcgctcatcgagaaaccgcggaagaaaaagtaatccggaatcttacccccgtctctaatagacggtcccatccatagaggatagccatggatcaaactctttgagatctcacggagag

SEQ ID NO: 549595 - DNA, 160 bp, Homo sapiens
cataacatcagaagagcttcctgatctgggtgaatgaggagagatcatacacgggtgatctccatggagcaagggtggtaacactgaacgagagtgtttgaaagattctgccgaggcctcaaagaggtggagagacttatccaagagcgtggccagaagg

SEQ ID NO: 549596 - DNA, 692 bp, Homo sapiens
gggggaacgagcttaatacaggaaacagtgggaattttagtaggccccgggtaaccttcttatgaacagtttggtcacaattcttgtgcgagcactcatggctctagcatggaagtatgatggcacactggtccctaggtgtagtgggcactgagggttttcctagggtgtgcacttccgacatagcgtaagaaaggccttgtacccatctagttgccgtgctgtaacatagacggaatgccctatggctcagacagagtagcccatacagtcccgttcaagatccataaaggtagtcccatagtattcccgcagcagtgaacccgagctccttttaagccttttgttgagacattgttctccccttcaagccgaaaagttctattgtgcagtcagtctggagaggtgaaactcatgggtaagttatcatgtgttcagcaaacgtaaactctttccataaaaagatgttgtacaggtttttaaaggcagatttattgtttttgaaaatcttcaggctaggccccttgagtaacccccaacccgtgtgtttttgatgtcttggagtccaaaggtccctaaagggttagcagaggcaattttatatccttcgtccatttatgagaatgaatgaatgtggccctgaaagtcttcatttagaaggatcgctaggcttaagaacaagctgggttaag

SEQ ID NO: 549597 - DNA, 411 bp, Homo sapiens
gaggatcccaggagatagcaggatacgagagagacagagagaagatgtgtgagaaaagacaaccgagcaaataaagaatcaccagcatagcaagaataaaacataaattgaacacgaaggtgccatttggcaaatgtactgcacgggcgtcgataccatgccagagggaggatgaatgagggatgaaatggaggagataaggaagatgttacaaggggggcgaacccagggtctagtatcggttgtctcaggggaaattcgctgtcggggaaaatggagcactcccacatgtattatgaaaatgaaggaaatcctggagtgcatctggctctctgtaggactggccgtgggtgaacacccagaaagctgtgtttccagaggcatgctctttccaaacccatcctgcttatc

SEQ ID NO: 549598 - DNA, 309 bp, Homo sapiens
ggccgcgtgacttctgctctaggttctttcccacgtattatctcacccacaactaacatttcagtaatcaccagtgaacaaaagaataccacagccagagctccaatcttggctcttctcttgggatctagacccctggttcaaacttccttgaggtcctgtgtcccctggttggccttcgctcctctctctctctgatatcactactgaaactggtgtgccccaccaaggccatttgtattgtactttggttctatctatctgtccatttcactggagggtaaactcgtccagagcagaaggtcgacg

SEQ ID NO: 549599 - DNA, 467 bp, Homo sapiens
  misc_feature (1)..(1): n is a, c, g, or t
nggaacagacagtcgtagattgatttactttccctgcatttaatgctctgccaaaactatcatctatggacttccagaatgccttatccaccaccactttttccacacagcagtgcttttgatgaataaactcatttcacagcaagtgaagtacagcaatgggcccgtgctcatggcttaccatgttctccatcataccgaagcagctggcttgatagaaaggcggaatggccttttgaagatctagttacagtgccagctcggtcgcaacaccttgcagggttgagacaatgtccttcaggagaccatatatactccaactcagcatcccacatatggtactatttgtcgcatagctaggattcatggttccagggatcagtagtagaaatgaaatggcacccacaactcactattacccctagtggtccactggtaaatctttgcttcccatccctgtggcttta

SEQ ID NO: 549600 - DNA, 304 bp, Homo sapiens
ccattactactaaaaatagaacattacgtcaggcgcggtggtcgtgctgtaatccagcactttggaaggcgaggagggcagatcacccgaggtcaggagttcgagcaccagcctggtcaacatgaagccccgtctctactaaaaatacaaaaattagccgggtgtggtggtgcatgcctgtaatcccagctacttgagaggctgagacaggagaactgcttgaacccaggggatggaggtagcagtgagccaagatcgcgccattgcactccagcctgggcaacaagagggaaactccgctctc

SEQ ID NO: 549601 - DNA, 822 bp, Homo sapiens
cggagctccgacacagtcaccactgcgggaaaattgcccccctggacagaggcccaaaaacacggggtgattaagtcccagcgcgggcccaaaatttccccagcgccggtggaaaggcgccccccaaattggcgcgcccgaaccgcgccaaatcgttgtagaaccccccctgaacgacacttccctcaaggcaaaaattaccaccagggcccacagacacgggaactcctcccacccagggtgcaacccaacgaccgccgtccgtcggacagtacgcacacaacgatagcaatttgtgaaacaagaactgtccccaacaaccctccccgtggcgaacccttcggggggcaaatacgccctcagtgagtaaccccaagagttcttttgcagagcccaatttccgtcttctagaaatctcttcgagagggaatcgtgttgtacgagaccttcctgccgaaggctgcgacgggatatcccgagccccccggttgctccgtggctcccaaaaatagctaccctcctagatcagggaggtcacgcctccctgtgctccaattatgagattctagctgcggcagtgtggctgcttcctaatacgtctgtgatgtctgcggggcagatcatcgccaatagtacccctccaacgtcttctcaccacctctatcagtagtgagcacccctgccccgcagcagttcttcatgtgtggacgcctccggaggtcagatgcacgagaatggggcagggagagaaatatgtcatcactcacaccacaggagacccgatctttggaaccccataaaatatttttctcacacacaagc

SEQ ID NO: 549602 - DNA, 319 bp, Homo sapiens
cgcctagagttcctgcttgtatccaagcagtcgaactatagactatttgctatatattagcataacgggtagaagtctggaagcctttggaggttgcaaatctgagttcaggtctagctcttcgagttacctggctgtgtaaccttcaggcaatttactataacctccgtgagtctccagtttcctttatctgtcaaactgaggataacacagaacttaggcagttgttactctgagattaaaacgggatgcttcatgtcaaaattggcttagaaataaccgacttgcatggatatacaacggagggtacctgagctcg

SEQ ID NO: 549603 - DNA, 910 bp, Homo sapiens
ccgccgggggccgttggtctctgtggggtgtgcccagccggtatccaggtctcccttcagtgccgggtgtgaacccccgggtggagcctggggagccggggtgcagactgtggcggttggttggggcggagggagcagcggccccagcgagtttggggggagaagtaaccagtgctgtgtgggtggaggtggctggagcatgtggagtgtggtgcctcatgtgccccgccccgcagtctatgtgactgaactggcatactggtgtgcactgccccttcacagtgctgtgggtgcctggtgtgtgtgtgccttgtggatttgggtgaagttgggggagccgttggtgtgtgccccttggcgaagccttccccgtgttgtgctgtgatgacccctgagtggggggattagcgggggtggtgtacccgtggaatggcgcgatgtggaaggcacaggacatctgggtgacaatttcttgcaggcagaataattgaccaatcaacctgaaccagaaagccatggatcgatgtgcccaagtgccaatgaaaacagctgcgcctaaagctagcgcaccggatatgaagtcctgggtctcgtttacgcgtccttgtgttgaagatcagaggaggaaacactgggcctcagtcattacggaggctcccgaggagtgatgagcctggtggaccacacagcatgatgccgcttggacaaacattgcttcgtgggcacgatgggtgtgtgcttgggccccgaagacaaggggggcggcgtcaggcagcaagcaagtttgtcaggcggcttgcaggcgctcatgggtgggtgcgtagttgtacccctgaacaaactcccaattcgaacgactccggactatctgcaaggcaaaacattgcccaaaatccctgtacatatacca

SEQ ID NO: 549604 - DNA, 110 bp, Homo sapiens
gtaattatctgccagcaagtagtcagcactttcagtgttatgattatcatctctggctggaggccagggtgggccaacctgtcaatcaactgactcttgaaaagaaccct

SEQ ID NO: 549605 - DNA, 184 bp, Homo sapiens
  misc_feature (9)..(9): n is a, c, g, or t
  misc_feature (24)..(24): n is a, c, g, or t
  misc_feature (36)..(36): n is a, c, g, or t
ggaaaagtncgcatatagcgtgcnataatactacgnctaaggagaaacaatttcctacacataaagtagtgagaacatcatcctataacagggaactgtgattatttaaaaaacgcagaacttatttatttggctttagaaataactgcatacaatgtcataagtcgaaaagaactcaaaataa

SEQ ID NO: 549606 - DNA, 1201 bp, Homo sapiens
  misc_feature (278)..(278): n is a, c, g, or t
  misc_feature (301)..(301): n is a, c, g, or t
  misc_feature (436)..(436): n is a, c, g, or t
  misc_feature (544)..(544): n is a, c, g, or t
gctgtacgtccgggttttttacgttgtaatagccaggaacttgcacactgcgcactgtcctctgcaatggaagggacaagctacttctggtcgggagcggctcgagactgttagaacatccgtagcgagcgagcgcactagtgataggcacgcgactatcagaccagtttcgggacggtactcgtcatgaaggagtggtcggtctgtcaacggacccagggaagacttcacgacggtccgaggggtgctctatggggtttcaatcactcgttcagcgncgaacccatcgatgcactgcttntcaggatttgctcgactgaggaggccagtcgaatcggggagacggtgtggagagcgctccgtaatcggtgcgaagacagggcaccctttgtgtcccaccaagtctgtgccgggcatatccggtatcgattctcgngtctatctctgtatgtctctaccctgtcctcgatgctgcgtggtcgtccgcgcgcgcgagccgatgagcgcgatcccaatacggccccccgcgaagatgaccctaacntttcacatggggtacgcagttgacctatgctcgtttgttggttatcccctacgggtcggggttggtgttaggggggtcaggcctggggcacggaaccaagtatgggccctcgagtcgcgggcacttcggggagagggcccgataccggaactgtgtgcttcccttggctattgaaggaggcccggagaaagccctaggtcttgctgggaattgggttcttgtacccttggcgcttttgtggggctttaggcgctaagttataggacgttcttggctatggagcccgtaggtaggcgacctcttggcgcgccgtgcaccgaagggaacctctcgggtgaagttcgattcgtggagcggttggggcgttcttggaaaggacctcataaaagccaagggaagaggcgttgttcttgttcttaagccctccgtggacctgaggttccgggggggcaaggcttttacgaacgggagtttgtgccgggaggggagggaacaccttcgagagggccttgaaagtttccagttcgacacgaattggtcaagtaaaggtaccgcaacgtgttgtaacacatggggttggccattttcagggcttcaccatttcttggccggtcgcggagatttcgctaattaagagcatccgctgtgctcgcaaag

SEQ ID NO: 549607 - DNA, 178 bp, Homo sapiens
atatctcactgtatacctctatcaggttgcacgacagttccctatatcgtgcccatttgcttcccgataacactagctcgactctactcctctctctactctgctcgctctgctatgtggaggcgagcaggacaggttgacagttacctccttagaggaactactccacctggagctc

SEQ ID NO: 549608 - DNA, 503 bp, Homo sapiens
tactctgaggatcgtagggagccttacctggggtaccaggggggcggcaaccccgtgaacccaagaccagagttacagaacatagaacaacgtgacaacgtgactctggtatcccagagtcaacacaacaggggacctctcacaaccaagtgtcctgccttaaacaattgcccaaatacaattaacagaaagtcgaaagcaaacataagactccaaacaagacatacatgttaggactgaaaatgaaaccaaagtggagcaataaaatggagtcagaggagaaagaaccaggtgaaggggtggcaagaatgtgcttcaaggcacctaaaccgtggggaactgaccgcttagccaaaggcttttatttcctagcttacctgatattactgggggagggtgcaaaggggactctcagccatccacagaagacaaaatggcaccagccagtcttccacgtgggacccgggtgcaggtctctctaggttcaccagctagaaggtgct

SEQ ID NO: 549609 - DNA, 313 bp, Homo sapiens
tacggtcgtgcatgaggaagcagagagaacctgcctttcaaggaatttaggctgttgggggataatgcgaggcgtgtggccagtgtccaggacactgcgctagagtttgcagtagttttaatatgcttgaccacccacgaactgtgatcttagaaaagtcacttgggttaggagtcaaaggatttaaagcccacaaagcctgaaacgtaaatcctatacacgtgcacgctattacttttcatatgagaaaggaaaatataatccgtgttccacatgattatgtaaagactggaattgatgtacatgcagtacg

SEQ ID NO: 549610 - DNA, 959 bp, Homo sapiens
actctcagcactctcgggaggctgcaggcacggcagatcaccctgaggctagcgcagctttgacgaccagcctggccaacatagcaccaaccctgtctcctgctaacaaatacaaaaacttagccagcaccatggctgcgcaggcgcttgtaatcccagctactcagcgaggccgaggcaggagcaatcactctgaacctgggacacagcagcgctgccgtgcagctgagatcgcaccactgcactccagcctcggctgacacaagaccagcacctctgtcctccacaaaacaacaaacaaaaaagttcaacaacaatcgtgctccgagcaccggcggcgtctacttctcccttccacacgtttcccaacccacaatattcccctatacatcttcccctcctctaccacctctcaatacacctcttctctacacaacgtgctctacacacagtatatacaccctctcttcaacaacaccctactcggtggccacccgcccccaccactcccccaccactccccaaacaagacccgcctcaccaccctatcaccaacgcggccccccgcgcccccccacgccgcccagcgcagcggccaccccctccggacaccccctcccaccccactcctctacgccgcccccaactccagcccccgcactctcacacgccaaccacaccaaccaggcgcacacgccgcgcccgccccagccaaccaacctctccaacaccgccggaaacacccgccccaacacggccaacaccatcccggacaccaccatccacaggccgcacagagcaaaaaaccccagcacagcacacccacagtgccaacacacaccatccagaccagccccccaacacggggcacacacacacgagcacacagacaaaggcgcaaccacgttccgccccagcaccacccacggacacacctggcccgagaccagcaaaaccaa

SEQ ID NO: 549611 - DNA, 467 bp, Homo sapiens
  misc_feature (228)..(228): n is a, c, g, or t
  misc_feature (247)..(247): n is a, c, g, or t
  misc_feature (335)..(335): n is a, c, g, or t
  misc_feature (346)..(346): n is a, c, g, or t
  misc_feature (368)..(368): n is a, c, g, or t
  misc_feature (372)..(372): n is a, c, g, or t
  misc_feature (420)..(420): n is a, c, g, or t
gctcccttccatccacctcctcagtgcttgctcagcccaaaggctcctgcctctgaagtgctgggggcccacccaccccagtgtggtcaaggaggcaaggggcaggtgcttgacactgccaagtgccccgagatgactctactgctcacccatttctttgggccctggcagtctcctacttgtccccagcatggagcacctggcagaactggaaggcaggagggtggntggtgaatttgaggcacanggaaggccaatccccttgcaccttttgtgctttggaattcacagccccacacctgcccccagctagagagcctgtgggaacacaatgnttggcaccttnaggaaccagaaggagtaatggntggnaagaaggcacagatggtccaactttggctgatgccgggatggatttgntgcatgtacaggccttggatgcacttctggcctggaagatggcatca

SEQ ID NO: 549612 - DNA, 265 bp, Homo sapiens
tgtctgtccatctgaattaacattatgttgactgctgcagcagccatgggaaagcctggaggcaggagtggtgaataaataaaggaatagggagaggcctagccctgggctgggtcaagatgcctgcgctctatttgctgaggtgtgcagggtcagaggacaattctgagaaatgactgtgaagctgagacttgcagaaatggtgagagcccagaggggcacagagcctggggagagtgcaggccgggaacaagcacttgtagag

SEQ ID NO: 549613 - DNA, 288 bp, Homo sapiens
  misc_feature (63)..(63): n is a, c, g, or t
  misc_feature (74)..(74): n is a, c, g, or t
  misc_feature (150)..(150): n is a, c, g, or t
  misc_feature (162)..(162): n is a, c, g, or t
  misc_feature (167)..(167): n is a, c, g, or t
gacgtgtggcttcagcatcgtcattctgcgtcacgcctggccccagcttcagtgcagacactntccagctgcanctcacctcagctctaccctcagctccaccctcagcagatgataatctcaagacacgtgccgagcgtctgctcgggnccgcttccaccntcacngatgataatctcaagacaccttccgagcgtcagctcactccccttccaccctcagctccaccctcagcagataaatatcaagacacctgccaattcccagggggccggaccagctcattct

SEQ ID NO: 549614 - DNA, 740 bp, Homo sapiens
  misc_feature (33)..(33): n is a, c, g, or t
tcgactctgtctccaaaaaaaaaaaaaaaaaanttttttttttagatcatcagctattgttagtgttagtgtatgttatgtgtggctcaagacaactttgtttcttttaatataggcagggaagtcaaaagattggatatccctgctttataccaagaaagacaacaccccacatttgcaatgcctaaaaacactaccagccatctgaaaaacatgagacttctaacttctgttcttttttgtagcagtggaatcccacggtgatatctgagggatgtggttaccttttggaggaggttgacggtttctaaggatgattctttctgagtgaaatattgtcagtgtcattgaccttttcattatttcaactattattattccaggttatcaatactctggctgaccatcatcatcgtgggactgactttggtggaagtccttggttacatgtcattattgcgtttccgacaagttataaagttgtcattaccctctggatagtttacctttgggtgagtatactaactttctgtagaggtatacttgtaatcacaaataagaataaattatataaaacaattcacatttctggacttcattatgaatatgtggttttacccaaaaaatcagggaaatgatttattagtataagaattatgaaaacatctgccatttgcattatgaaaattaaataggtcggtgtttgtttaatagaatgtcaacagagcgagactgcatct

SEQ ID NO: 549615 - DNA, 133 bp, Homo sapiens
cccatcccccatatttaaacccaaaaaaaagttgatcttgtttgatttttttttgaaaaaattgatgttgttaaaaacaaatatgtaaccatttaaattgtttttgtgaaataaataaaccaattctttccca

SEQ ID NO: 549616 - DNA, 404 bp, Homo sapiens
gcctactactactaaattcgcggccgcgtcgacggaagaccgccagaaaacagtaagatgtgccttgacacaaatactgttgtatgaaccatgtgccaatcaaagtagacaactgtaaagtccttgagaatattttctacaatatttgtggcaaattcagtgggttcaaaattgagtttgtcctttctgcttcattagtttaagctgtataattcctttcccttcctacattcttgttttcattttttcggaggaagaggagttgctagtactggcattggttttcctttctctttttttttttttcctgagatggagctttgctgttgttgcccaggctgtagtgcaatggcacaatctcagctcactgccttttggtcgacgcggccgcgaatttagtagta

SEQ ID NO: 549617 - DNA, 3818 bp, Homo sapiens
  misc_feature (33)..(33): n is a, c, g, or t
  misc_feature (3096)..(3096): n is a, c, g, or t
  misc_feature (3647)..(3647): n is a, c, g, or t
  misc_feature (3663)..(3663): n is a, c, g, or t
  misc_feature (3774)..(3774): n is a, c, g, or t
  misc_feature (3803)..(3803): n is a, c, g, or t
tcgactctgtctccaaaaaaaaaaaaaaaaaanttttttttttagatcatcagctattgttagtgttagtgtatgttatgtgtggctcaagacaactttgtttcttttaatataggcagggaagtcaaaagattggatatccctgctttataccaagaaagacaacaccccacatttgcaatgcctaaaaacactaccagccatctgaaaaacatgagacttctaacttctgttcttttttgtagcagtggaatcccacggtgatatctgagggatgtggttaccttttggaggaggttgacggtttctaaggatgattctttctgagtgaaatattgtcagtgtcattgaccttttcattatttcaactattattattccaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgtgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttgggacaattccaaatgagggccttaaatgatgctcagctaagctggttcttgtgtggcctctgtaccttcaaaagctgccgagtcctatgattacacgcgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacaatgggcttttcatgcctctcttactgtctcttactgtctattgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgacttttctttaccccctagctgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcagctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcggggggccgcttccaccctcagcggatgataatctcaagacaccttccgagtgtgtgctcactccccntccaccctcagcctcccgagtagctgggattacaggtgcctgccaccacgcctggctaattttttgtatttttagtagagaaggggtttcaccatattagccacaatggtctcaatctcctgacctcgtgatccatccgccccgccctcccagagtgctgggattacaggcgtcagccaccgtgaccggctcagactgtactcttctagccatctgaaatacgttttctaggtagagatagattgtgtaagggtacagttgtgaggataacagaaacatggcagattatttaaaatcatcctgaaagtggtgctttatctgatgaaagtgattgtaatccataggaaaatgtttcaacgtgcgcaagagttgcggcggcgagcagaggactaccacaaatgcaaagtaaggagcttcctccctgcagttgcaggatagttcagtgctgatgcagatgatgccacggcccttagactctctcaacattcaatttctcatgtgttggctttttcagatccccccttctgcaagaaaggctctttgcaactggntcagaatggcggcagnggagcatcgtcattcttcaggattgccctactggccctacctcacagctgaaactttaaaaaacaggatgggcctccagccacctcctccaactcaacaacattctataantgataactccctgagcctcaagacacctnccgagtgtgtgctca

SEQ ID NO: 549618 - DNA, 264 bp, Homo sapiens
taaggagtgtgtttggaccaaaaggttgaaaatccattaggacactgagtgtagacagaggcctggagagaggagcttcccatactcttcccacacacattgtatctaggagttccctgtagcatcatacaggtgtgattaatttggaataacaagatcatacttgaaaggtcctatatgaactaaaagttgaccaactgaatcatgtcttaaaggtataagaggagctcttggctgaaagggactcttatcattaattatttt

SEQ ID NO: 549619 - DNA, 750 bp, Homo sapiens
caaaatacctactgggtcgggaagtcacgtggaaacatgtagagccatcctaagttgactggactagatacaggttcaaagtgaaagttcaggttgtgtgcaggagaccatgtacactgactgtctccattattgatcggttcatgcagaataacttgtgtgcccaagaagatgctgcagctggattggtgtcgactgccgatgtttattgcaagcaaaatatgaagaaatgtaccctccagaaatgggtgactttgcttttgtgacgtgacaacacttatactaagcaccaaatcagacagatggaaagtgaagattcgtaagagctttaagactatggtcgtgggtcgggctcgtacctttgcacttccttcggagaagcatctaagatgggagaggttgatgtcgagcaacatacttggccgaaatacctgatggaactaactatgttggactagtgactatggtgcacttgtcctccgttctcaaattgccgagcgaggagcttttgctgtagcactgaaaattctggataatggtgaagggacaccagactcttacgacattacctgtcatatactgaagaatctctgcttccagttatgcagcacctggctaagaatgtagtcatgggtagatcaggggacttacaaagcacatgactgtcaagaacaagtttgcacatcgaagcatgctaagatcacactctacacagtgattctgtctagttcagaatttgcaaggtgggga

SEQ ID NO: 549620 - DNA, 3709 bp, Homo sapiens
  misc_feature (33)..(33): n is a, c, g, or t
  misc_feature (3096)..(3096): n is a, c, g, or t
  misc_feature (3538)..(3538): n is a, c, g, or t
  misc_feature (3554)..(3554): n is a, c, g, or t
  misc_feature (3665)..(3665): n is a, c, g, or t
  misc_feature (3694)..(3694): n is a, c, g, or t
tcgactctgtctccaaaaaaaaaaaaaaaaaanttttttttttagatcatcagctattgttagtgttagtgtatgttatgtgtggctcaagacaactttgtttcttttaatataggcagggaagtcaaaagattggatatccctgctttataccaagaaagacaacaccccacatttgcaatgcctaaaaacactaccagccatctgaaaaacatgagacttctaacttctgttcttttttgtagcagtggaatcccacggtgatatctgagggatgtggttaccttttggaggaggttgacggtttctaaggatgattctttctgagtgaaatattgtcagtgtcattgaccttttcattatttcaactattattattccaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgtgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttgggacaattccaaatgagggccttaaatgatgctcagctaagctggttcttgtgtggcctctgtaccttcaaaagctgccgagtcctatgattacacgcgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacaatgggcttttcatgcctctcttactgtctcttactgtctattgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgacttttctttaccccctagctgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcagctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcggggggccgcttccaccctcagcggatgataatctcaagacaccttccgagtgtgtgctcactccccntccaccctcagcctcccgagtagctgggattacaggtgcctgccaccacgcctggctaattttttgtatttttagtagagaaggggtttcaccatattagccacaatggtctcaatctcctgacctcgtgatccatccgccccgccctcccagagtgctgggattacaggcgtcagccaccgtgaccggctcagactgtactcttctagccatctgaaatacgttttctaggtagagatagattgtgtaagggtacagttgtgaggataacagaaacatggcagattatttaaaatcatcctgaaagtggtgctttatctgatgaaagtgattgtaatccataggaaaatgtttcaacgtgcgcaagagttgcggcggcgagcagaggactaccacaaatgcaaaatccccccttctgcaagaaaggctctttgcaactggntcagaatggcggcagnggagcatcgtcattcttcaggattgccctactggccctacctcacagctgaaactttaaaaaacaggatgggcctccagccacctcctccaactcaacaacattctataantgataactccctgagcctcaagacacctnccgagtgtgtgctca

SEQ ID NO: 549621 - DNA, 501 bp, Homo sapiens
ccctcagattacctcaactatgaatgcattgcagtcaatctgtccattcagatccattaatatttgctttatatatttaggcattccaatgctgggtgcatatatatttataattgttaagacctcttgatgaattgatccctttatcattataaaatgatgtttgttgtctccattaaaagttttgaacttaaagtctattttatctgacataagtatagctactcctgccactctttagatttccattagcatggagtatctttttccatcccttcactttcagtctaggcatgtccttgcaggtgaggtgagtctcttgtagacagcatactattgagatcggttttttttttaacccattcacgcactctatgtcttttgattggagaatttaaaccctttactttcaaggttattattgataggtaagaacttactactgccatttggttgttttatagactctttgttccttccgtcctctcttactatcttccc

SEQ ID NO: 549622 - DNA, 194 bp, Homo sapiens
acaatgtcggagacaatgaggaaatatccggcgaaaccccgatccagatcatgtatgagctccacgagcaggacgcccaagtctacgagaatatcttcaaagctatccctgagggcttgcatctctatgggagggaacttcctcataggtgcgctacgctacaacttttccgcctcacctttcggctgtctgac

SEQ ID NO: 549623 - DNA, 255 bp, Homo sapiens
tgtggtagctcatgcctgtaatcccattactttgggaggctgagatgggtggatcacttgaggtcagttgttcgagaccaaccagaccaatatagcgcctcatttatactaacaatacattggccaggcatgcttgttatcccagctactcaggaggctgagacaggataatcgcttgaacccaggtggaagaggttgctttgagccaagatagcgccactgcattccattctgggtgagagagtgagacgctgt

SEQ ID NO: 549624 - DNA, 3228 bp, Homo sapiens
  misc_feature (33)..(33): n is a, c, g, or t
  misc_feature (3203)..(3203): n is a, c, g, or t
  misc_feature (3219)..(3219): n is a, c, g, or t
tcgactctgtctccaaaaaaaaaaaaaaaaaanttttttttttagatcatcagctattgttagtgttagtgtatgttatgtgtggctcaagacaactttgtttcttttaatataggcagggaagtcaaaagattggatatccctgctttataccaagaaagacaacaccccacatttgcaatgcctaaaaacactaccagccatctgaaaaacatgagacttctaacttctgttcttttttgtagcagtggaatcccacggtgatatctgagggatgtggttaccttttggaggaggttgacggtttctaaggatgattctttctgagtgaaatattgtcagtgtcattgaccttttcattatttcaactattattattccaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgtgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttgggacaattccaaatgagggccttaaatgatgctcagctaagctggttcttgtgtggcctctgtaccttcaaaagctgccgagtcctatgattacacgcgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacaatgggcttttcatgcctctcttactgtctcttactgtctattgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgacttttctttaccccctagctgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcagctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcggggggccgcttccaccctcagcggatgataatctcaagacaccttccttagctaattcaggaggcttgagggcaggaaaaaaccacggcaaacccaagagggcaggaggggcgggttgaggatggggaaccactttcccggaacccaagagggcgggagggttcggttgagttngggaaccgtttaaggnaaaccccaa

SEQ ID NO: 549625 - DNA, 972 bp, Homo sapiens
tccttgaaaattgaattctaacaacgtgccccgtgacagggagctgtcgatcccaggcccgccgtatagatttggggcatgtatagtccttatgtcttctcgtggttgcctttattcagttccttgaatacagctaatagccatgtggagttcaaaaacacatgtatcagcagctagcgtggagcatagacctaacaccccagaatgggggctggttggtagtgagaacgatggagccactaactgcatagacagcatgcattgtggtgagctcgtcttcatttcgaggagcccatggtgaaatctagtgcactgagcttgtaaaagctcgggagaagacgtggagaattcgtgctataccgcaatctctgcagagccatgtagggagccgctacccttggtagtgttcatggtgctgtatgggagaacgctagcgcgattccttcagggccaaggttctgaataatatacaccagcggcatcaattctgctcatcttgtcctccttgtttttggaagcaaacacacttaaaaatcttttatacgcactgcgatgagacgattctaaaaacaagtttaaggttttacaatgttttcctgtgaaaattagtgtgagtaacacctgagtggagctgtgtaggaatgaacacgtggactctccctggtgggtaaagagggagggttcgttttaatagattaaagtaaataggggggaatatttgctcaggcgcttgaattgagggacagaacattggcggggtgcatgttctggacatattagggaaaggactgtttagatttagctgcggttctggataaccctaggtgttgagggcctttaaaacgcacgcaggtaaggtcggaggaaaaaacgatgcgttttatttaattgggagaacgatataggcggaaaataggagttcggagatatacaatgtcacatggtgtgggaaaaaattgggggagcaagtga

SEQ ID NO: 549626 - DNA, 3764 bp, Homo sapiens
  misc_feature (33)..(33): n is a, c, g, or t
  misc_feature (3042)..(3042): n is a, c, g, or t
  misc_feature (3593)..(3593): n is a, c, g, or t
  misc_feature (3609)..(3609): n is a, c, g, or t
  misc_feature (3720)..(3720): n is a, c, g, or t
  misc_feature (3749)..(3749): n is a, c, g, or t
tcgactctgtctccaaaaaaaaaaaaaaaaaanttttttttttagatcatcagctattgttagtgttagtgtatgttatgtgtggctcaagacaactttgtttcttttaatataggcagggaagtcaaaagattggatatccctgctttataccaagaaagacaacaccccacatttgcaatgcctaaaaacactaccagccatctgaaaaacatgagacttctaacttctgttcttttttgtagcagtggaatcccacggtgatatctgagggatgtggttaccttttggaggaggttgacggtttctaaggatgattctttctgagtgaaatattgtcagtgtcattgaccttttcattatttcaactattattattccaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgtgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttgggacaattccaaatgagggccttaaatgatgctcagctaagctggttcttgtgtggcctctgtaccttcaaaagctgccgagtcctatgattacacgcgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacaatgggcttttcatgcctctcttactgtctcttactgtctattgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgacttttctttaccccctagctgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcagctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcggggggccgcttccaccctcagcggatgataatctcaagacaccttccgagtgtgtgctcactccccntccaccctcagcctcccgagtagctgggattacaggtgcctgccaccacgcctggctaattttttgtatttttagtagagaaggggtttcaccatattagccacaatggtctcaatctcctgacctcgtgatccatccgccccgccctcccagagtgctgggattacaggcgtcagccaccgtgaccggctcagactgtactcttctagccatctgaaatacgttttctaggtagagatagattgtgtaagggtacagttgtgaggataacagaaacatggcagattatttaaaatcatcctgaaagtggtgctttatctgatgaaagtgattgtaatccataggaaaatgtttcaacgtgcgcaagagttgcggcggcgagcagaggactaccacaaatgcaaagtaaggagcttcctccctgcagttgcaggatagttcagtgctgatgcagatgatgccacggcccttagactctctcaacattcaatttctcatgtgttggctttttcagatccccccttctgcaagaaaggctctttgcaactggntcagaatggcggcagnggagcatcgtcattcttcaggattgccctactggccctacctcacagctgaaactttaaaaaacaggatgggcctccagccacctcctccaactcaacaacattctataantgataactccctgagcctcaagacacctnccgagtgtgtgctca

SEQ ID NO: 549627 - DNA, 346 bp, Homo sapiens
ctgacagtgaatgggtggcccctgggaagcctcctcacacagacggcactgggagtatgctctttctcattttattgtccttgtcctgctatagtaggtgggttttgaaagggagtcagtgtcccgtgatcttggatagtagctctttctgtcactgcacctttctgtctgttcagccttgtgggatggcccagctgcaggggttctgcatgatgggacagcagactgccctatgcttttctggttatgacatcgggcacccttacgtacatgctgatgtgtgcatttgtgcatggaatttgcatcacattctatatttagatttcctcaacttaggctgtcagca

SEQ ID NO: 549628 - DNA, 3818 bp, Homo sapiens
  misc_feature (33)..(33): n is a, c, g, or t
  misc_feature (3096)..(3096): n is a, c, g, or t
  misc_feature (3647)..(3647): n is a, c, g, or t
  misc_feature (3663)..(3663): n is a, c, g, or t
  misc_feature (3774)..(3774): n is a, c, g, or t
  misc_feature (3803)..(3803): n is a, c, g, or t
tcgactctgtctccaaaaaaaaaaaaaaaaaanttttttttttagatcatcagctattgttagtgttagtgtatgttatgtgtggctcaagacaactttgtttcttttaatataggcagggaagtcaaaagattggatatccctgctttataccaagaaagacaacaccccacatttgcaatgcctaaaaacactaccagccatctgaaaaacatgagacttctaacttctgttcttttttgtagcagtggaatcccacggtgatatctgagggatgtggttaccttttggaggaggttgacggtttctaaggatgattctttctgagtgaaatattgtcagtgtcattgaccttttcattatttcaactattattattccaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgtgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttgggacaattccaaatgagggccttaaatgatgctcagctaagctggttcttgtgtggcctctgtaccttcaaaagctgccgagtcctatgattacacgcgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacaatgggcttttcatgcctctcttactgtctcttactgtctattgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgacttttctttaccccctagctgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcgcttccaccctcagcggatgataatctcaagacaccttccgagcgtcagctcactccccttccaccctcagctccaccctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgccgagcgtctgcagctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcggggggccgcttccaccctcagcggatgataatctcaagacaccttccgagtgtgtgctcactccccntccaccctcagcctcccgagtagctgggattacaggtgcctgccaccacgcctggctaattttttgtatttttagtagagaaggggtttcaccatattagccacaatggtctcaatctcctgacctcgtgatccatccgccccgccctcccagagtgctgggattacaggcgtcagccaccgtgaccggctcagactgtactcttctagccatctgaaatacgttttctaggtagagatagattgtgtaagggtacagttgtgaggataacagaaacatggcagattatttaaaatcatcctgaaagtggtgctttatctgatgaaagtgattgtaatccataggaaaatgtttcaacgtgcgcaagagttgcggcggcgagcagaggactaccacaaatgcaaagtaaggagcttcctccctgcagttgcaggatagttcagtgctgatgcagatgatgccacggcccttagactctctcaacattcaatttctcatgtgttggctttttcagatccccccttctgcaagaaaggctctttgcaactggntcagaatggcggcagnggagcatcgtcattcttcaggattgccctactggccctacctcacagctgaaactttaaaaaacaggatgggcctccagccacctcctccaactcaacaacattctataantgataactccctgagcctcaagacacctnccgagtgtgtgctca

SEQ ID NO: 549629 - DNA, 968 bp, Homo sapiens
tcatgagggaccccattcggattcttgttcgagaaggaagagttgaccctggagggtatccgccagtttctacattcaacgtggatacgagatggtagtggaatgcctggacacactatgtgacttgtatgaaaccctggaccatcacccaggcaggcatcttcatcaacacccggaggaaggtggactggttcacgctgagaagatgcatgctcgagatttcatgtgtatccgccatgcatggagatatgggaccaaagaggaacgaggacgtgatatatgagggagtgcccgtgctggctctagcagagattttcgattaccactgacctgcgtggccagaggcattgtatgtgcatgcatggtttcttgtagtcatcaactatgaccttccctaccgaacagggaaaactatatccacagcaatcggtcgaggtggacggtttggccgtaaaggtgtggctattaacatggtgacagaatgaagacaagaggactcttcgagacacttgagaccttctacaaacaccgtccattgaggaaatgcccctcaatgttgctgaccgtcatctgaggggctgtcctgccaccagccccagccaggggctcaatctctgggggctgagagcagcaggaggggggagggaaagggagccagggatgggcctctgggtcttgggctttgaattagtgtcacttctgcagggaaagaagacgtgaacatttttagacacccttgtcttggcgtaggtcgttggccaggtgcggtgctttccgaaaaaaaaaaatttttctttcccaacggaactccgaaccgaaggctcccctcagtgggtcctgaagagcagggggggttctcccctgttggccctgcggaccccaaccaaaggggcggggccccggggggggaaagagccctgttttttcggcaccctttttttttgagaaaaggggatctgcacgccgta

SEQ ID NO: 549630 - DNA, 182 bp, Homo sapiens
agtacacaaaggagacaccaatatgaaatcctgaggtcaagccgaaagaaaaaaaaaaaaacccaaatacagaacaaaaaaaacaggttgcagaaaatcacctcctattctggcaggatcggttaccttcacgccaagggggcctcaatattctttatcggcctcttcctacacatgggggg

SEQ ID NO: 549631 - DNA, 3761 bp, Homo sapiens
  misc_feature (33)..(33): n is a, c, g, or t
  misc_feature (3039)..(3039): n is a, c, g, or t
  misc_feature (3590)..(3590): n is a, c, g, or t
  misc_feature (3606)..(3606): n is a, c, g, or t
  misc_feature (3717)..(3717): n is a, c, g, or t
  misc_feature (3746)..(3746): n is a, c, g, or t
tcgactctgtctccaaaaaaaaaaaaaaaaaanttttttttttagatcatcagctattgttagtgttagtgtatgttatgtgtggctcaagacaactttgtttcttttaatataggcagggaagtcaaaagattggatatccctgctttataccaagaaagacaacaccccacatttgcaatgcctaaaaacactaccagccatctgaaaaacatgagacttctaacttctgttcttttttgtagcagtggaatcccacggtgatatctgagggatgtggttaccttttggaggaggttgacggtttctaaggatgattctttctgagtgaaatattgtcagtgtcattgaccttttcattatttcaactattattattccaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgtgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttgggacaattccaaatgagggccttaaatgatgctcagctaagctggttcttgtgtggcctctgtaccttcaaaagctgccgagtcctatgattacacgcgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattcttcttactgtctattgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgacttttctttaccccctagctgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcagctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcggggggccgcttccaccctcagcggatgataatctcaagacaccttccgagtgtgtgctcactccccntccaccctcagcctcccgagtagctgggattacaggtgcctgccaccacgcctggctaattttttgtatttttagtagagaaggggtttcaccatattagccacaatggtctcaatctcctgacctcgtgatccatccgccccgccctcccagagtgctgggattacaggcgtcagccaccgtgaccggctcagactgtactcttctagccatctgaaatacgttttctaggtagagatagattgtgtaagggtacagttgtgaggataacagaaacatggcagattatttaaaatcatcctgaaagtggtgctttatctgatgaaagtgattgtaatccataggaaaatgtttcaacgtgcgcaagagttgcggcggcgagcagaggactaccacaaatgcaaagtaaggagcttcctccctgcagttgcaggatagttcagtgctgatgcagatgatgccacggcccttagactctctcaacattcaatttctcatgtgttggctttttcagatccccccttctgcaagaaaggctctttgcaactggntcagaatggcggcagnggagcatcgtcattcttcaggattgccctactggccctacctcacagctgaaactttaaaaaacaggatgggcctccagccacctcctccaactcaacaacattctataantgataactccctgagcctcaagacacctnccgagtgtgtgctca

SEQ ID NO: 549632 - DNA, 204 bp, Homo sapiens
atgagtgcccataggggggtcataccaaatttttttgtatttatagtagagacagtttttcaccatgttggccaggatggtctggggttcctgaccgtgtgatccacccgcctcggtctcccaaagtgttgatattacaggcgtgagccaccaagcctggctgaatatttcttatatgaagaagttatgctcgtatagaaggta

SEQ ID NO: 549633 - DNA, 355 bp, Homo sapiens
  misc_feature (100)..(100): n is a, c, g, or t
agagcagagacccaatgcagagcacaggcccagtgactcatggttctagtcccagcactttgggaggctaacgcaggccgatcactagctcaagagatangagaccatcctggccaacatggtgaaaccccatctcaactaaaaatacaaaaaaaaattagctgggcgtggtggcacacacctgtaatcccagctacttgggaggctgaggcaggagaattgcttgaacctggcaggcagaggttgcagtgagcagagatcatgccattgcacttcagcctgagtgacagagggagactcaaaaaaaaaaagaaaatattcaaacaatgtggggggaaaatgattgtagaactag

SEQ ID NO: 549634 - DNA, 3892 bp, Homo sapiens
  misc_feature (33)..(33): n is a, c, g, or t
  misc_feature (3170)..(3170): n is a, c, g, or t
  misc_feature (3721)..(3721): n is a, c, g, or t
  misc_feature (3737)..(3737): n is a, c, g, or t
  misc_feature (3848)..(3848): n is a, c, g, or t
  misc_feature (3877)..(3877): n is a, c, g, or t
tcgactctgtctccaaaaaaaaaaaaaaaaaanttttttttttagatcatcagctattgttagtgttagtgtatgttatgtgtggctcaagacaactttgtttcttttaatataggcagggaagtcaaaagattggatatccctgctttataccaagaaagacaacaccccacatttgcaatgcctaaaaacactaccagccatctgaaaaacatgagacttctaacttctgttcttttttgtagcagtggaatcccacggtgatatctgagggatgtggttaccttttggaggaggttgacggtttctaaggatgattctttctgagtgaaatattgtcagtgtcattgaccttttcattatttcaactattattattccaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgtgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttgggacaattccaaatgagggccttaaatgatgctcagctaagctggttcttgtgtggcctctgtaccttcaaaagctgccgagtcctatgattacacgcgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacaatgggcttttcatgcctctcttactgtctcttactgtctattgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgacttttctttaccccctagctgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgccgagcgtctgcagctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcggggggccgcttccaccctcagcggatgataatctcaagacaccttccgagtgtgtgctcactccccntccaccctcagcctcccgagtagctgggattacaggtgcctgccaccacgcctggctaattttttgtatttttagtagagaaggggtttcaccatattagccacaatggtctcaatctcctgacctcgtgatccatccgccccgccctcccagagtgctgggattacaggcgtcagccaccgtgaccggctcagactgtactcttctagccatctgaaatacgttttctaggtagagatagattgtgtaagggtacagttgtgaggataacagaaacatggcagattatttaaaatcatcctgaaagtggtgctttatctgatgaaagtgattgtaatccataggaaaatgtttcaacgtgcgcaagagttgcggcggcgagcagaggactaccacaaatgcaaagtaaggagcttcctccctgcagttgcaggatagttcagtgctgatgcagatgatgccacggcccttagactctctcaacattcaatttctcatgtgttggctttttcagatccccccttctgcaagaaaggctctttgcaactggntcagaatggcggcagnggagcatcgtcattcttcaggattgccctactggccctacctcacagctgaaactttaaaaaacaggatgggcctccagccacctcctccaactcaacaacattctataantgataactccctgagcctcaagacacctnccgagtgtgtgctca

SEQ ID NO: 549635 - DNA, 82 bp, Homo sapiens
tggttggggaaaaacccaacaagggcgggaaatgtttgtttaatatttggttttttaattttaaaaaataaagtgtaacttt

SEQ ID NO: 549636 - DNA, 411 bp, Homo sapiens
agaggatcatagaacgtggtctaatacgtacccatcagtatacaaggctgccgaggaagcaacagaagacggcagtcgacccctggaactctagcacaaaatatgatggtgcacacgaagaccctactgctaagctccctgtgcttatgaattcgaacagaataccccctccccataatgtaagagatactctaacataaccatacctcggcattcatggtttattttggataatgatcagaacatattcactaggacacattacagatgttagaaacttaacacttttatgtgtcgttcattatgcctcttccacttattaaaactgaaaattagattagtctggaacataacctaatttatgttgtatgttgttctggattacaaggttcattcctaatgttagagata

SEQ ID NO: 549637 - DNA, 534 bp, Homo sapiens
aaataatactcacttccacagctctggagcgcaggaaccatgggctgaggccagaatgtttgctccaggagcgtccctcgtggtccgttcaggtgcccagagttgcgggccttgcacgccttgtacgccttgttccctggcgcctccttccctggcgcctcctccttccatgtgggtgtgcagcatcccgctccagggccttcagcctttgcgcccctcatctgctgatgcaggtgatggcatttagggcccacctgggtactcctaggattcacctttatcaccgcatgagggagcattcccaggttttagggattagggataggactgggattcctttggggactgctcttccgcccaccactgtgccagaatgtgatgcacacaacggccagcatatccaaaggccccaggaggacctggggtggctggaacaggacctggtgccgggaacaggcggggccggggattcccgacaaaggcttgatgtgtaccttaagtgagcaaagggttttgaattaaccaagaactgga

SEQ ID NO: 549638 - DNA, 429 bp, Homo sapiens
agggagtcattccatctggtattgatcttttccccaaaaacagaactgagaaactttatatataactgatggtcccataaaacagatttgcataaaattaccatgattgctttatgtttatatttaacctggatttttggcccaacaaaattgtgtaaaatatatttgaagtttcagtgatttaacagtctttcccacctttcatgatttttatgagcccaggctttccagaaaaaaccttggaaataaattcccttgccttttgtccctttatcagcaaataaaacatggccttaacaaagttgtttgtgtttttggtcaattttaaaattatgtcggggcataccctataaaattactaacccttctgccccctgtagaatatgtttttatccttttcccttaaaaaaaaaaatggttttttctgga

SEQ ID NO: 549639 - DNA, 189 bp, Homo sapiens
gcagaagtttaataactttccttggaaaactgaaattgatgtgtgtgtgtttgtgtatatgtgcatgtggaacatgtgttgtgtgtgtgcaggagtctgtatatatgtggggggtatatgtggagtgtgatgtatgtatatgtatgtgtgcggcatgtgtgagcatgtatctatgtacatgcggtatgt

SEQ ID NO: 549640 - DNA, 316 bp, Homo sapiens
  misc_feature (10)..(10): n is a, c, g, or t
ccccacttcncaccaccccaaacccccgcctaattttttacactcccgcaagaatcttttacatcagtcacaagaatgaccttgcggcatacaagacacttccctccatgtaatgcacgggaaaaaaaagttcaggcactccataggatgtcggacaagaagacttccactctaataggatgaaaaaatgatcatttatttacatcattctgattccttttaatcgcttcacaatccactataaagaagattcgctctgaccctaaattttctactttttttcccacttttctctcacataaatcaggcgtctcat

SEQ ID NO: 549641 - DNA, 201 bp, Homo sapiens
gggagagaggctcaggtgggccggagcaagcgcgggggatggatacgggcgctgctggaagaggggcccagctgcgtggtgtcagcgccagtctgggcctcattccgcttggggagtcctggtgaccacgtgccccgagggggcgtctagagtactgagctgagggtccagtggggtctaagctcttcatccgttgtcggc

SEQ ID NO: 549642 - DNA, 238 bp, Homo sapiens
gggtgatccagaggatcccccgaacatgtcgaggctattgggacggctgagacaggagaatagcttgaataccagaggcagtaggttgcagtgcgctgaaatcgtgcctctgacatctagcctgggtgacacgagtgagaccccagctcataaaaaacaatatagacagttatatcccataccgggaacataagaagtagtgccgttaatctgagaaactccctaagattcgaaacaa

SEQ ID NO: 549643 - DNA, 3471 bp, Homo sapiens
aacacatcgacttgtgtaagaaaaagattggaagtgcggagctgtcttttgagcatgatgcatggatgtctaaacaattccaggcctttggagatttatttgatgaagctattaagttagggttaacagctattcaaactcagaatcctggtttctattaccagcaggcagcatactatgcccaggagcggaaacagcttgcaaaaaccctctgtaaccacgaagcttctgtaatgtatcccaatcctgatcccttagaaacacaaacaggcgttcttgacttttatggacaaagatcatggcgacaaggaatactaagttttgatctttctgatcctgaaaaagaaaaggtgggaattcttgccattcagctgaaggagagaaatgttgttcactctgagataatcataactcttctgagcaatgctgttgcacagttcaagaagtataagtgcccgcgaatgaaaagtcacctaatggttcagatgggagaggaatattattacgcaaaggattataccaaagctttgaagttgctggattatgtgatgtgtgattatcggagtgaaggatggtggactctgctcacttctgtattaactacagctctgaagtgctcctacctcatggcccaattaaaggattacattacttactccctagaactccttggtagagcttcaactctgaaagatgaccagaagtctcggatagaaaagaacctcataaatgttttaatgaatgaaagtcctgatccagaacccgactgtgatatcttagctgtgaaaactgctcagaagctgtgggcagaccgaatttctctggctggcagcaatattttcacaataggagtacaggactttgtgccatttgtgcagtgcaaagccaagtttcatgccccaagttttcatgttgatgttcctgttcagtttgatatttatctgaaggctgattgtccacatcccattaggttttccaagctctgtgtcagctttaataatcaggaatacaaccagttctgtgtaatagaagaagcatccaaagcaaatgaagttttagaaaatctgactcaaggaaagatgtgcctagttcctggcaaaacaagaaaactgttatttaagtttgttgcaaaaactgaagatgtgggaaagaaaattgagattacttcagtggatcttgctctgggcaatgagacgggaagatgtgtggttttaaattggcagggaggaggaggagatgctgcttcctcccaagaagccttacaggcagctcggtctttcaaaaggcgacctaagctacctgacaatgaagttcactgggacagcattataattcaggcaagcacaatgatcatatccagagtcccaaacatttctgtacatctgctacatgaaccccctgcactgactaatgaaatgtattgtttggttgtgactgttcagtcccatgaaaagacccaaatcagagatgtgaagctcactgctggcttaaaaccaggacaggatgccaatttaactcagaagactcacgtgactcttcatggaacagaactgtgtgatgaatcctacccggctttactcactgacattcctgttggagacttacatccaggggaacagctggaaaaaatgttgtatgttcgctgtggaacagtgggttccagaatgtttcttgtatatgtttcttacctgataaatacaaccgttgaagaaaaagaaattgtttgcaagtgtcacaaggatgaaactgtaacaattgaaacagtctttccatttgatgttgcggttaaatttgtttctaccaagtttgagcacctggaaagggtttatgctgacatcccctttctgttgatgacggacctcttaagtgcctcaccctgggccctcactattgtttccagtgagctccagcttgctccatccatgaccacagtggaccagctcgagtctcaagtggacaatgttatcttacagactggagagagtgctagtgaatgcttttgtcttcaatgcccatctcttggaaatattgaaggtggagtagcaaccgggcattatattatctcttggaaaaggacctcagcaatggagaatatccccatcatcacaactgtcatcactctgccgcacgtgattgtggagaatatccctctccatgtgaatgcagatctgccgtcatttgggcgtgtcagagagtcgttacctgtcaagtatcacctacagaataagaccgacttagttcaagatgtagaaatttctgtggagcccagtgatgccttcatgttctcaggtctcaaacagattcgattacgtatcctccctggcacggagcaggaaatgctatataatttctatcctctgatggctggataccagcagctgccatctctcaacatcaacttgcttagatttcctaacttcacaaatcagctgctcaggcgttttatacctaccagtatttttgtcaagccacagggtcgactcatggatgatacctctattgctgctgcatgatgttcaagaccggcccttggctgttgttacagagatgttgggcagagctatgcaggtgtttcattgtgaactctagctttgatcatggtaaaaagttaaccttttctattttttaatggatgttataccaactattcagaggaactcatacttcaaaaatattaggaaaatctgtcttatagtttctctaataaatatctgaaatctcagtacgacatgaaagaatgtcagaccattgttattgttgaaagtcatttgatgaatggtaaattctatgaaaagtaagtgatttgcatgtataatatcaggaaaattaagcatcccaagtgtgactggacaaagagagcagatgcaccagtgcctgtgccataaagttccgaatcccccatgtgtctctttcagagctggccagaccggaaataaatcattctcataaattcagtgtgtactcagaacacatacacaacaacatagggagttgtatgactgatacggaaaacttccagaaagttttaatcaaagcagtttaattaaggtatcaaaaatatctttgcttactatcaagaagtgtcaaataggttcagcttgctgccaaaatatggatcatttatgaagcaggttcatattttagaggtgttaataaaatcctcatcggaaaagatccaaagtgcaaggatttgattataaacataatttcctagactgaaagtttttggaaaagatgcagggtctgagtcaggccttctggttatattgtgcagtttcaaaagaactatttaaaactcttgaaaactcatgtaaataaaaatcatagggtgaaaattgtatttgttaaaataccttaataatttaaaatgacctgatttcctggaaaattttattattcaaaaggtggaggcattgtaaaaaggaaatagtgatgtaaataaacatgttctctttcaagtaaaaaaaaaaa

SEQ ID NO: 549644 - DNA, 695 bp, Homo sapiens
cagcactgatgttctgcccgggatgaagcctgacccctcccgcattgcccgccccgccgtgcgcctcctgccatgctgctactgcgcctgtcctccgtcgtcctgctctcgtggccaatgctgctgtgcggtgcctgcttctgcgccggcttcgaggccgaggtgctgcacactggtgctcgccggcctgcctgctgccgcccggcgcggtggtggccgtgttgctgcctcgtggcggcaatggactccactggtgcttggctgcacgtgctgctgcgcgctggcgccgtgcctgggcatctcactgcagctcgtggccgtcgatgagggcatcggtggctacctgggacgcggcgttggctggccgtgctggtgccatgtgcggcgcgctgggagctgccgctcacggtcgtggcctacgaagacctctttgggggctggacgatggacgccgtggccctgcatgcacagccggctccggccgcagccgctcctgctgcaccttctgtggagtgctgcggcgccagggcgctggaggaaggggcgcgccgagttgggagccacgcaacatcgtgacaggtcacaactgccgacgacatggcggagaccgtgctccatgaacttcctacggggctgacgcggggctggctggcccgtgtgcgggggcctgggctctcccggcgaggggggcgcca

SEQ ID NO: 549645 - DNA, 1506 bp, Homo sapiens
tccaattttaaaataataagagaaacaaaaagagccgtggcgacttaggagtcactagctgatgagttgctcatctatatatcctggtctggatcactaacagtacctgccagtgactcctctctccactctattgttctgagatgactcgacgacgtagcctttaaacattaactgcagtctggtccacagatgtgacttaaagtcgagcatcaatgtatacgctcagatgatcgctcacgatgagcctgcacggcctggaactccatcttgggcgagctattcaaaacagttgctaactgttctagaatcagaccttcgaagcaaggaaattctgggtttaaaattgcacctctcggggggcagtggcctggtacatcaggacttgctgtaagggcacattcctccagtgcaagttcctaatgtgcagctgaggtcgcaggacgctcgagcacagaaaatggctaatctgaagatgcgatcctctatgtggatcatctggcccgtgtgaaagggccaggacagtgtgtcgttcctgacatagttgaaacctctcaagaaactactagtatatactatactatactgcaaacgagttaagaccaggttgtccacgccaatgtggatagaatcaccgcacgcgctgtttcaaagactcaaccggctttagaactgtggcttcacacaaaatcacttacagcacccatcggcttgcgataaccgtattacacaggcaatataagagaggaaatatatgcacgtgttgacacagctatcacaacagcctatcacagtggccgccacaaaataatccagtcgtcccgagcaaaaacaccgcgatattatggacaagcgcccaaactgtcacgatgacaacggaaggatggtacacgacgtgccgctaacaagacgtcgcgttgcatgataaaagatagtttcttaaaaacaacacagcacacacacagcaccatccgacgagcaccagcaaaagcaacccacgcacagcacctccgatcactacgagcagaacaacaaccaacagagacccgaccatacgaagcacagacgacaataaactagtacaacaaaacaacctaaacaattcatatacaacaacttatcataaaatatctatacatcaaatacaacatacactcatccaccactcactatcaattactacaatataacacataaaagctacgaggcacaaaacgagaacctagctcacgctggaacggacacaaaagatataaaactgactcagaacaagaggacgagtgagacatactatacgaagtcaagcaagcatagacgaccgcacaggcagatacacgaaggataccaaggaaacaagagaacagcaaacaagagaagagtagatcgaacgaacagcagatgtatagagagaggacagaacccacatgacgacagccgaaacagagcagcgactagcaacagcagaatgccacttcacacgtgcaccgacacgatctcgcacaaccc

SEQ ID NO: 549646 - DNA, 1196 bp, Homo sapiens
ctctcaacatcaacttgcttagatggcagctgctggtatccagccatcagaggatagaaattatatagcatttcctgctccgtgccagggaggataccagcagctgccatctctcaacatcaacttgcttagatttcctaacttcacaaatcagctgctcaggcgttttatacctaccagtatttttgtcaagccacagggtcgactcatggatgatacctctattgctgctgcatgatgttcaagaccggcccttggctgttgttacagagatgttgggcagagctatgcaggtgtttcattgtgaactctagctttgatcatggtaaaaagttaaccttttctattttttaatggatgttataccaactattcagaggaactcatacttcaaaaatattaggaaaatctgtcttatagtttctctaataaatatctgaaatctcagtacgacatgaaagaatgtcagaccattgttattgttgaaagtcatttgatgaatggtaaattctatgaaaagtaagtgatttgcatgtataatatcaggaaaattaagcatcccaagtgtgactggacaaagagagcagatgcaccagtgcctgtgccataaagttccgaatcccccatgtgtctctttcagagctggccagaccggaaataaatcattctcataaattcagtgtgtactcagaacacatacacaacaacatagggagttgtatgactgatacggaaaacttccagaaagttttaatcaaagcagtttaattaaggtatcaaaaatatctttgcttactatcaagaagtgtcaaataggttcagcttgctgccaaaatatggatcatttatgaagcaggttcatattttagaggtgttaataaaatcctcatcggaaaagatccaaagtgcaaggatttgattataaacataatttcctagactgaaagtttttggaaaagatgcagggtctgagtcaggccttctggttatattgtgcagtttcaaaagaactatttaaaactcttgaaaactcatgtaaataaaaatcatagggtgaaaattgtatttgttaaaataccttaataatttaaaatgacctgatttcctggaaaattttattattcaaaaggtggaggcattgtaaaaaggaaatagtgatgtaaataaacatgttctctttcaagtaaaaaaaaaaa

SEQ ID NO: 549647 - DNA, 3218 bp, Homo sapiens
agcggagaatgttgaagagtctgaaatgattatattaaataaaggtttcaaggagtgtacacatacaacgttcatatgaagatttatattaaatgagctgtctaaaatgagttgtgtctcatcttacgcaggttttgatctttctgatcctgaaaaagaaaaggtgggaattcttgccattcagctgaaggagagaaatgttgttcactctgagataatcataactcttctgagcaatgctgttgcacagttcaagaagtataagtgcccgcgaatgaaaagtcacctaatggttcagatgggagaggaatattattacgcaaaggattataccaaagctttgaagttgctggattatgtgatgtgtgattatcggagtgaaggatggtggactctgctcacttctgtattaactacagctctgaagtgctcctacctcatggcccaattaaaggattacattacttactccctagaactccttggtagagcttcaactctgaaagatgaccagaagtctcggatagaaaagaacctcataaatgttttaatgaatgaaagtcctgatccagaacccgactgtgatatcttagctgtgaaaactgctcagaagctgtgggcagaccgaatttctctggctggcagcaatattttcacaataggagtacaggactttgtgccatttgtgcagtgcaaagccaagtttcatgccccaagttttcatgttgatgttcctgttcagtttgatatttatctgaaggctgattgtccacatcccattaggttttccaagctctgtgtcagctttaataatcaggaatacaaccagttctgtgtaatagaagaagcatccaaagcaaatgaagttttagaaaatctgactcaaggaaagatgtgcctagttcctggcaaaacaagaaaactgttatttaagtttgttgcaaaaactgaagatgtgggaaagaaaattgagattacttcagtggatcttgctctgggcaatgagacgggaagatgtgtggttttaaattggcagggaggaggaggagatgctgcttcctcccaagaagccttacaggcagctcggtccacaatgatcatatccagagtcccaaacatttctgtacatctgctacatgaaccccctgcactgactaatgaaatgtattgtttggttgtgactgttcagtcccatgaaaagacccaaatcagagatgtgaagctcactgctggcttaaaaccaggacaggatgccaatttaactcagaagactcacgtgactcttcatggaacagaactgtgtgatgaatcctacccggctttactcactgacattcctgttggagacttacatccaggggaacagctggaaaaaatgttgtatgttcgctgtggaacagtgggttccagaatgtttcttgtatatgtttcttacctgataaatacaaccgttgaagaaaaagaaattgtttgcaagtgtcacaaggatgaaactgtaacaattgaaacagtctttccatttgatgttgcggttaaatttgtttctaccaagtttgagcacctggaaagggtttatgctgacatcccctttctgttgatgacggacctcttaagtgcctcaccctgggccctcactattgtttccagtgagctccagcttgctccatccatgaccacagtggaccagctcgagtctcaagtggacaatgttatcttacagactggagagagtgctagtgaatgcttttgtcttcaatgcccatctcttggaaatattgaaggtggagtagcaaccgggcattatattatctcttggaaaaggacctcagcaatggagaatatccccatcatcacaactgtcatcactctgccgcacgtgattgtggagaatatccctctccatgtgaatgcagatctgccgtcatttgggcgtgtcagagagtcgttacctgtcaagtatcacctacagaataagaccgacttagttcaagatgtagaaatttctgtggagcccagtgatgccttcatgttctcaggtctcaaacagattcgattacgtatcctccctggcacggagcaggaaatgctatataatttctatcctctgatggctggataccagcagctgccatctctcaacatcaacttgcttagatttcctaacttcacaaatcagctgctcaggcgttttatacctaccagtatttttgtcaagccacagggtcgactcatggatgatacctctattgctgctgcatgatgttcaagaccggcccttggctgttgttacagagatgttgggcagagctatgcaggtgtttcattgtgaactctagctttgatcatggtaaaaagttaaccttttctattttttaatggatgttataccaactattcagaggaactcatacttcaaaaatattaggaaaatctgtcttatagtttctctaataaatatctgaaatctcagtacgacatgaaagaatgtcagaccattgttattgttgaaagtcatttgatgaatggtaaattctatgaaaagtaagtgatttgcatgtataatatcaggaaaattaagcatcccaagtgtgactggacaaagagagcagatgcaccagtgcctgtgccataaagttccgaatcccccatgtgtctctttcagagctggccagaccggaaataaatcattctcataaattcagtgtgtactcagaacacatacacaacaacatagggagttgtatgactgatacggaaaacttccagaaagttttaatcaaagcagtttaattaaggtatcaaaaatatctttgcttactatcaagaagtgtcaaataggttcagcttgctgccaaaatatggatcatttatgaagcaggttcatattttagaggtgttaataaaatcctcatcggaaaagatccaaagtgcaaggatttgattataaacataatttcctagactgaaagtttttggaaaagatgcagggtctgagtcaggccttctggttatattgtgcagtttcaaaagaactatttaaaactcttgaaaactcatgtaaataaaaatcatagggtgaaaattgtatttgttaaaataccttaataatttaaaatgacctgatttcctggaaaattttattattcaaaaggtggaggcattgtaaaaaggaaatagtgatgtaaataaacatgttctctttcaagtaaaaaaaaaaa

SEQ ID NO: 549648 - DNA, 1010 bp, Homo sapiens
  misc_feature (1010)..(1010): n is a, c, g, or t
gggtcctccgtgcgcacgtcgcaggtgggactaagcatgtggtctggtagaagcgatcgggcggccgtcgggcccctgtcggtccgggcgcgctacaggaccgcgcgacaaggcgcattggacgcacccgctgtgcagccttgaatccgactctggccatcgttgcagattcccgtccctcgcctgggcgtcgagctggggggtggtgcggaccttcgctgggtttcctcgtctctgtgagcttcttgcctctgatgcacattcctcgttgttacatggccacgttctcgcgttgatgacagggctcgcatggtagtgaggatggcctacggtcggtcccccattggacgtcgccatgggtcgtaaggcgggaggaaccagactgggcggactgcagtgagaacctcgacaatgagggcccgaagcccatggagagctgtggccaggagagacaggatgtgtccctgtagtctgcctagccgtctcggtgccccctgtgatgccccgtggcgagatcctggaggagagtgtgagaagagagggcgactggaggtcgggctattgggctcggggactctcagcactgggttctataggtacatcaggtatgacttgtgaacctctgagcatctttaacctgtgaggtctgcagagacgtgcctacggcattgccatgcttacatgcgaacgctaccgggcgctatacgtgggccgcttatgagtctagaaagcaccgacaaaaacccaaagatctatggggcaaacattacttggcagcctattgttgacattccgtattcggcttgcaatgacaagggaccaacgaccatgaacccgttttcgaattggtgctcatctgtgaacaaggccgggacacatcatgatgtttgcgcttgtggccctgggccaaaggcatggacccattgtgcaagagagagggtgacaagatagattacaatagcatatatttattcagaaatagatataatggcatacaacacttagtgatn

SEQ ID NO: 549649 - DNA, 3074 bp, Homo sapiens
agcggagaatgttgaagagtctgaaatgattatattaaataaaggtttcaaggagtgtacacatacaacgttcatatgaagatttatattaaatgagctgtctaaaatgagttgtgtctcatcttacgcaggttttgatctttctgatcctgaaaaagaaaaggtgggaattcttgccattcagctgaaggagagaaatgttgttcactctgagataatcataactcttctgagcaatgctgttgcacagttcaagaagtataagtgcccgcgaatgaaaagtcacctaatggttcagatgggagaggaatattattacgcaaaggattataccaaagctttgaagttgctggattatgtgatgtgtgattatcggagtgaaggatggtggactctgctcacttctgtattaactacagctctgaagtgctcctacctcatggcccaattaaaggattacattacttactccctagaactccttggtagagcttcaactctgaaagatgaccagaagtctcggatagaaaagaacctcataaatgttttaatgaatgaaagtcctgatccagaacccgactgtgatatcttagctgtgaaaactgctcagaagctgtgggcagaccgaatttctctggctggcagcaatattttcacaataggagtacaggactttgtgccatttgtgcagtgcaaagccaagtttcatgccccaagttttcatgttgatgttcctgttcagtttgatatttatctgaaggctgattgtccacatcccattaggttttccaagctctgtgtcagctttaataatcaggaatacaaccagttctgtgtaatagaagaagcatccaaagcaaatgaagttttagaaaatctgactcaaggaaagatgtgcctagttcctggcaaaacaagaaaactgttatttaagtttgttgcaaaaactgaagatgtgggaaagaaaattgagattacttcagtggatcttgctctgggcaatgagacgggaagatgtgtggttttaaattggcagggaggaggaggagatgctgcttcctcccaagaagccttacaggcagctcggtctttcaaaaggcgacctaagctacctgacaatgaagttcactgggacagcattataattcaggcaagcacaatgatcatatccagagtcccaaacatttctgtacatctgctacatgaaccccctgcactgactaatgaaatgtattgtttggttgtgactgttcagtcccatgaaaagacccaaatcagagatgtgaagctcactgctggcttaaaaccaggacaggatgccaatttaactcagaagactcacgtgactcttcatggaacagaactgtgtgatgaatcctacccggctttactcactgacattcctgttggagacttacatccaggggaacagctggaaaaaatgttgtatgttcgctgtggaacagtgggttccagaatgtttcttgtatatgtttcttacctgataaatacaaccgttgaagaaaaagaaattgtttgcaagtgtcacaaggatgaaactgtaacaattgaaacagtctttccatttgatgttgcggttaaatttgtttctaccaagtttgagcacctggaaagggtttatgctgacatcccctttctgttgatgacggacctcttaagtgcctcaccctgggccctcactattgtttccagtgagctccagcttgctccatccatgaccacagtggaccagctcgagtctcaagtggacaatgttatcttacagactggagagagtgctagtgaatgcttttgtcttcaatgcccatctcttggaaatattgaaggtggagtagcaaccgggcattatattatctcttggaaaaggacctcagcaatggagaatatccccatcatcacaactgtcatcactctgccgcacgtgattgtggagaatatccctctccatgtgaatgcagatctgccatctctcaacatcaacttgcttagatttcctaacttcacaaatcagctgctcaggcgttttatacctaccagtatttttgtcaagccacagggtcgactcatggatgatacctctattgctgctgcatgatgttcaagaccggcccttggctgttgttacagagatgttgggcagagctatgcaggtgtttcattgtgaactctagctttgatcatggtaaaaagttaaccttttctattttttaatggatgttataccaactattcagaggaactcatacttcaaaaatattaggaaaatctgtcttatagtttctctaataaatatctgaaatctcagtacgacatgaaagaatgtcagaccattgttattgttgaaagtcatttgatgaatggtaaattctatgaaaagtaagtgatttgcatgtataatatcaggaaaattaagcatcccaagtgtgactggacaaagagagcagatgcaccagtgcctgtgccataaagttccgaatcccccatgtgtctctttcagagctggccagaccggaaataaatcattctcataaattcagtgtgtactcagaacacatacacaacaacatagggagttgtatgactgatacggaaaacttccagaaagttttaatcaaagcagtttaattaaggtatcaaaaatatctttgcttactatcaagaagtgtcaaataggttcagcttgctgccaaaatatggatcatttatgaagcaggttcatattttagaggtgttaataaaatcctcatcggaaaagatccaaagtgcaaggatttgattataaacataatttcctagactgaaagtttttggaaaagatgcagggtctgagtcaggccttctggttatattgtgcagtttcaaaagaactatttaaaactcttgaaaactcatgtaaataaaaatcatagggtgaaaattgtatttgttaaaataccttaataatttaaaatgacctgatttcctggaaaattttattattcaaaaggtggaggcattgtaaaaaggaaatagtgatgtaaataaacatgttctctttcaagtaaaaaaaaaaa

SEQ ID NO: 549650 - DNA, 394 bp, Homo sapiens
  misc_feature (159)..(159): n is a, c, g, or t
gactaacacatccctaaccaggtgtggtggtgtacttgtagtctcagctacttgggaggctgaggtgggaggattgcctgagcctgggaaggtggaggttgcagtgagctgagatagtgccactgcactccagcttgggtgacagagtgaaaccttgtntcagaaaaaaaaaaaaaaaggaaaagaaaagacttttttttatacaagaggcctcaggatattcagggacagtggctagcaataaatgtgggcttatctccatgcctgtttccatgatctcctaatgcgggttctgccataagctcagattctataaatctcaaagcactcttttaaaaaaatttatttaaatgggacggtggtctgtgatgtacaaggctgttaagggtgctgt

SEQ ID NO: 549651 - DNA, 122 bp, Homo sapiens
aaaaaaaaaagggggggccccccccttttttttccccctttggggggggggggggggggttttttttttggggggggttttttcccccccccggggtttttaggggccccccgttttttcca

SEQ ID NO: 549652 - DNA, 1567 bp, Homo sapiens
accattgcataaggaatataaagacttttccctgtagttatcttacagactggagagagtgctagtgaatgcttttgtcttcaatgcccatctcttggaaatattgaaggtggagtagcaaccgggcattatattatctcttggaaaaggacctcagcaatggagaatatccccatcatcacaactgtcatcactctgccgcacgtgattgtggagaatatccctctccatgtgaatgcagatctgtcatctttctctgtagatctgccgtcatttgggcgtgtcagagagtcgttacctgtcaagtatcacctacagaataagaccgacttagttcaagatgtagaaatttctgtggagcccagtgatgccttcatgttctcaggtctcaaacagattcgattacgtatcctccctggcacggagcaggaaatgctatataatttctatcctctgatggctggataccagcagctgccatctctcaacatcaacttgcttagatttcctaacttcacaaatcagctgctcaggcgttttatacctaccagtatttttgtcaagccacagggtcgactcatggatgatacctctattgctgctgcatgatgttcaagaccggcccttggctgttgttacagagatgttgggcagagctatgcaggtgtttcattgtgaactctagctttgatcatggtaaaaagttaaccttttctattttttaatggatgttataccaactattcagaggaactcatacttcaaaaatattaggaaaatctgtcttatagtttctctaataaatatctgaaatctcagtacgacatgaaagaatgtcagaccattgttattgttgaaagtcatttgatgaatggtaaattctatgaaaagtaagtgatttgcatgtataatatcaggaaaattaagcatcccaagtgtgactggacaaagagagcagatgcaccagtgcctgtgccataaagttccgaatcccccatgtgtctctttcagagctggccagaccggaaataaatcattctcataaattcagtgtgtactcagaacacatacacaacaacatagggagttgtatgactgatacggaaaacttccagaaagttttaatcaaagcagtttaattaaggtatcaaaaatatctttgcttactatcaagaagtgtcaaataggttcagcttgctgccaaaatatggatcatttatgaagcaggttcatattttagaggtgttaataaaatcctcatcggaaaagatccaaagtgcaaggatttgattataaacataatttcctagactgaaagtttttggaaaagatgcagggtctgagtcaggccttctggttatattgtgcagtttcaaaagaactatttaaaactcttgaaaactcatgtaaataaaaatcatagggtgaaaattgtatttgttaaaataccttaataatttaaaatgacctgatttcctggaaaattttattattcaaaaggtggaggcattgtaaaaaggaaatagtgatgtaaataaacatgttctctttcaagtaaaaaaaaaaa

SEQ ID NO: 549653 - DNA, 1329 bp, Homo sapiens
ggcagtagctgctggaacgcagggttgagagagaagtactgacagaagaggattcttcgggtggaagtgcagagtcagctggtgatggctacaggagagggcagctcccagcctgtgccgtggccatccccaggtgcaagtgaagaaagaaagaggtggggtgaaaggaggagaatcaccatatcaccatttttattttgatgcttacactcatttattctgtttttgtaaaacagtttcaagaatttaaaaatccttccagttaatagagcttttgttattatattataattttgtaaacccactttgtttttcccactttaaagccacagggtcgactcatggatgatacctctattgctgctgcatgatgttcaagaccggcccttggctgttgttacagagatgttgggcagagctatgcaggtgtttcattgtgaactctagctttgatcatggtaaaaagttaaccttttctattttttaatggatgttataccaactattcagaggaactcatacttcaaaaatattaggaaaatctgtcttatagtttctctaataaatatctgaaatctcagtacgacatgaaagaatgtcagaccattgttattgttgaaagtcatttgatgaatggtaaattctatgaaaagtaagtgatttgcatgtataatatcaggaaaattaagcatcccaagtgtgactggacaaagagagcagatgcaccagtgcctgtgccataaagttccgaatcccccatgtgtctctttcagagctggccagaccggaaataaatcattctcataaattcagtgtgtactcagaacacatacacaacaacatagggagttgtatgactgatacggaaaacttccagaaagttttaatcaaagcagtttaattaaggtatcaaaaatatctttgcttactatcaagaagtgtcaaataggttcagcttgctgccaaaatatggatcatttatgaagcaggttcatattttagaggtgttaataaaatcctcatcggaaaagatccaaagtgcaaggatttgattataaacataatttcctagactgaaagtttttggaaaagatgcagggtctgagtcaggccttctggttatattgtgcagtttcaaaagaactatttaaaactcttgaaaactcatgtaaataaaaatcatagggtgaaaattgtatttgttaaaataccttaataatttaaaatgacctgatttcctggaaaattttattattcaaaaggtggaggcattgtaaaaaggaaatagtgatgtaaataaacatgttctctttcaagtaaaaaaaaaaa

SEQ ID NO: 549654 - DNA, 3130 bp, Homo sapiens
agcggagaatgttgaagagtctgaaatgattatattaaataaaggtttcaaggagtgtacacatacaacgttcatatgaagatttatattaaatgagctgtctaaaatgagttgtgtctcatcttacgcaggttttgatctttctgatcctgaaaaagaaaaggtgggaattcttgccattcagctgaaggagagaaatgttgttcactctgagataatcataactcttctgagcaatgctgttgcacagttcaagaagtataagtgcccgcgaatgaaaagtcacctaatggttcagatgggagaggaatattattacgcaaaggattataccaaagctttgaagttgctggattatgtgatgtgtgattatcggagtgaaggatggtggactctgctcacttctgtattaactacagctctgaagtgctcctacctcatggcccaattaaaggattacattacttactccctagaactccttggtagagcttcaactctgaaagatgaccagaagtctcggatagaaaagaacctcataaatgttttaatgaatgaaagtcctgatccagaacccgactgtgatatcttagctgtgaaaactgctcagaagctgtgggcagaccgaatttctctggctggcagcaatattttcacaataggagtacaggactttgtgccatttgtgcagtgcaaagccaagtttcatgccccaagttttcatgttgatgttcctgttcagtttgatatttatctgaaggctgattgtccacatcccattaggttttccaagctctgtgtcagctttaataatcaggaatacaaccagttctgtgtaatagaagaagcatccaaagcaaatgaagttttagaaaatctgactcaaggaaagatgtgcctagttcctggcaaaacaagaaaactgttatttaagtttgttgcaaaaactgaagatgtgggaaagaaaattgagattacttcagtggatcttgctctgggcaatgagacgggaagatgtgtggttttaaattggcagggaggaggaggagatgctgcttcctcccaagaagccttacaggcagctcggtctttcaaaaggcgacctaagctacctgacaatgaagttcactgggacagcattataattcaggcaagcacaatgatcatatccagagtcccaaacatttctgtacatctgctacatgaaccccctgcactgactaatgaaatgtattgtttggttgtgactgttcagtcccatgaaaagacccaaatcagagatgtgaagctcactgctggcttaaaaccaggacaggatgccaatttaactcagaagactcacgtgactcttcatggaacagaactgtgtgatgaatcctacccggctttactcactgacattcctgttggagacttacatccaggggaacagctggaaaaaatgttgtatgttcgctgtggaacagtgggttccagaatgtttcttgtatatgtttcttacctgataaatacaaccgttgaagaaaaagaaattgtttgcaagtgtcacaaggatgaaactgtaacaattgaaacagtctttccatttgatgttgcggttaaatttgtttctaccaagtttgagcacctggaaagggtttatgctgacatcccctttctgttgatgacggacctcttaagtgcctcaccctgggccctcactattgtttccagtgagctccagcttgctccatccatgaccacagtggaccagctcgagtctcaagtggacaatgttatcttacagactggagagagtgctagtgaatgcttttgtcttcaatgcccatctcttggaaatattgaaggtggagtagcaaccgggcattatattatctcttggaaaaggacctcagcaatggagaatatccccatcatcacaactgtcatcactctgccgcacgtgattgtggagaatatccctctccatgtgaatgcagatctgccgtcatttgggcgtgtcagagagtcgttacctgtcaagtatcacctacagaataagaccgacttagttcaagatgtagaaatttctgtggagcccagtgatgccttcatgttctcaggtctcaaacagattcgattacgtatcctccctggcacggagcaggaaatgctatataatttctatcctctgatggctggataccagcagctgccatctctcaacatcaacttgcttagatttcctaacttcacaaatcagctgctcaggcgttttatacctaccagtatttttgtcaagccacagggtcgactcatggatgatacctctattgctgctgcatgatgttcaagaccggcccttggctgttgttacagagatgttgggcagagctatgcaggtgtttcattgtgaactctagctttgatcatggtaaaaagttaaccttttctattttttaatggatgttataccaactattcagaggaactcatacttcaaaaatattaggaaaatctgtcttatagtttctctaataaatatctgaaatctcagtacgacatgaaagaatgtcagaccattgttattgttgaaagtcatttgatgaatggtaaattctatgaaaagtaagtgatttgcatgtataatatcaggaaaattaagcatcccaagtatgactgatacggaaaacttccagaaagttttaatcaaagcagtttaattaaggtatcaaaaatatctttgcttactatcaagaagtgtcaaataggttcagcttgctgccaaaatatggatcatttatgaagcaggttcatattttagaggtgttaataaaatcctcatcggaaaagatccaaagtgcaaggatttgattataaacataatttcctagactgaaagtttttggaaaagatgcagggtctgagtcaggccttctggttatattgtgcagtttcaaaagaactatttaaaactcttgaaaactcatgtaaataaaaatcatagggtgaaaattgtatttgttaaaataccttaataatttaaaatgacctgatttcctggaaaattttattattcaaaaggtggaggcattgtaaaaaggaaatagtgatgtaaataaacatgttctctttcaagtaaaaaaaaaaa

SEQ ID NO: 549655 - DNA, 586 bp, Homo sapiens
agggaatcttaccattaatagatatgttgtctagcctgagctgtataccaattcttatgggggacaagggtaaaatgacagactttttagttaaagtgaagaaaagcatctttcagtccatagttaaactcctaccataatgcaacaagtgagctggcatacatggacagcttcagttgtgactgggtacacgtttaaaaacttattactgcaggtattataatcatagtgcactgccatgtcagtctgtcatgtctacagcggcgtacgcttaaataatagaccgtaggcgctccagtaaacacagatactggtctttatacaaattagttctgccagtcagaagcaatgtgtatgtaaagatgggcagcgctaatttactatactattacataaagaagtttagggtcatcaccacagcctatgttggacccaggattaggatcttgttgtattcgtctcagtcactgtcatcatgttgtataactctaacctacgtttcctacggatgagacctgtctcaatctaaaaattcgtgtgtcctgcacccagctcttaaaaggcctggtgtgctaatgcatcctag

SEQ ID NO: 549656 - DNA, 2534 bp, Homo sapiens
agcggagaatgttgaagagtctgaaatgattatattaaataaaggtttcaaggagtgtacacatacaacgttcatatgaagatttatattaaatgagctgtctaaaatgagttgtgtctcatcttacgcaggttttgatctttctgatcctgaaaaagaaaaggtgggaattcttgccattcagctgaaggagagaaatgttgttcactctgagataatcataactcttctgagcaatgctgttgcacagttcaagaagtataagtgcccgcgaatgaaaagtcacctaatggttcagatgggagaggaatattattacgcaaaggattataccaaagctttgaagttgctggattatgtgatgtgtgattatcggagtgaaggatggtggactctgctcacttctgtattaactacagctctgaagtgctcctacctcatggcccaattaaaggattacattacttactccctagaactccttggtagagcttcaactctgaaagatgaccagaagtctcggatagaaaagaacctcataaatgttttaatgaatgaaagtcctgatccagaacccgactgtgatatcttagctgtgaaaactgctcagaagctgtgggcagaccgaatttctctggctggcagcaatattttcacaataggagtacaggactttgtgccatttgtgcagtgcaaagccaagtttcatgccccaagttttcatgttgatgttcctgttcagtttgatatttatctgaaggctgattgtccacatcccattaggttttccaagctctgtgtcagctttaataatcaggaatacaaccagttctgtgtaatagaagaagcatccaaagcaaatgaagttttagaaaatctgactcaaggaaagatgtgcctagttcctggcaaaacaagaaaactgttatttaagtttgttgcaaaaactgaagatgtgggaaagaaaattgagattacttcagtggatcttgctctgggcaatgagacgggaagatgtgtggttttaaattggcagggaggaggaggagatgctgcttcctcccaagaagccttacaggcagctcggtctttcaaaaggcgacctaagctacctgacaatgaagttcactgggacagcattataattcaggcaagcacaatgatcatatccagagtcccaaacatttctgtacatctgctacatgaaccccctgcactgactaatgaaatgtattgtttggttgtgactgttcagtcccatgaaaagacccaaatcagagatgtgaagctcactgctggcttaaaaccaggacaggatgccaatttaactcagaagactcacgtgactcttcatggaacagaactgtgtgatgaatcctacccggctttactcactgacattcctgttggagacttacatccaggggaacagctggaaaaaatgttgtatgttcgctgtggaacagtgggttccagaatgtttcttgtatatgtttcttacctgataaatacaaccgttgaagaaaaagaaattgtttgcaagtgtcacaaggatgaaactgtaacaattgaaacagtctttccatttgatgttgcggttaaatttgtttctaccaagtttgagcacctggaaagggtttatgctgacatcccctttctgttgatgacggacctcttaagtgcctcaccctgggccctcactattgtttccagtgagctccagcttgctccatccatgaccacagtggaccagctcgagtctcaagtggacaatgttatcttacagactggagagagtgctagtgaatgcttttgtcttcaatgcccatctcttggaaatattgaaggtggagtagcaaccgggcattatattatctcttggaaaaggacctcagcaatggagaatatccccatcatcacaactgtcatcactctgccgcacgtgattgtggagaatatccctctccatgtgaatgcagatctgccgtcatttgggcgtgtcagagagtcgttacctgtcaagtatcacctacagaataagaccgacttagttcaagatgtagaaatttctgtggagcccagtgatgccttcatgttctcaggtctcaaacagattcgattacgtatcctccctggcacggagcaggaaatgctatataatttctatcctctgatggctggataccagcagctgccatctctcaacatcaacttgcttagatttcctaacttcacaaatcagctgctcaggcgttttatacctaccagtatttttgtcaagccacagggtcgactcatggatgatacctctattgctgctgcatgatgttcaagaccggcccttggctgttgttacagagatgttgggcagagctatgcaggtgtttcattgtgaactctagctttgatcatggtaaaaagttaaccttttctattttttaatggatgttataccaactattcagaggaactcatacttcaaaaatattaggaaaatctgtcttatagtttctctaataaatatctgaaatctc

SEQ ID NO: 549657 - DNA, 500 bp, Homo sapiens
tattttgccactgcgagaagatttattgaaagcttaggatgtcattctacatagaagtgagggtatgtgacagtcatgacagtaaagtcctttcaaacaaatactactggtatactagaggtaggtttgtgatcgatgattcctggtgagaatttaaggatagacctcttatttgtttgagatagatggatagatagatagatagatagacagacagacagacagagttggatatatgtgagaggatttttactgaatacctaccatgtgccagaaacaggactagaactttagaaggacacaaagtctaacatgggcccttttccccaagagctcctaacatcagtgagaggccagatgtcttttcagtaaggctgaaatatatatgatgtgctttctaattatacatgttaaacaccattaggtatttgccaatgaataggttgtaaattataagacttcgctattgaaagaaaggagtaatcatctgggaagggaag

SEQ ID NO: 549658 - DNA, 444 bp, Homo sapiens
gtctctagagatccccacgtgcgggcgtagtctgcctgcctgttagcctccatgtctgcttttctgttcctcttggcctctagtgttcctgccttttgatgcctttgcagtgcatatcagccactttctttggggcctatacagcatctaacgagctgtaggagttcttcctcgtactttatttctttgcccccagcagtttagggtcctctttccttatatatagctccgtgaacatgcaatgtggcccaggcttatttggagtcagtataaacattgactttggttgtcttttgctagctcaagggctcttgtcagggctattaggtctgctttctgggctgatgttctgtgggcagaaactgagcctctaccactgagtccaatgttactactgcatacccggcctgccggatcccttccaataccatattgcttccatct

SEQ ID NO: 549659 - DNA, 451 bp, Homo sapiens
  misc_feature (31)..(31): n is a, c, g, or t
aagtgaaataactggtttttactgtggctantttgcccactttggttattaattattattagtttttcccattttatttttattcagtttcattgttttcaagtttatcccaatttataaagggcttttttccctttataaattacagggagaaaatgagaacccctgtgcatggctggtgggaatgtgaaatggtgtagccactatggaaaacagtatggcagttcctcagacattaaacacagagttagcatgtgatctgcagttccacctctgcgtatatacccaaaagaactcgaaagcgagggacacgaacagatatttgcatacctgtgttcacagcagcattattcaccatggggaaaagggggaagcaacccaaatgttcattgacagatgaatagatcaagcaacgtgagatgtctatataaccagaatattatttaacctc

SEQ ID NO: 549660 - DNA, 1016 bp, Homo sapiens
  misc_feature (799)..(799): n is a, c, g, or t
  misc_feature (822)..(822): n is a, c, g, or t
ggcagtagcagaacacctgctctcatgaacttcatgatgacaggctcttgggtgacaattggtgcgacctttgcagccatgattggagctggaatgcttgtacactcaatatcatatgagcagacccaggcccaaagcatctggcttggatgctgcattctggtgtgatgggtgcagttgtggctcctctgacgatcttaggggggcctcttctcctgagagccgcatggtacaccgctggtattgtgggaggcctctctactgtggccatgtgtgcgcctagtgagaagtttctgaacatgggagcacccctgggagtgggcctgggtcttgtctttgcgtcttctctggggtctatgtttcttccccctacctctgtggctggtgccactctgtactcagtggcaatgtatggtggattagttcttttcagcatgttccttctgtatgatactcagaaagtaatcaaacgtgcagaaataacacccatgtatggagctcaaaagtatgatcccatcaattcgatgttgacaatctacatggatacattaaatatatttatgcgagttgcaactatgctagcaactggaagcaacagaaagaaatgaagtaaccgcttgtgatgtctccgctcactgatgtcttgcttgtttaataggagcagatagtcattacagtttgcatcagcagaattccttgaggtttagaagatagcctgtcaccatgtttaaaatgtgcagtaatgcgacccttcaggcatgcctttcttttagaaaataaatgcaatagatgtcttccnaatatattttcatctcttatgcnttctactttaaaactgcttgatgaatgtgtgaaccaactatattttagaagattgcaagtatgggtatgtttgggtaaggtaagctttagcaaatgggtggcttcatttgtgggagccggcgaatattccggggctctgggtgcagttgtatagggtcaaaaataaggctgaacagtgaggccgaaccggtggg

SEQ ID NO: 549661 - DNA, 474 bp, Homo sapiens
  misc_feature (90)..(90): n is a, c, g, or t
  misc_feature (140)..(140): n is a, c, g, or t
  misc_feature (196)..(198): n is a, c, g, or t
tgggctcattgtgaccactggcctctctacagccaccctgtggcctgttcaaggcagaacccacgacccttgactccccgggtggggagnttgccaaggatgctggagctgaatcagacgctgacgggtctggcgggcgnttggtgttttcacaatcgaattgaacacattggccaaataaggttgaaattttaannnaaaaaaaaaaaaactcgagactagcaaggtgctgggattacaggaatgagccactgtgcgcagcccaataccccactttcaataaattattaatagaacaactagacagaggatcaataaggaaatacaggacttgaacaacactgtagaccaactggacctaacagacatacacaaacactccacccaacagcagagtacacattcttctcaaatacacatggaacattcattctccagaatagactgtctccagagaggtcataaaacaagtct

SEQ ID NO: 549662 - DNA, 395 bp, Homo sapiens
  misc_feature (167)..(167): n is a, c, g, or t
  misc_feature (175)..(175): n is a, c, g, or t
  misc_feature (186)..(186): n is a, c, g, or t
  misc_feature (192)..(192): n is a, c, g, or t
  misc_feature (219)..(219): n is a, c, g, or t
  misc_feature (222)..(222): n is a, c, g, or t
  misc_feature (257)..(257): n is a, c, g, or t
  misc_feature (261)..(261): n is a, c, g, or t
  misc_feature (288)..(288): n is a, c, g, or t
ggtagtggtgatcttcaggaaatgacacctgtatacattagattataatatgggtaggttaaaaaaaaaaaatcaagactcactccagctcccagtcagagcggtaggggttttaaactggttttcaaaggggaaatcctttcttcaaatgttatcttcctgggaangctaacangtgaaacagtnggacanggagctgcacagccagggggagtaggnggngcgggtacatcctcctctaatagcgcatacggggncggngtacccagctcccacccaccatacacngaagcaacagaggcacctccacaaaaggtaattggaaaaccaacagctgggccgggcacaggggctcacaccggtaatcctagcatggtggaaggccgaggcaggcg

SEQ ID NO: 549663 - DNA, 126 bp, Homo sapiens
  misc_feature (2)..(2): n is a, c, g, or t
cncctctttataaccccacatttttagtcatcaaatctcatttccacggctggggtgcagtggctcatgcttgtaatcccagtactttgggaagccaaagcaggagttattgcttgagcccaggag

SEQ ID NO: 549664 - DNA, 3740 bp, Homo sapiens
  misc_feature (33)..(33): n is a, c, g, or t
  misc_feature (3018)..(3018): n is a, c, g, or t
  misc_feature (3569)..(3569): n is a, c, g, or t
  misc_feature (3585)..(3585): n is a, c, g, or t
  misc_feature (3696)..(3696): n is a, c, g, or t
  misc_feature (3725)..(3725): n is a, c, g, or t
tcgactctgtctccaaaaaaaaaaaaaaaaaanttttttttttagatcatcagctattgttagtgttagtgtatgttatgtgtggctcaagacaactttgtttcttttaatataggcagggaagtcaaaagattggatatccctgctttataccaagaaagacaacaccccacatttgcaatgcctaaaaacactaccagccatctgaaaaacatgagacttctaacttctgttcttttttgtagcagtggaatcccacggtgatatctgagggatgtggttaccttttggaggaggttgacggtttctaaggatgattctttctgagtgaaatattgtcagtgtcattgaccttttcattatttcaactattattattccaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgtgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttgggacaattccaaatgagggccttaaatgatgctcagctaagctggttcttgtgtggcctctgtaccttcaaaagctgccgagtcctatgattacacgcgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacaatgggcttttcatgcctctcttactgtctcttactgtctattgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgacttttctttaccccctagctgtcggcagtactcagtggaagggtgatattatgacactgacactgctattttgaaacctggaggatggaaaggtgcaaaaatctatcaccagcaacagaggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcagctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcggggggccgcttccaccctcagcggatgataatctcaagacaccttccgagtgtgtgctcactccccntccaccctcagcctcccgagtagctgggattacaggtgcctgccaccacgcctggctaattttttgtatttttagtagagaaggggtttcaccatattagccacaatggtctcaatctcctgacctcgtgatccatccgccccgccctcccagagtgctgggattacaggcgtcagccaccgtgaccggctcagactgtactcttctagccatctgaaatacgttttctaggtagagatagattgtgtaagggtacagttgtgaggataacagaaacatggcagattatttaaaatcatcctgaaagtggtgctttatctgatgaaagtgattgtaatccataggaaaatgtttcaacgtgcgcaagagttgcggcggcgagcagaggactaccacaaatgcaaagtaaggagcttcctccctgcagttgcaggatagttcagtgctgatgcagatgatgccacggcccttagactctctcaacattcaatttctcatgtgttggctttttcagatccccccttctgcaagaaaggctctttgcaactggntcagaatggcggcagnggagcatcgtcattcttcaggattgccctactggccctacctcacagctgaaactttaaaaaacaggatgggcctccagccacctcctccaactcaacaacattctataantgataactccctgagcctcaagacacctnccgagtgtgtgctca

SEQ ID NO: 549665 - DNA, 250 bp, Homo sapiens
cagtgattaacctggaacactacacgagagttgatcctaaggcatatactaaacccagtgttggtcagtatacagtgccagccagctgcggtcacacgattaacccaagtcaatagaagccgtcgtaagagtgtaacagatcaccccctccccaataaagctaaaatcacctgagttgtaaaaaactccagtagactcaaaatagactacgaaagtggctttaacaaatctgaacacaacaatagctaaa

SEQ ID NO: 549666 - DNA, 3553 bp, Homo sapiens
  misc_feature (33)..(33): n is a, c, g, or t
  misc_feature (2831)..(2831): n is a, c, g, or t
  misc_feature (3382)..(3382): n is a, c, g, or t
  misc_feature (3398)..(3398): n is a, c, g, or t
  misc_feature (3509)..(3509): n is a, c, g, or t
  misc_feature (3538)..(3538): n is a, c, g, or t
tcgactctgtctccaaaaaaaaaaaaaaaaaanttttttttttagatcatcagctattgttagtgttagtgtatgttatgtgtggctcaagacaactttgtttcttttaatataggcagggaagtcaaaagattggatatccctgctttataccaagaaagacaacaccccacatttgcaatgcctaaaaacactaccagccatctgaaaaacatgagacttctaacttctgttcttttttgtagcagtggaatcccacggtgatatctgagggatgtggttaccttttggaggaggttgacggtttctaaggatgattctttctgagtgaaatattgtcagtgtcattgaccttttcattatttcaactattattattccaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgtgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttgggacaattccaaatgagggccttaaatgatgctcagctaagctggttcttgtgtggcctctgtaccttcaaaagctgccgagtcctatgattacacgcgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacaatgggcttttcatgcctctcttactgtctcttactgtctattgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgacttttctttaccccctagctgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtctgctcactccccttccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcggggggccgcttccaccctcagcggatgataatctcaagacaccttccgagtgtgtgctcactccccntccaccctcagcctcccgagtagctgggattacaggtgcctgccaccacgcctggctaattttttgtatttttagtagagaaggggtttcaccatattagccacaatggtctcaatctcctgacctcgtgatccatccgccccgccctcccagagtgctgggattacaggcgtcagccaccgtgaccggctcagactgtactcttctagccatctgaaatacgttttctaggtagagatagattgtgtaagggtacagttgtgaggataacagaaacatggcagattatttaaaatcatcctgaaagtggtgctttatctgatgaaagtgattgtaatccataggaaaatgtttcaacgtgcgcaagagttgcggcggcgagcagaggactaccacaaatgcaaagtaaggagcttcctccctgcagttgcaggatagttcagtgctgatgcagatgatgccacggcccttagactctctcaacattcaatttctcatgtgttggctttttcagatccccccttctgcaagaaaggctctttgcaactggntcagaatggcggcagnggagcatcgtcattcttcaggattgccctactggccctacctcacagctgaaactttaaaaaacaggatgggcctccagccacctcctccaactcaacaacattctataantgataactccctgagcctcaagacacctnccgagtgtgtgctca

SEQ ID NO: 549667 - DNA, 3475 bp, Homo sapiens
  misc_feature (33)..(33): n is a, c, g, or t
  misc_feature (2753)..(2753): n is a, c, g, or t
  misc_feature (3304)..(3304): n is a, c, g, or t
  misc_feature (3320)..(3320): n is a, c, g, or t
  misc_feature (3431)..(3431): n is a, c, g, or t
  misc_feature (3460)..(3460): n is a, c, g, or t
tcgactctgtctccaaaaaaaaaaaaaaaaaanttttttttttagatcatcagctattgttagtgttagtgtatgttatgtgtggctcaagacaactttgtttcttttaatataggcagggaagtcaaaagattggatatccctgctttataccaagaaagacaacaccccacatttgcaatgcctaaaaacactaccagccatctgaaaaacatgagacttctaacttctgttcttttttgtagcagtggaatcccacggtgatatctgagggatgtggttaccttttggaggaggttgacggtttctaaggatgattctttctgagtgaaatattgtcagtgtcattgaccttttcattatttcaactattattattccaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgtgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttgggacaattccaaatgagggccttaaatgatgctcagctaagctggttcttgtgtggcctctgtaccttcaaaagctgccgagtcctatgattacacgcgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacaatgggcttttcatgcctctcttactgtctcttactgtctattgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgacttttctttaccccctagctgtcggcagtactcagtggaagggtgatattatgacactgacactgctattttgaaacctggaggatggaaaggtgcaaaaatctatcaccagcaacagaggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtctgctcactccccttccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcggggggccgcttccaccctcagcggatgataatctcaagacaccttccgagtgtgtgctcactccccntccaccctcagcctcccgagtagctgggattacaggtgcctgccaccacgcctggctaattttttgtatttttagtagagaaggggtttcaccatattagccacaatggtctcaatctcctgacctcgtgatccatccgccccgccctcccagagtgctgggattacaggcgtcagccaccgtgaccggctcagactgtactcttctagccatctgaaatacgttttctaggtagagatagattgtgtaagggtacagttgtgaggataacagaaacatggcagattatttaaaatcatcctgaaagtggtgctttatctgatgaaagtgattgtaatccataggaaaatgtttcaacgtgcgcaagagttgcggcggcgagcagaggactaccacaaatgcaaagtaaggagcttcctccctgcagttgcaggatagttcagtgctgatgcagatgatgccacggcccttagactctctcaacattcaatttctcatgtgttggctttttcagatccccccttctgcaagaaaggctctttgcaactggntcagaatggcggcagnggagcatcgtcattcttcaggattgccctactggccctacctcacagctgaaactttaaaaaacaggatgggcctccagccacctcctccaactcaacaacattctataantgataactccctgagcctcaagacacctnccgagtgtgtgctca

SEQ ID NO: 549668 - DNA, 4128 bp, Homo sapiens
  misc_feature (33)..(33): n is a, c, g, or t
  misc_feature (3406)..(3406): n is a, c, g, or t
  misc_feature (3957)..(3957): n is a, c, g, or t
  misc_feature (3973)..(3973): n is a, c, g, or t
  misc_feature (4084)..(4084): n is a, c, g, or t
  misc_feature (4113)..(4113): n is a, c, g, or t
tcgactctgtctccaaaaaaaaaaaaaaaaaanttttttttttagatcatcagctattgttagtgttagtgtatgttatgtgtggctcaagacaactttgtttcttttaatataggcagggaagtcaaaagattggatatccctgctttataccaagaaagacaacaccccacatttgcaatgcctaaaaacactaccagccatctgaaaaacatgagacttctaacttctgttcttttttgtagcagtggaatcccacggtgatatctgagggatgtggttaccttttggaggaggttgacggtttctaaggatgattctttctgagtgaaatattgtcagtgtcattgaccttttcattatttcaactattattattccaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgtgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttgggacaattccaaatgagggccttaaatgatgctcagctaagctggttcttgtgtggcctctgtaccttcaaaagctgccgagtcctatgattacacgcgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacaatgggcttttcatgcctctcttactgtctcttactgtctattgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgacttttctttaccccctagctgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcagctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccacccttccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgactccccttccaccctcagcggatgataatctcaagacacctcccgagtgtgtgctcactccccttccaccctcagcggatgataatctcaagacaccttccgagtgtgtgctcactccccntccaccctcagcctcccgagtagctgggattacaggtgcctgccaccacgcctggctaattttttgtatttttagtagagaaggggtttcaccatattagccacaatggtctcaatctcctgacctcgtgatccatccgccccgccctcccagagtgctgggattacaggcgtcagccaccgtgaccggctcagactgtactcttctagccatctgaaatacgttttctaggtagagatagattgtgtaagggtacagttgtgaggataacagaaacatggcagattatttaaaatcatcctgaaagtggtgctttatctgatgaaagtgattgtaatccataggaaaatgtttcaacgtgcgcaagagttgcggcggcgagcagaggactaccacaaatgcaaagtaaggagcttcctccctgcagttgcaggatagttcagtgctgatgcagatgatgccacggcccttagactctctcaacattcaatttctcatgtgttggctttttcagatccccccttctgcaagaaaggctctttgcaactggntcagaatggcggcagnggagcatcgtcattcttcaggattgccctactggccctacctcacagctgaaactttaaaaaacaggatgggcctccagccacctcctccaactcaacaacattctataantgataactccctgagcctcaagacacctnccgagtgtgtgctca

SEQ ID NO: 549669 - DNA, 160 bp, Homo sapiens
caacagggagctgccaccaccgtgtactgtgctgctgtcccaaaactggagggtctgggagggatgtactttaacaactgctgccgctgcatgccctcaccagaagctcatagcgaagagaccgcccggaccctgtgggcgctcagcgagaggctgatcc

SEQ ID NO: 549670 - DNA, 104 bp, Homo sapiens
cacatcttctgctgggaccaggaagaagatgtggaaacggggcagctggatcagggcaaagctaccatggatgatgagcaggacatagagcaggatagagaggt

SEQ ID NO: 549671 - DNA, 276 bp, Homo sapiens
aaaaaaaaaaaaaaaaaaaaaaagagcttggttggtaacaaacaccctcgggggctccagaggtcgggggaaaccacccttaaaatgtgccatgagcgggtagggggtaaattccggggggcacccaaaagcttcggcacccactcacccggggtgctccccctcccacagggggttggagcagggcgggtaagcaagtgagccacccctgtcacaagtcacgtgagggggtcgagggaactcggccgtgtcaataggagctcgaaccctgtggtg

SEQ ID NO: 549672 - DNA, 3433 bp, Homo sapiens
  misc_feature (33)..(33): n is a, c, g, or t
  misc_feature (2711)..(2711): n is a, c, g, or t
  misc_feature (3262)..(3262): n is a, c, g, or t
  misc_feature (3278)..(3278): n is a, c, g, or t
  misc_feature (3389)..(3389): n is a, c, g, or t
  misc_feature (3418)..(3418): n is a, c, g, or t
tcgactctgtctccaaaaaaaaaaaaaaaaaanttttttttttagatcatcagctattgttagtgttagtgtatgttatgtgtggctcaagacaactttgtttcttttaatataggcagggaagtcaaaagattggatatccctgctttataccaagaaagacaacaccccacatttgcaatgcctaaaaacactaccagccatctgaaaaacatgagacttctaacttctgttcttttttgtagcagtggaatcccacggtgatatctgagggatgtggttaccttttggaggaggttgacggtttctaaggatgattctttctgagtgaaatattgtcagtgtcattgaccttttcattatttcaactattattattccaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgtgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttgggacaattccaaatgagggccttaaatgatgctcagctaagctggttcttgtgtggcctctgtaccttcaaaagctgccgagtcctatgattacacgcgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacaatgggcttttcatgcctctcttactgtctcttactgtctattgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgacttttctttaccccctagctgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcggggggccgcttccaccctcagcggatgataatctcaagacaccttccgagtgtgtgctcactccccntccaccctcagcctcccgagtagctgggattacaggtgcctgccaccacgcctggctaattttttgtatttttagtagagaaggggtttcaccatattagccacaatggtctcaatctcctgacctcgtgatccatccgccccgccctcccagagtgctgggattacaggcgtcagccaccgtgaccggctcagactgtactcttctagccatctgaaatacgttttctaggtagagatagattgtgtaagggtacagttgtgaggataacagaaacatggcagattatttaaaatcatcctgaaagtggtgctttatctgatgaaagtgattgtaatccataggaaaatgtttcaacgtgcgcaagagttgcggcggcgagcagaggactaccacaaatgcaaagtaaggagcttcctccctgcagttgcaggatagttcagtgctgatgcagatgatgccacggcccttagactctctcaacattcaatttctcatgtgttggctttttcagatccccccttctgcaagaaaggctctttgcaactggntcagaatggcggcagnggagcatcgtcattcttcaggattgccctactggccctacctcacagctgaaactttaaaaaacaggatgggcctccagccacctcctccaactcaacaacattctataantgataactccctgagcctcaagacacctnccgagtgtgtgctca

SEQ ID NO: 549673 - DNA, 93 bp, Homo sapiens
  misc_feature (59)..(59): n is a, c, g, or t
gaggatccaccaaccatagcccgaaaatgtggtaagggaccctcatctatcacacaacncaggtaagaaggcacccagccccatgggccatac

SEQ ID NO: 549674 - DNA, 3608 bp, Homo sapiens
  misc_feature (33)..(33): n is a, c, g, or t
  misc_feature (2886)..(2886): n is a, c, g, or t
  misc_feature (3437)..(3437): n is a, c, g, or t
  misc_feature (3453)..(3453): n is a, c, g, or t
  misc_feature (3564)..(3564): n is a, c, g, or t
  misc_feature (3593)..(3593): n is a, c, g, or t
tcgactctgtctccaaaaaaaaaaaaaaaaaanttttttttttagatcatcagctattgttagtgttagtgtatgttatgtgtggctcaagacaactttgtttcttttaatataggcagggaagtcaaaagattggatatccctgctttataccaagaaagacaacaccccacatttgcaatgcctaaaaacactaccagccatctgaaaaacatgagacttctaacttctgttcttttttgtagcagtggaatcccacggtgatatctgagggatgtggttaccttttggaggaggttgacggtttctaaggatgattctttctgagtgaaatattgtcagtgtcattgaccttttcattatttcaactattattattccaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgtgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttgggacaattccaaatgagggccttaaatgatgctcagctaagctggttcttgtgtggcctctgtaccttcaaaagctgccgagtcctatgattacacgcgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacaatgggcttttcatgcctctcttactgtctcttactgtctattgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgacttttctttaccccctagctgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcggggggccgcttccaccctcagcggatgataatctcaagacaccttccgagtgtgtgctcactccccntccaccctcagcctcccgagtagctgggattacaggtgcctgccaccacgcctggctaattttttgtatttttagtagagaaggggtttcaccatattagccacaatggtctcaatctcctgacctcgtgatccatccgccccgccctcccagagtgctgggattacaggcgtcagccaccgtgaccggctcagactgtactcttctagccatctgaaatacgttttctaggtagagatagattgtgtaagggtacagttgtgaggataacagaaacatggcagattatttaaaatcatcctgaaagtggtgctttatctgatgaaagtgattgtaatccataggaaaatgtttcaacgtgcgcaagagttgcggcggcgagcagaggactaccacaaatgcaaagtaaggagcttcctccctgcagttgcaggatagttcagtgctgatgcagatgatgccacggcccttagactctctcaacattcaatttctcatgtgttggctttttcagatccccccttctgcaagaaaggctctttgcaactggntcagaatggcggcagnggagcatcgtcattcttcaggattgccctactggccctacctcacagctgaaactttaaaaaacaggatgggcctccagccacctcctccaactcaacaacattctataantgataactccctgagcctcaagacacctnccgagtgtgtgctca

SEQ ID NO: 549675 - DNA, 242 bp, Homo sapiens
taggtcagaaaggattgggattcctatccttaaaactcgatcaccagtcactttcctgtctggtctgcgcaggcccctacgagttatccaagtgaaccgtgggaatcgctacactctcaagctcatcaaggcatgtggtgctctatgtggggactcaggccattgcgcacatccacaccatgggcatgacatcgtatcagtgagcagcatcactacgactcaagcagatatggatatcttcc

SEQ ID NO: 549676 - DNA, 3507 bp, Homo sapiens
  misc_feature (33)..(33): n is a, c, g, or t
  misc_feature (2785)..(2785): n is a, c, g, or t
  misc_feature (3336)..(3336): n is a, c, g, or t
  misc_feature (3352)..(3352): n is a, c, g, or t
  misc_feature (3463)..(3463): n is a, c, g, or t
  misc_feature (3492)..(3492): n is a, c, g, or t
tcgactctgtctccaaaaaaaaaaaaaaaaaanttttttttttagatcatcagctattgttagtgttagtgtatgttatgtgtggctcaagacaactttgtttcttttaatataggcagggaagtcaaaagattggatatccctgctttataccaagaaagacaacaccccacatttgcaatgcctaaaaacactaccagccatctgaaaaacatgagacttctaacttctgttcttttttgtagcagtggaatcccacggtgatatctgagggatgtggttaccttttggaggaggttgacggtttctaaggatgattctttctgagtgaaatattgtcagtgtcattgaccttttcattatttcaactattattattccaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgtgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttgggacaattccaaatgagggccttaaatgatgctcagctaagctggttcttgtgtggcctctgtaccttcaaaagctgccgagtcctatgattacacgcgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacaatgggcttttcatgcctctcttactgtctcttactgtctattgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgacttttctttaccccctagctgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagctccaccctcagcagatgataatatcaagacacctgccgagcgtctgcgggggcccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcggggggccgcttccaccctcagcggatgataatctcaagacaccttccgagtgtgtgctcactccccntccaccctcagcctcccgagtagctgggattacaggtgcctgccaccacgcctggctaattttttgtatttttagtagagaaggggtttcaccatattagccacaatggtctcaatctcctgacctcgtgatccatccgccccgccctcccagagtgctgggattacaggcgtcagccaccgtgaccggctcagactgtactcttctagccatctgaaatacgttttctaggtagagatagattgtgtaagggtacagttgtgaggataacagaaacatggcagattatttaaaatcatcctgaaagtggtgctttatctgatgaaagtgattgtaatccataggaaaatgtttcaacgtgcgcaagagttgcggcggcgagcagaggactaccacaaatgcaaagtaaggagcttcctccctgcagttgcaggatagttcagtgctgatgcagatgatgccacggcccttagactctctcaacattcaatttctcatgtgttggctttttcagatccccccttctgcaagaaaggctctttgcaactggntcagaatggcggcagnggagcatcgtcattcttcaggattgccctactggccctacctcacagctgaaactttaaaaaacaggatgggcctccagccacctcctccaactcaacaacattctataantgataactccctgagcctcaagacacctnccgagtgtgtgctca

SEQ ID NO: 549677 - DNA, 163 bp, Homo sapiens
atactgagttccccatcataggagagaaaacaagcaagtggcagctgagatgaggggaatcatcccaggccctttggctctgagtaccccatcccaaaccaacattgtacccagctttttgcagcgggggctgaggttaacaggttgcagcgatgagccaacg

SEQ ID NO: 549678 - DNA, 148 bp, Homo sapiens
taagggaaatgggtatctccttatgttgcccgggctggccttgaactcctaggctcaagcagtcctccagtctcagcctcctgagtaactgggactgcgttttttttgttttattttgtttttaatttggtcttgaagtggagttata

SEQ ID NO: 549679 - DNA, 2668 bp, Homo sapiens
  misc_feature (33)..(33): n is a, c, g, or t
  misc_feature (2624)..(2624): n is a, c, g, or t
  misc_feature (2653)..(2653): n is a, c, g, or t
tcgactctgtctccaaaaaaaaaaaaaaaaaanttttttttttagatcatcagctattgttagtgttagtgtatgttatgtgtggctcaagacaactttgtttcttttaatataggcagggaagtcaaaagattggatatccctgctttataccaagaaagacaacaccccacatttgcaatgcctaaaaacactaccagccatctgaaaaacatgagacttctaacttctgttcttttttgtagcagtggaatcccacggtgatatctgagggatgtggttaccttttggaggaggttgacggtttctaaggatgattctttctgagtgaaatattgtcagtgtcattgaccttttcattatttcaactattattattccaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgtgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttgggacaattccaaatgagggccttaaatgatgctcagctaagctggttcttgtgtggcctctgtaccttcaaaagctgccgagtcctatgattacacgcgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacaatgggcttttcatgcctctcttactgtctcttactgtctattgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgacttttctttaccccctagctgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccagccacctcctccaactcaacaacattctataantgataactccctgagcctcaagacacctnccgagtgtgtgctca

SEQ ID NO: 549680 - DNA, 199 bp, Homo sapiens
ctctgacccccaacaggatacctgttcacatccagaatcacgtatcccacttgcagcccatgcccctgggcagctgaacctcctggagtcacctaggtgtaagtagggggcatagcagcaacaggggacacctgggggacaaagtattgcttggcttatagcgctctaggcgcagtggcaagccacgcaggcaaagacc

SEQ ID NO: 549681 - DNA, 3626 bp, Homo sapiens
  misc_feature (33)..(33): n is a, c, g, or t
  misc_feature (2904)..(2904): n is a, c, g, or t
  misc_feature (3455)..(3455): n is a, c, g, or t
  misc_feature (3471)..(3471): n is a, c, g, or t
  misc_feature (3582)..(3582): n is a, c, g, or t
  misc_feature (3611)..(3611): n is a, c, g, or t
tcgactctgtctccaaaaaaaaaaaaaaaaaanttttttttttagatcatcagctattgttagtgttagtgtatgttatgtgtggctcaagacaactttgtttcttttaatataggcagggaagtcaaaagattggatatccctgctttataccaagaaagacaacaccccacatttgcaatgcctaaaaacactaccagccatctgaaaaacatgagacttctaacttctgttcttttttgtagcagtggaatcccacggtgatatctgagggatgtggttaccttttggaggaggttgacggtttctaaggatgattctttctgagtgaaatattgtcagtgtcattgaccttttcattatttcaactattattattccaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgtgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttgggacaattccaaatgagggccttaaatgatgctcagctaagctggttcttgtgtggcctctgtaccttcaaaagctgccgagtcctatgattacacgcgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacaatgggcttttcatgcctctcttactgtctcttactgtctattgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgacttttctttaccccctagctgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcgcttccaccctcagcggatgataatctcaagacaccttccgagcgtcagctcactccccttccaccctcagctccttccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgactccccttccaccctcagcggatgataatctcaagacacctcccgagtgtgtgctcactccccttccaccctcagcggatgataatctcaagacaccttccgagtgtgtgctcactccccntccaccctcagcctcccgagtagctgggattacaggtgcctgccaccacgcctggctaattttttgtatttttagtagagaaggggtttcaccatattagccacaatggtctcaatctcctgacctcgtgatccatccgccccgccctcccagagtgctgggattacaggcgtcagccaccgtgaccggctcagactgtactcttctagccatctgaaatacgttttctaggtagagatagattgtgtaagggtacagttgtgaggataacagaaacatggcagattatttaaaatcatcctgaaagtggtgctttatctgatgaaagtgattgtaatccataggaaaatgtttcaacgtgcgcaagagttgcggcggcgagcagaggactaccacaaatgcaaagtaaggagcttcctccctgcagttgcaggatagttcagtgctgatgcagatgatgccacggcccttagactctctcaacattcaatttctcatgtgttggctttttcagatccccccttctgcaagaaaggctctttgcaactggntcagaatggcggcagnggagcatcgtcattcttcaggattgccctactggccctacctcacagctgaaactttaaaaaacaggatgggcctccagccacctcctccaactcaacaacattctataantgataactccctgagcctcaagacacctnccgagtgtgtgctca

SEQ ID NO: 549682 - DNA, 1254 bp, Homo sapiens
  misc_feature (487)..(487): n is a, c, g, or t
agcgtagtccgctggtccctaccttgcgagctgtgaggggattcatcttcgttgtgcggaacatcactcgcgataccatgggcggtcccttgttcccgtgtgccaccgtagtttcaacatcattttagggcgcatggcaatgcgttgtatccaatagcagtagcatgccatgagacaagcctcggttggctgcacgtttactgtcttgttagggtggccgatcggaccttcattttggagaactctggtacatgcagctacacgcgttgggaggacgccatccaggacgaatggtgctaaaagaacttcatgcttaagcgagtagtgacggagaatgcgcgttctcttctattgcgtaacgcgaaatgaatgaggtgccaacgtatctcatacacagaacactgatttgggtgttctggaccaagtccggagcagcctagagagcttctctaggtctggactactcggttcgaattggggcttcgangagtaattgcacttgcatagctcggggtggattgggccagcgttaccccgtcgttgctttaaaccctgctgtattgacggctatgctatgcagactctcaatgtggcagggggggcataatgcgccggaaaattcgtatgtccacagtatagccaagacattacccaaggattctgccattccccaatccacggaacgcctagtccaactcaaggctgtgccggtgttgggaacgcattggaaaaggccccaggcggacctggggctaggcttaccggaacggcagggggccgccctccgatctttgaacgatttatcttcgggccatggttgttcgcaagttcgacctcgggtattcccccgaactatggacaaaggtctcagagaattctgcacccgttttcagaaggcgaaatatcttaaacttggaagggttacctctgggcgagagggcgaaccaagacccagttctaggtccccggttccgtaacacaggttttccttgttggcccttctgagtcccaggcacaaatcggaacgccaaggttgtgtaagccaccaagcgattatatcggcatttgctagatgagcgaggccaggggttgtctcttcgcaatgggagcctcttggatcacccagcggctctctcgttggggcgaagacggcacctgggaggaacgcggggagaaggttcttcgcgaatagggttttgaggttccacaaccgaaaaaggccttaagccgaaggtggagaaaaggataccgggg

SEQ ID NO: 549683 - DNA, 339 bp, Homo sapiens
gtcatttctacacttaaatacgtgctggactctacagcataagatggcattatctattattagtacagctggcacatctgtgtgacgctctttattaagtggggatataaccatatccattctcactcatattttaagaaacatcattcttgagtttattttttttttctttaaaagacaggatctcatgctgtcgcccagagtggagtgcggtggcatgatcgtagctcactacaacctcaaattccgtgggctcaagcgatccttctgcctcatccttccaaagtgctgggattataggcatgaggccaccgcgcccagcctcgtgtagaagttgaa

SEQ ID NO: 549684 - DNA, 3762 bp, Homo sapiens
  misc_feature (33)..(33): n is a, c, g, or t
  misc_feature (3040)..(3040): n is a, c, g, or t
  misc_feature (3591)..(3591): n is a, c, g, or t
  misc_feature (3607)..(3607): n is a, c, g, or t
  misc_feature (3718)..(3718): n is a, c, g, or t
  misc_feature (3747)..(3747): n is a, c, g, or t
tcgactctgtctccaaaaaaaaaaaaaaaaaanttttttttttagatcatcagctattgttagtgttagtgtatgttatgtgtggctcaagacaactttgtttcttttaatataggcagggaagtcaaaagattggatatccctgctttataccaagaaagacaacaccccacatttgcaatgcctaaaaacactaccagccatctgaaaaacatgagacttctaacttctgttcttttttgtagcagtggaatcccacggtgatatctgagggatgtggttaccttttggaggaggttgacggtttctaaggatgattctttctgagtgaaatattgtcagtgtcattgaccttttcattatttcaactattattattccaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgtgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttgggacaattccaaatgagggccttaaatgatgctcagctaagctggttcttgtgtggcctctgtaccttcaaaagctgccgagtcctatgattacacgcgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacaatgggcttttcatgcctctcttactgtctcttactgtctattgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgacttttctttaccccctagctgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcgcttccaccctcagcggatgataatctcaagacaccttccgagcgtcagctcactccccttccaccctcagctccaccctcagcagatgataatatcaagatacctgctgagcgtctgcggattccgcttccaccatcagccgatgataatctcaagacaccttccgagcgtcagctcactccccttccaccctcagctccaccctcagccttccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgactccccttccaccctcagcggatgataatctcaagacacctcccgagtgtgtgctcactccccttccaccctcagcggatgataatctcaagacaccttccgagtgtgtgctcactccccntccaccctcagcctcccgagtagctgggattacaggtgcctgccaccacgcctggctaattttttgtatttttagtagagaaggggtttcaccatattagccacaatggtctcaatctcctgacctcgtgatccatccgccccgccctcccagagtgctgggattacaggcgtcagccaccgtgaccggctcagactgtactcttctagccatctgaaatacgttttctaggtagagatagattgtgtaagggtacagttgtgaggataacagaaacatggcagattatttaaaatcatcctgaaagtggtgctttatctgatgaaagtgattgtaatccataggaaaatgtttcaacgtgcgcaagagttgcggcggcgagcagaggactaccacaaatgcaaagtaaggagcttcctccctgcagttgcaggatagttcagtgctgatgcagatgatgccacggcccttagactctctcaacattcaatttctcatgtgttggctttttcagatccccccttctgcaagaaaggctctttgcaactggntcagaatggcggcagnggagcatcgtcattcttcaggattgccctactggccctacctcacagctgaaactttaaaaaacaggatgggcctccagccacctcctccaactcaacaacattctataantgataactccctgagcctcaagacacctnccgagtgtgtgctca

SEQ ID NO: 549685 - DNA, 128 bp, Homo sapiens
aacattcgtgtcagaggctgaatgggggataggtgtatgaacatgaggtgttttctcgtgtgaaagagggttttatgttgttaatgtggtgggtgagtgagcctcattgtgttgtcggtaaatatgta

SEQ ID NO: 549686 - DNA, 649 bp, Homo sapiens
tgggctctaaagggggtagagggggtgctatagggtaaatacgggccctatttcaaagatttttaggggaattaattctaggacgatgggcatgaaactgtggttggctccacagatttcagaagcattgcaccgtagtatacccccggtcgtgtagcggtgaaagtggttgggtttagacgtccgggaatgtgcatctgtttttaagcctaagtggtggggcacagctcatgagtgcaagacgtctgtgatgtaattattatacgaagtgggggctctcaatcgggagttactactcgatgtgtcaacgttcaaggagttcgcaggtctcgccgtgggtctctaggaataagtgggggaagtattgtaggagtttgaagattagctccgccgaaagctcgggtgatacctcgtaggtctcagtaccatggggggccaccatgtgattggagtggtaagggagggactcgtgtgaccctcgtcgtgttatgtaaaggatgcgtagggatgggagggcagatgaggactaggatgatggcgggcaggatagtctcagacggtttctattacctgagcgtctgagatgtgacgaataagtaaagagaggggagtgttaggacagggcatacaggactaggaagcagatagg

SEQ ID NO: 549687 - DNA, 1468 bp, Homo sapiens
gcaaaacaccaaatggcggatgactgccggtgcagcttggtgtgtgggccctggggtgccctggtggccctgggatggggaaccgcgtgtggcttccgcggagtgtttctggcagtggcatcgtgggccggggtcgcggccgtggacggggccggggccgaggccgcggagctcgcggagtgcaaggccgaggataaggagtggatgcccgtcaccaagtttgggcctgttggtcaacggaacataaagcatcaagtcccgtggaggagatctatctattctccctgcactattaaggaatcagagatcattgatatcttccttgggggcctctctcacaggacttgacggtttagaagcattattgccagtgacagaagcagacccgtgacggccagcgacaaccaggttcaaggcattaagtatgcatatcggggcactacaattggacacgttcgagaactggggttgtaaaagtgctcccaagagaggtgggcaacccggccaatccgttggggaacatcatacttggcaccaagctcttacaatacgtccccggatgcagacagaggctactgtggggaacaaagatcgggaaaaggcacacagcaagttgagcactatgcacagggtggaccaggaccgaatgagagattcatgagaatggcagtaacgacacatccaataaccatagcaacacagaaggaggcaacattggcaaatcaagtacttccacgaaaaccagatgtgagcgataaggaaaagcagtgagtccaattgaatgcggaatggcaatatacgaatagaccataggtaacaaacattacaagacaccaggatgagctaagacatatgcaaagccacataagagaaaaactatacgacacacacgggcgaacctatttggaaaagccaacaagtgctaaagaacgccgttaacgaggcaaacagttagaaccccaagcgagaaagcattctgagcaacgggagacaaatgggtatttcacacgccaaggatataaccaccatataatacaaggaggaatctgacgtgacacacaaaccaattcgaatcaagcagacaccaaagcgaaaaacagaacttaacggtggccaagcgggaaatccaagagactcacagaaattgagtggacttacaaacacaaaggggagtaataaatacacgagacaccaagcttacacgatggaactaagcggtgtaaaaagaaaaagccacacaaggcaagagaagcaggacgacaaagagaagacgaagaaagacatgagtgaagcatagaagaatcgctggacgaagcacaaaagaactgaagctaacgatgcagaggagacagacacagagatgctgcgagcaggacaatatattcgaacgagagagaaaaaaacgaggggaggcacaaacgaacgcaaccaaacgcagcaaagagagagcacaagataagaaatacaa

SEQ ID NO: 549688 - DNA, 439 bp, Homo sapiens
atatcattaaacaaataaaatactttttatcacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaagaaaaaaaaaaaaaaaaaaaaaaaaaaaagtggccgccctttgcccccgggacgtttaaaccttcacatgtatagacctggctatccaatgaggctaaaattgccaatgtcccctgaaggggggccttttaaaaagaccggggccgtttttaataaccttgagctggggaaaaccctgggggaccccaaatttaacgcgtttgaataaagaccccttttgccccagggggaaaaaaacaaaaggccctttcaaggagggctttcaaaaaaggggccaaccttaaagggcaaagg

SEQ ID NO: 549689 - DNA, 391 bp, Homo sapiens
  misc_feature (371)..(371): n is a, c, g, or t
  misc_feature (386)..(386): n is a, c, g, or t
agagctacaccatgagcttcaataccctgtctctagagtcaaaaataaattggccaggcacagtggctcacacctgtaatctcagcacgttgggaggccaaggcgggaggatcacttaaggccaggagttcaagaccagttcatgcaacatagggagatcttgtctctacaaaaaatataaaaattagccaagtgttgtggtgcacacctgtagtcccagctactgaggaggctgaggtggaaggagtgctggagccctgggagcactgggagcctggggagatgggaagttgacagttgagctgtaattgttgccactgcattccagccttgagttgacagagccaagattttttcttcaaaattaagantaatatttaaattanaaatt

SEQ ID NO: 549690 - DNA, 188 bp, Homo sapiens
ctcatccgtggtgtatcaaattgagctccgaatctattattggtactgtaatctggaaagactcaaatgcaggattccctacatgttacaaagtggatgagagcgcccttttgattattctgcacttattaaatgcttactgactccatcagtgatctgatgctgtttgtcagagggtcccaagcgct

SEQ ID NO: 549691 - DNA, 160 bp, Homo sapiens
ttagattaacgtagattattttagaaaggacagtaggtatgctcaataaacattcagttattattactgcaaactttacagaatatatcagttctatttatctaagtcccacatctcaacagcattcatcactacctgctgcattctttttatttattat

SEQ ID NO: 549692 - DNA, 543 bp, Homo sapiens
gagacagggtgtcactctgtcacccgggctggagtgcagtgacacgatctttgcgacctccgcctttcaggttcaagtgcatctcctgcctcagcctcctgagtagctgggattacagtcgtgtatcaccacccttggctaatttttgtatttttagtagagatgggatttcgccatattggttaggctggtctcaaacttctgacctcaagtgatctgcctgcctcggccttccaaagacctgggattataggtgtgagcacactccgggcccaatatggcattttgattgggatgaagggtggaggaaaatcagtgtgatttttgtatctatctctctagctatctattattttttgagatgaggtcttgctctgttgcttaggctggagtgcagttgggcaatgatggctcactgcagcctcgacctcctggacgcaagccatcctcctattttagcctccgtagtagctgggaccacaggcacacgccaccctgcctggctaatttttactttaagtgtagagctgaggaccatcgttg

SEQ ID NO: 549693 - DNA, 393 bp, Homo sapiens
ttcttctatcctgaaagctgtcctctccccactcccgacacactgggagcccccccatccccgcccctctcccgcccctcccttgtccccgccccttcccgccccaactcaggttctgccccaccccgccccaattcacgtcctgctccgccccgacgtaggccccgccctggcccccgggccccgcccccgtctgacgcaggccccgccccctctccgccccgccccggctcgggcggccggaggacccggagctaaggcgcccgaacccgcggcggcggtggggacgatgtggttctttgcccgggacccggtccgggactttccgttcgagctcatcccggagcccccagagggcggcctgcccgggccctgggccctgcaccgcggccg

SEQ ID NO: 549694 - DNA, 156 bp, Homo sapiens
tcgctattcatcggcacccccaggacacagagactttatcaaaaacatgattacagggacatctcaggctgactgtgctgtcctgattgttgctgctggtgccgaataatagcgagctattcatcggcacccatatcagtgatcgtggggttgtaa

SEQ ID NO: 549695 - DNA, 117 bp, Homo sapiens
tagagaaatagctgcagcagaaggctgcttggagaacagtgtcggatctgctggttcacttggggacacagtgaccacttcataaccctcaggtggtgtgactcgctccccgccctc

SEQ ID NO: 549696 - DNA, 309 bp, Homo sapiens
gtatttttgtttttcccaaaggtttttcctctcaaaatttgttttttgttcaggcattggatggggtagaaataaaggcaggaaaggaaggaaaaaaaaaggcaggtgtgggcccctgggggggccaattcccatgcaaagggatgtcaaaggggtgttgccagcgacccccgggggttttccctcactccagttccttaagagccccttgcatttatttatccatgggggcagatcccccctttaggagttgagagttttagggtgcagttccagacccctcccccaataaagagttcctcctttgta

SEQ ID NO: 549697 - DNA, 422 bp, Homo sapiens
tcacttagaaaaatagcttttgcatttcatacagcttctaattccaaaattagttcaacatctagcagtgaatgtagaaatatataccccttttggagacatacttagggctggtattgatttatgctgtaccatgattttagtcttatgggataatcaccttgtcaaggctatatttattgttgtggctattaaatcacattaattccttggcgattacatgagataaagcatccacaaactgcagcagtgacagaattcagtttttctccctaaataaactcaatacaaagatagccatgtcctagtttttcaatggcattccaactttttttttttttgcatatcttactgagcattagagttgcagcttgtgctttgccacagatttgaactctggtgtaaaagcaccttgagggaga

SEQ ID NO: 549698 - DNA, 920 bp, Homo sapiens
ggagcttcccggtgcctccgcgggcgcccaggtgtagcggaggctgctggagatgcgaccggggggaggaggaggcgccctgggggggagggacgggaatgccggccagtgttctgtgctgtcttcccgggccaagggagccaggtgttggggcattgggccggggtatagtcaaaatacctgagagcgtccgggaaaactctacggcggacgcccgcggggtgcgtgggatacagaacctgttggaaattggaagcctttggaagggggccggaagaaagacctcttgaagcgggaagctgttgatttggtaaggcggcggaattttgcagttgggcaatcggagtggccctgatgttaggaaaaaattaattttaatttgggaggcctcgggtggattgagaaaaagtgtgttggtggtggaggattcacaggggtggggaggagttgtggcagcccttagttggttggcgggacagccattggaaatttggctgggagggtttggtatcggagggggaaaactccagagttggaggcatggcagggaaggttaaggaaggttgccagaggtgagattggtgttggctcgggcaagctatagtccatgtcattcgctgttgtgaaagccggggaacactggaggtttaggcatagagacccccgtttgtgcagtgtcaactaccttacagatgccgggtggtcggcacccagaggtcagggtctcagagatccctagttcattagagccacggagtgccgtagtgcgatccaaccggtatgggcaggtgaccataagagttaaggggcgaataagacctgttggaaccacgcacgaaaaggtcgggccaggtggcaggggccgggtgcagtcggctaagaaggggcccatgagcggacgcagaagacgtgcacgccag

SEQ ID NO: 549699 - DNA, 139 bp, Homo sapiens
cttcctacatctcccagtagcctttatgctaaggatttctcaagaccgctcttcgttcaagtgagttgactcttcctttttcctccccatggaggctggctggacaattcttacattcatgttcttgacttaggatcac

SEQ ID NO: 549700 - DNA, 306 bp, Homo sapiens
  misc_feature (46)..(46): n is a, c, g, or t
  misc_feature (158)..(158): n is a, c, g, or t
aggtctccacatatctataatgacacgatggtagtgagcatggttngctgtcaacttcagaggctgctgtggcggggtctagtactgcatctgctcaagaactgtaggttggatttcgtagccgtctgctgcatcttggacaggtggcgctcctctgnggtgacagcggcgtcaaccgtccaccacacatgatgaatggatgtgtactgtttcttcttcagcatcaccaaggtgatgacgatcactgtcgctatgacaacaccggccaccatgagtccaatgattgcacctttgtttgaacccact

SEQ ID NO: 549701 - DNA, 101 bp, Homo sapiens
gagatatccccgagtccttcaatgctatccttctctttgactacttggacccatactgcatagtacccgagaaccctacgtgcgaagcacgtgactcacgg

SEQ ID NO: 549702 - DNA, 290 bp, Homo sapiens
actagagggaacccccgccacagcccccaaaggtacgagcccagcttacttgtcagtaaaaagcatgcatcattcacaatttatatcttttttggtggtacaaaaatgaacacaagatattctcttttatctgcaaagcgaaaggtttggcgagagggaattaggccacttgagagttagtgtgtgttcacaattttctggccaggcacggtggatcatgcctgcaatcccagcaccttgcgaggccaaggcgctcggatcacttgagctcatgagagcgagaccaaatt

SEQ ID NO: 549703 - DNA, 518 bp, Homo sapiens
tataaagaggacccccttttatgggggtaaaaaaggggggttaaatttcccgggacatggaaagggaccttatccctaatcccaggggaaccaaaaatatttttttttcaaaggaaagaaaagggggggcaaaaaagagaggcggggctaaacaaccaaaaaaatttcttgccgctggctactttaccgcaacgcccagtgagtttctggcccccagttcatacagcgtacccaggaaaaccacccttaacccggaagatcctcataagcatacaatgcaacaaggggggcgggggccaacaaactctccggggtggggaaaggggggtgcaggcaatactggggtggggcccccagccacaagtgccctgcgtggctacccgctgtggggtatcaccccagtggtgtttgtccccttgtgcgcaggttgtgtaccctccgggggagaggggccgtgaccaaagtgatcaggggtggggaaacacgcactcgtgattcagcacagggttccacgagtg

SEQ ID NO: 549704 - DNA, 149 bp, Homo sapiens
atggcagaagcaggaagcataagagatactgccctggcacccagcacaatgaagatcaagatcattgctcctcctgagcgcgagtactccgtgtggatcggcggctccatctctggcctcgctgtccaccttccggcagaagcaggaag

SEQ ID NO: 549705 - DNA, 163 bp, Homo sapiens
tccagtctcttccatcacacctaccttgaataggcatctctcctagcaactctgaccccaactctcatctgttaatagatcagacacaagtatgaccaatgcatctgacatgagcaagaaaggaggagtacaagagtgttttgttgctgtataatgtcgacgc

SEQ ID NO: 549706 - DNA, 156 bp, Homo sapiens
  misc_feature (89)..(89): n is a, c, g, or t
gtgatgctgaggtcgctctagagatcccccaaccctttgttcacctgacgacagcgggcctgtggtgggacggggtgacgcacctcctngcctccacttgcatctccttcccagcaggcccgggctctcctgcctctgacttcaagtccttggtac

SEQ ID NO: 549707 - DNA, 204 bp, Homo sapiens
cctgtggtgtactgtcagttgtacctctacggcatgcaatgctagatcctaggacatgcctctgttcagttttcctcaaaacaatcaatggacttcttcaagtacacagtagagtacgttaggaaagggatcttactccagaggccactgtagtggcgatgtcctcccctagacgttatccgacgacattgcttttacatctgt

SEQ ID NO: 549708 - DNA, 148 bp, Homo sapiens
gaattcaagtttgaccctcatgaggcaacgtgttacgatgatgggaagacataaccacgtaaggagaacagtggcagaaggaatatctacggtgccatattgctcctgcacatagctaaggaggccaacgggactaggcgcttgtgac

SEQ ID NO: 549709 - DNA, 3222 bp, Homo sapiens
  misc_feature (33)..(33): n is a, c, g, or t
tcgactctgtctccaaaaaaaaaaaaaaaaaanttttttttttagatcatcagctattgttagtgttagtgtatgttatgtgtggctcaagacaactttgtttcttttaatataggcagggaagtcaaaagattggatatccctgctttataccaagaaagacaacaccccacatttgcaatgcctaaaaacactaccagccatctgaaaaacatgagacttctaacttctgttcttttttgtagcagtggaatcccacggtgatatctgagggatgtggttaccttttggaggaggttgacggtttctaaggatgattctttctgagtgaaatattgtcagtgtcattgaccttttcattatttcaactattattattccaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgtgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttgggacaattccaaatgagggccttaaatgatgctcagctaagctggttcttgtgtggcctctgtaccttcaaaagctgccgagtcctatgattacacgcgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacaatgggcttttcatgcctctcttactgtctcttactgtctattgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgacttttctttaccccctagctgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcgcttccaccctcagcggatgataatctcaagacaccttccgagcgtcagctcactccccttccaccctcagctccaccctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgccgagcgtctgcagctgcgggggccgcttccaccctcagcggatgataatctcaagacaccttccgagcgtcagctcactccccttccaccctcagcatccaacccgtcagcagaatagataagtatcaagacaactggccgagcgtctgggggggccgagttccacccgtcagcggagtgagtagatctcaagagaccttcggagacgtacggaggtgcgagtgccgcatgggcgaccgctgcgagctcgacccgtcagacagatagatagtggtcgaggagaccgtgcgcgagcgtcatgcgggggccgattccagcactcagcggatgagcggctgcaagaggacattcgcgagcgagtagcggtgtcacgctgccacaataagacgaaaccatcggactccaacccttcaagcgagaaagaatagaacactccagagaggacccgggaccggaggcggtctgcggggaagcccggaatgtacgcaagcaggcaggcgggagtaaggcagtgactcaggggaatacccagtcccgaagcggaggcgtgcaccacccggtgggagaaaccgcaggtttccaaccctac

SEQ ID NO: 549710 - DNA, 3135 bp, Homo sapiens
  misc_feature (33)..(33): n is a, c, g, or t
tcgactctgtctccaaaaaaaaaaaaaaaaaanttttttttttagatcatcagctattgttagtgttagtgtatgttatgtgtggctcaagacaactttgtttcttttaatataggcagggaagtcaaaagattggatatccctgctttataccaagaaagacaacaccccacatttgcaatgcctaaaaacactaccagccatctgaaaaacatgagacttctaacttctgttcttttttgtagcagtggaatcccacggtgatatctgagggatgtggttaccttttggaggaggttgacggtttctaaggatgattctttctgagtgaaatattgtcagtgtcattgaccttttcattatttcaactattattattccaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgtgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttgggacaattccaaatgagggccttaaatgatgctcagctaagctggttcttgtgtggcctctgtaccttcaaaagctgccgagtcctatgattacacgcgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacaatgggcttttcatgcctctcttactgtctcttactgtctattgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgacttttctttaccccctagctgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcgcttccaccctcagcggatgataatctcaagacaccttccgagcgtcagctcactccccttccaccctcagctccaccctcagcagatgataatatcaagacacctgccgagcgtctgcgggggccgcttccaccctgagcggatgataatctcaagacaccttccgagcgtcagctcactccccttccaccctcagctccaccctcagcagatgataatatcaagatacctgctgagcgtctgcggattccgcttccaccatcagccgatgataatctcaagacaccttccgagcgtcagctcactccccttccaccctcagctccaccctcagccttccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccatccgaagcagttgccg

SEQ ID NO: 549711 - DNA, 2697 bp, Homo sapiens
  misc_feature (33)..(33): n is a, c, g, or t
  misc_feature (2677)..(2677): n is a, c, g, or t
tcgactctgtctccaaaaaaaaaaaaaaaaaanttttttttttagatcatcagctattgttagtgttagtgtatgttatgtgtggctcaagacaactttgtttcttttaatataggcagggaagtcaaaagattggatatccctgctttataccaagaaagacaacaccccacatttgcaatgcctaaaaacactaccagccatctgaaaaacatgagacttctaacttctgttcttttttgtagcagtggaatcccacggtgatatctgagggatgtggttaccttttggaggaggttgacggtttctaaggatgattctttctgagtgaaatattgtcagtgtcattgaccttttcattatttcaactattattattccaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgtgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttgggacaattccaaatgagggccttaaatgatgctcagctaagctggttcttgtgtggcctctgtaccttcaaaagctgccgagtcctatgattacacgcgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacaatgggcttttcatgcctctcttactgtctcttactgtctattgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgacttttctttaccccctagctgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcgcttccaccctcagcggatgataatctcaagacaccttccgagcgtcagctcactccccttccaccctcagctccaccctcagcagatgataatatcaagacacctgccgagcgtctgcgggggccgcttccaccctgagcggatgataatctcaagacaccttccgagcgtcagctcactccccttccaccctcagctccaccctcagcagatgataatatcaagacacctgccgagcgtctgcgggggccgcttccaccctcagcgatgaaaatcntcgcagagcgaaaccctata

SEQ ID NO: 549712 - DNA, 184 bp, Homo sapiens
gtgctcggtccgccacgccgatcagtatttgctgaatcgcagccacaggcggcggcggagaagatcgggatattgctggcgggcagcgtcggcgcgatcaggatgacgatcagcccgccaagacctattttgacctttttgctgatttgcttttcgctgaatatcggcgcggtgctgatcagcg

SEQ ID NO: 549713 - DNA, 385 bp, Homo sapiens
ggggacagcacgggggctaagtgatcaagcgcgtaactaggatcctacactaaatagtgagtcataaatacttaaaatacaaagccaacaacattagctagcaaataaacgtaaaaaatactagtaaaagtgtaaagtagtaatacctaccgataccatactagacgttatactaggacggttacgtaagaacagcagagaaaacgctagacaccgtctagcactagatgcatagggagacactaaaagcaaaggtagaggagatcctactaaatattgtcgacctagcaaggacatagcaaagctataggcacctaggaccagtacgtaatcaaccaaaaatacgttagacttgaggaaaaacccattggacggacaaaggagc

SEQ ID NO: 549714 - DNA, 2849 bp, Homo sapiens
  misc_feature (33)..(33): n is a, c, g, or t
  misc_feature (2804)..(2804): n is a, c, g, or t
tcgactctgtctccaaaaaaaaaaaaaaaaaanttttttttttagatcatcagctattgttagtgttagtgtatgttatgtgtggctcaagacaactttgtttcttttaatataggcagggaagtcaaaagattggatatccctgctttataccaagaaagacaacaccccacatttgcaatgcctaaaaacactaccagccatctgaaaaacatgagacttctaacttctgttcttttttgtagcagtggaatcccacggtgatatctgagggatgtggttaccttttggaggaggttgacggtttctaaggatgattctttctgagtgaaatattgtcagtgtcattgaccttttcattatttcaactattattattccaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgtgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttgggacaattccaaatgagggccttaaatgatgctcagctaagctggttcttgtgtggcctctgtaccttcaaaagctgccgagtcctatgattacacgcgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacaatgggcttttcatgcctctcttactgtctcttactgtctattgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgacttttctttaccccctagctgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcgcttccaccctcagcggatgataatctcaagacaccttccgagcgtcagctcactccccttccaccctcagctccttccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcgatgatantctcaaacacacggggggatgagcacacagtaccgagctcgatga

SEQ ID NO: 549715 - DNA, 3243 bp, Homo sapiens
  misc_feature (33)..(33): n is a, c, g, or t
  misc_feature (2521)..(2521): n is a, c, g, or t
  misc_feature (3072)..(3072): n is a, c, g, or t
  misc_feature (3088)..(3088): n is a, c, g, or t
  misc_feature (3199)..(3199): n is a, c, g, or t
  misc_feature (3228)..(3228): n is a, c, g, or t
tcgactctgtctccaaaaaaaaaaaaaaaaaanttttttttttagatcatcagctattgttagtgttagtgtatgttatgtgtggctcaagacaactttgtttcttttaatataggcagggaagtcaaaagattggatatccctgctttataccaagaaagacaacaccccacatttgcaatgcctaaaaacactaccagccatctgaaaaacatgagacttctaacttctgttcttttttgtagcagtggaatcccacggtgatatctgagggatgtggttaccttttggaggaggttgacggtttctaaggatgattctttctgagtgaaatattgtcagtgtcattgaccttttcattatttcaactattattattccaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgtgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttgggacaattccaaatgagggccttaaatgatgctcagctaagctggttcttgtgtggcctctgtaccttcaaaagctgccgagtcctatgattacacgcgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacaatgggcttttcatgcctctcttactgtctcttactgtctattgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgacttttctttaccccctagctgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacaccttccgagtgtgtgctcactccccntccaccctcagcctcccgagtagctgggattacaggtgcctgccaccacgcctggctaattttttgtatttttagtagagaaggggtttcaccatattagccacaatggtctcaatctcctgacctcgtgatccatccgccccgccctcccagagtgctgggattacaggcgtcagccaccgtgaccggctcagactgtactcttctagccatctgaaatacgttttctaggtagagatagattgtgtaagggtacagttgtgaggataacagaaacatggcagattatttaaaatcatcctgaaagtggtgctttatctgatgaaagtgattgtaatccataggaaaatgtttcaacgtgcgcaagagttgcggcggcgagcagaggactaccacaaatgcaaagtaaggagcttcctccctgcagttgcaggatagttcagtgctgatgcagatgatgccacggcccttagactctctcaacattcaatttctcatgtgttggctttttcagatccccccttctgcaagaaaggctctttgcaactggntcagaatggcggcagnggagcatcgtcattcttcaggattgccctactggccctacctcacagctgaaactttaaaaaacaggatgggcctccagccacctcctccaactcaacaacattctataantgataactccctgagcctcaagacacctnccgagtgtgtgctca

SEQ ID NO: 549716 - DNA, 3134 bp, Homo sapiens
  misc_feature (33)..(33): n is a, c, g, or t
  misc_feature (2521)..(2521): n is a, c, g, or t
  misc_feature (2963)..(2963): n is a, c, g, or t
  misc_feature (2979)..(2979): n is a, c, g, or t
  misc_feature (3090)..(3090): n is a, c, g, or t
  misc_feature (3119)..(3119): n is a, c, g, or t
tcgactctgtctccaaaaaaaaaaaaaaaaaanttttttttttagatcatcagctattgttagtgttagtgtatgttatgtgtggctcaagacaactttgtttcttttaatataggcagggaagtcaaaagattggatatccctgctttataccaagaaagacaacaccccacatttgcaatgcctaaaaacactaccagccatctgaaaaacatgagacttctaacttctgttcttttttgtagcagtggaatcccacggtgatatctgagggatgtggttaccttttggaggaggttgacggtttctaaggatgattctttctgagtgaaatattgtcagtgtcattgaccttttcattatttcaactattattattccaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgtgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttgggacaattccaaatgagggccttaaatgatgctcagctaagctggttcttgtgtggcctctgtaccttcaaaagctgccgagtcctatgattacacgcgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacaatgggcttttcatgcctctcttactgtctcttactgtctattgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgacttttctttaccccctagctgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacaccttccgagtgtgtgctcactccccntccaccctcagcctcccgagtagctgggattacaggtgcctgccaccacgcctggctaattttttgtatttttagtagagaaggggtttcaccatattagccacaatggtctcaatctcctgacctcgtgatccatccgccccgccctcccagagtgctgggattacaggcgtcagccaccgtgaccggctcagactgtactcttctagccatctgaaatacgttttctaggtagagatagattgtgtaagggtacagttgtgaggataacagaaacatggcagattatttaaaatcatcctgaaagtggtgctttatctgatgaaagtgattgtaatccataggaaaatgtttcaacgtgcgcaagagttgcggcggcgagcagaggactaccacaaatgcaaaatccccccttctgcaagaaaggctctttgcaactggntcagaatggcggcagnggagcatcgtcattcttcaggattgccctactggccctacctcacagctgaaactttaaaaaacaggatgggcctccagccacctcctccaactcaacaacattctataantgataactccctgagcctcaagacacctnccgagtgtgtgctca

SEQ ID NO: 549717 - DNA, 1149 bp, Homo sapiens
atgttgagcccagatagcctaagtatatatcatatggctatccccccagtttttccaacgtattctcttttgcggaccgggatggtaccttgtgcgcaaatatctaccttaaaacgggctgcccgaaaatttcacctactaatgtctcgcccaaccatttaaatgtgagaattggccattttcccctattacgctggcctcctacaattattaccttagtatataggcaacccctatgtggttggtttttaatggtatagaacaccggaaggtttccttctttcccttaagtattacccttcaacatggatgcacgggtacttagtgcccttgtttcacgctcccttaacgcttgctttgcgcgtttcccgttaacatacttgggatgacattcagttacaggtataacagtaatgacagttcagtcaacaccaaggcaagattacccttgctttccctaggcgtgatgtcactcaccaccatttcgctaacagggttcgttaattcaagtatcctgggtggtatacacgacacgggacagaccgggttggaccagtgctgatatgtcatgaaaccactaacctgcacttcctcgatctgcagtagccatctgatcatcttagttagcgagtgaacggttcttcagttggagacttctcagcccttaggaaggtagcaacgtggaggtagcggtatcggaggaggttcccttgctgggcatgacttcgtagagggccaggagcagacaggtcatgtgcactatgccgattgacagcaacaagcttatgcttcaccgctatgccgctggcttttgcattcatgcgacagtcccaggatcccagctcccctcttatggctttctgtcattatgtgcgtttatctgagttggctccccaagcatcaccgagaatgtcaacttgcagtatttctagtgggaaccaataatgtacaagtttgacaattatgctgtgagcattcaaatgtgcttagttcggagaaatgctaatgcgcagggcataatatataacaataaaaagagacaatcattctgtttcctgcagtgggaactggccatgtagtcttaacagtctaggtacaaatatctacaaagcagataatatccctatacagccgcggccttggaatgtt

SEQ ID NO: 549718 - DNA, 100 bp, Homo sapiens
attcacttggaagcccacattctctttttctgtgtgtgtgacggggtctcactttgtcacccaggccgcagtgcagtggtgtgaacacagctcattgcag

SEQ ID NO: 549719 - DNA, 2511 bp, Homo sapiens
  misc_feature (33)..(33): n is a, c, g, or t
  misc_feature (2499)..(2499): n is a, c, g, or t
tcgactctgtctccaaaaaaaaaaaaaaaaaanttttttttttagatcatcagctattgttagtgttagtgtatgttatgtgtggctcaagacaactttgtttcttttaatataggcagggaagtcaaaagattggatatccctgctttataccaagaaagacaacaccccacatttgcaatgcctaaaaacactaccagccatctgaaaaacatgagacttctaacttctgttcttttttgtagcagtggaatcccacggtgatatctgagggatgtggttaccttttggaggaggttgacggtttctaaggatgattctttctgagtgaaatattgtcagtgtcattgaccttttcattatttcaactattattattccaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgtgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttgggacaattccaaatgagggccttaaatgatgctcagctaagctggttcttgtgtggcctctgtaccttcaaaagctgccgagtcctatgattacacgcgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacaatgggcttttcatgcctctcttactgtctcttactgtctattgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgacttttctttaccccctagctgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacggtcagaatggcggcagcggagcatcgtcattcttcaggattgccctactggccctacctcacagctgaaactttaaaaaacaggatgggccaccagccacctcctccaactcaacaacattctataactgataactccctgagcatctcaagacaccttccgagactccccttccaccctcagcggatgataatctcaagacacctcccgagtgtctgctcactccccttccaccctcttgccgccgttccgggaatcctctagagggacntccaaagggcat

SEQ ID NO: 549720 - DNA, 512 bp, Homo sapiens
gacccgtattgtctgacatcatatgcaatcaagtcacctgacgcaattttgtgaagaactatttatgcaggaaatgctctattgggtaaacctaaaggtgtggggataaaagcgggtttgggcttggactagagaaagggaaagtgttttcatgtccgtggaatatcctttgattgctgcagaatacgaagtggcggtagtgccagttcatgaaataggtatcaagtacttcatcagtggaaatatcaggagtggcttgagcaagaaattaactaaaagagtgatcgaacagagctaatcaggtgccatagtggtggtacctggtggtcgaagctgtgaagagtgggaggagaactttccagttgtgtatattgacttgtgcatgatctaagtacatgctgtcagtatggtgtcttcaccgtgctgtggttgatgctggcttagtacccgttgacatgcaagttggacagacgaggaaaatagtcgtacagagattgatatgtgtggagtta

SEQ ID NO: 549721 - DNA, 2345 bp, Homo sapiens
  misc_feature (33)..(33): n is a, c, g, or t
tcgactctgtctccaaaaaaaaaaaaaaaaaanttttttttttagatcatcagctattgttagtgttagtgtatgttatgtgtggctcaagacaactttgtttcttttaatataggcagggaagtcaaaagattggatatccctgctttataccaagaaagacaacaccccacatttgcaatgcctaaaaacactaccagccatctgaaaaacatgagacttctaacttctgttcttttttgtagcagtggaatcccacggtgatatctgagggatgtggttaccttttggaggaggttgacggtttctaaggatgattctttctgagtgaaatattgtcagtgtcattgaccttttcattatttcaactattattattccaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgtgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttgggacaattccaaatgagggccttaaatgatgctcagctaagctggttcttgtgtggcctctgtaccttcaaaagctgccgagtcctatgattacacgcgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacaatgggcttttcatgcctctcttactgtctcttactgtctattgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgacttttctttaccccctagctgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacagggtcaaaggcggggcggagcatcatcattctccaggatgcctgttggcctactcgtgaactttacaacagatggcggcgcacctcccaatcaacacttaagataaccgtgtcgccg

SEQ ID NO: 549722 - DNA, 1366 bp, Homo sapiens
  misc_feature (582)..(582): n is a, c, g, or t
  misc_feature (769)..(769): n is a, c, g, or t
ggcctgaattagggatgtgacagagcgcaagaccgaggctactaggatggatgcccggagccagtcgtgggaggccggtgcgcgatcgtcgcgccattgtgtatattatctgttcgcttgtagttaatagtaattttgttctctattaagaatgtcttgcgcacttgttccacacggacagcgaagctatatctcactgcaaaaagactgtggactatctcataccacgagagggacctcattgtgtcacgcactgatacgggaccttgagacattcgtaatagagctggaggcgcatagtgtagaggcaccttagagttggcaccgacgctctcctaatctgtgtgcgcatatgtataaacgagagcgcgtgagagatcttgctgttgcttctggtcgcatacaaaggaagatgctcaatcagagatcatctgaaaaccgcgccagtttgaggctctggagagaccggttgtcgctgcgagagcaggcgggtgggtgaagagtaggggccctccccatttcggtgggggagtatctgtggtgggcagagggtcgataatcagtagatcgcgcaaatggcgngtagtagtgggtggaatagggcgctcgaagagcggagagggggggttttccggaactttacaacccctagtggggcgttaggacctcgggaagtggggggtcacggagaggtcctcacgtcactctccttcttagaccatttggggagagaggagaattaaccccccctgtattgatgatgcgttgnaacaacccctacgagggctcatattcatttgtaagatcttttcagacgatccgttactctgctgaggacaagacgtggagcacgtcttaattggcgcgccgagaaggggaggtgtcacacacactaagagacggccacaagagacagcaaaacatttcggcgatgtgtgtgatgaaatgcacacgcaaactttatattccgacccagtctgttgtggcagtttctggacgtgtcggaaaaatccctccacttttggcggagatacaacaattgttatagccgtggttgtatgttcgggaggtacccatcgtcaccactattgcggcacgggggccaggtgtgtgggaaggttgtaggcagagttggaacgcgcaggtccgtaatctaaacctctcggcgtgtgggcggaaaagaaaaattggccgcttatccacagaggggtgatcagtgccatatcatacacttagcaggcgttcttcgctgtgggtgggaagccccccgttgtgggaggaggaggctccggagagacatattcatataccggagcgaaaatgttgcttgtggcacacaaattgaaactgatcagctgtgtaggaa

SEQ ID NO: 549723 - DNA, 1964 bp, Homo sapiens
  misc_feature (33)..(33): n is a, c, g, or t
tcgactctgtctccaaaaaaaaaaaaaaaaaanttttttttttagatcatcagctattgttagtgttagtgtatgttatgtgtggctcaagacaactttgtttcttttaatataggcagggaagtcaaaagattggatatccctgctttataccaagaaagacaacaccccacatttgcaatgcctaaaaacactaccagccatctgaaaaacatgagacttctaacttctgttcttttttgtagcagtggaatcccacggtgatatctgagggatgtggttaccttttggaggaggttgacggtttctaaggatgattctttctgagtgaaatattgtcagtgtcattgaccttttcattatttcaactattattattccaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgtgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttgggacaattccaaatgagggccttaaatgatgctcagctaagctggttcttgtgtggcctctgtaccttcaaaagctgccgagtcctatgattacacgcgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacaatgggcttttcatgcctctcttactgtctcttactgtctattgacctggtggcagtgctccggtgaaagttgttaaggaggattgcggttacattaaactccgtgtctcaacagcttcttataacccgttgaaaccgttccccgggggcaccgggtacattgtgaacc

SEQ ID NO: 549724 - DNA, 1759 bp, Homo sapiens
  misc_feature (914)..(914): n is a, c, g, or t
  misc_feature (1501)..(1501): n is a, c, g, or t
ggggcaccatggcagatgaataaacgcggcatgatgcagttactcttgagtgtctgaagaaatccgcgacatgcactcagacggatgcgactggtcgcatgagctgcacccagactgacgggcgagcgagtggagcaagccaggggacgtaccatataatctgaggtgtgctcgtagcacctcgagtgcaagagacaagaccttcatgaggtgtgttaacttacgtgtgcactaggagtcgacacgttcacacgcgagggccctacacgattggagtcgatctgcgaagctatgatactctgcgcatgccacttagaaacgctgtcatcttcgtgagcctccgggcgcacaacgctcacatctagggatcactctgtgagcggccttagcacccactctgctcattgcgcactggtcactagcagctcgcacgcacacgggagagagccgttaccacgtagacaccacttgggcagccacgttatagggccgcgctcccttgggcatagggagcttcgtcgttgcattctcggttgcggctatacatacgaattcgtagcgcctagttcggcccggtggtgcgtcgctcaagcttagagatttgccccttcaagacagttcgccttaggcaatataggacttcaaataccgttatgtgcaccccacaaggggttcgcacaagacccgtaaaaaactttgccgacacaaggcaaggcacatataggtctctaacacggaataatatgctccggagctcaggcaagacgtggcgcaatgcgcagataggtctagaacccttatactcggacaatgtgctcataccccacgaacggcggtaattcgcaccttccgaatatgcgagagcggcacacctacgggaggcaagcactagggttcgccattttcggcatacntgtggtctcaaaattgccacaagcgacattcgtcctctagcgggacattaacaacattgccacataccttagaggcgcacgacacaagcgcagtgtcgcaacacggccatttcaatgtgccacccccacgagcccataggactaatcctcacccaccccgcctagagtctctacatgcgaacacacacacgactatgttcgacccaattaagcggctatattgttcggagttcaccaataaacggcaaaggcttaaacaatatcgccgggtgcacaaacggccttgcgagaaccaacggcacttctaggaggggaaatcagctccgtgggcagggacatactgtcggcgtgacaatctctattcctcaggggtgtggtccagcgccacattgccaaaccaaactcctgcgttgggtggtaactctggaaagccatccgggctatgacacaagctctaggtgccccatagcggaagggcgcaaagcatggccttggcgggatgcgacacacagtacagaattgctatctaaaccaggggaagcgcgtaaccacaattgatcttgccccccgcagcccttacgttaacncgcactggcacatacgggggggggcacgacattgtggcacactttgcaaatggcatgcctttcgaatcgtactagtgcacgcctcgtggacgacccaaccatgtcatcagtgtaccccccaagacacaaacgtcgttataatccagtactaaagctccccgcgtatagcaacggcacacaagattatatctccgcaatgctacagacacccactcgcgccaaccgacccgcccatcacctagtgactatcgcacgatc

SEQ ID NO: 549725 - DNA, 89 bp, Homo sapiens
  misc_feature (67)..(67): n is a, c, g, or t
catggatttgctggtgcagtacaactaggcttaataggctcgaattcgaggtattccattgtagganaattacaagctgaaaataagca

SEQ ID NO: 549726 - DNA, 1082 bp, Homo sapiens
cggcaagcgcaggaaagttgatgaggagctcgtggtcccagaacaaagcttgagaaaaaccatggtgaatccgggcagacagcgtcgcaggcgccccctgtgatgacggcacggctcccatcatcctggaagcggtgctgcaggctgacagtggggcaagaattgcggaccgctttctgctctatgccatggacagctattggcacagacggtgcctcaaggtgctcctgctgccaggcgcaggctgggcgactcactcggcacgtccgtgttacaccgagaaagtggcatgatccgtttgcagaaatgactacattaggttatttgcgcacaatagcaggtgctatgcagcgcttgcgagacagatggattcctgcagagtgaacatacgtcatgagggcgcaaggcacatgctcgtatcatcttcacacgctgttggtacatgctctacctagacggaatcagcctggtcccgggagatcggattcactacatcaatcggcagtgaaatatattggtgaacatgattagacctacagctcttcatcaatggccatgcgaattcagttcagagcacatcccactactgccagaccagaaggtctgctaaaaggtcagagtaatgcagaatgcgtgacttcatctcagatttgtcatcacgcagggtggatcccgaggtgtcttcacgcacgacgaggtcacttaggaagatagcaaacaagaggcaagctccatgccattgacagcattatgaggactaaattgacattacccgacgttataggcggactcaaactgcctggaatatgaacatttaagggcacaccagaagaaccgtgaccaacgggaacagccgggcacgccacaagagcaaagaactaccacaccagaggaaaacaccagggactcggggcgcagcgaccaaggtggggagcaggaacgagcggcagcagagaaaagagaggaagcgtaaaaacagggcgacaaccggcccaaaaacgaccgacggagaaggagacagcaaggctgcagtagacacacagcacgacagagaggaacacagagaagaacgcggcgctcac

SEQ ID NO: 549727 - DNA, 352 bp, Homo sapiens
aaatgctttacatttgagaatgaagctcagctacagatttgaacagcatactgacatataccaacaagaatgaaaataacttaacagcaattttataaattcacatcccccagagcaccacagagtaaagaaatactgcatatgggtaacaactggttcttagttactaaatctgaaagatcaaatacagttaattacataagcttctcttgagtttttctgggggaatataccaggagaccataatcaagcgctttcagcatcaccagtggcatttcatactggtcccatggtgttaatccaggtttctggtattggactaaacacgatgaaaaacaggagagaacggaga

SEQ ID NO: 549728 - DNA, 150 bp, Homo sapiens
gctctagaccatcttacgctctccacccacccccggagaggcagcaatagaaacggctaccacatccaatgggaggctatcagccatacaggcttaacaaatatagtagactggcctagtataagagaacagggggtgggtggagagcgg

SEQ ID NO: 549729 - DNA, 162 bp, Homo sapiens
tccacctcgtgtatccccgccctctccctagcaaatcagtccagccagtcctcctttgggtgcaccgttccctggggaggatgacaagcgctccgcacagaaatttaggggtgcgcctggtctcttctcacttgcttccaaccagggtcgactggctcaact

SEQ ID NO: 549730 - DNA, 116 bp, Homo sapiens
cgttacaagatgcatacagctcactgattgcatcctctagttgccgcacagtgcccaccaaaagtatgtgcgacaagcctggcagaaggcagacatcaatactcatgtacagccag

SEQ ID NO: 549731 - DNA, 375 bp, Homo sapiens
ttcattactcacgcactcatgcaagggtgcatccagtagtcagccctttagtgcagatctacctgtcaccagctcctgtgcactgatcagagctcagtcagcagccatgtgactagtcgtcctcgcagtcaaggcataggtcgatcagacgagcacatggtatgctctcagcctcgttatagtgtgtatgcagagtacacgcctctgtccctgtgaggcttcctatagcccctccttcatgcagggcgctgtatcagagtctgcacagcctaaccacagggcatgagtgactgagcatatatgtaagattgtcttcagtcttggagacagaggtagtaagtcaggaatgtccacacaatgtcatgatcatcagag

SEQ ID NO: 549732 - DNA, 241 bp, Homo sapiens
  misc_feature (232)..(232): n is a, c, g, or t
aaaaaaagaaaaccttaaaaaactccccttaaaaaccaaacctctttgtgttttgaaccaaggaattttccaaatttgattgggattctgttttgaagtctaggaaatttttcagcccataaagccccccgttttatgcccctctaattttgaagtttggggaatgggggagggcaaggggttttttttttttttttttaaagcgggtgtgaaccaatggaaataaagccgngggctgtga

SEQ ID NO: 549733 - DNA, 246 bp, Homo sapiens
  misc_feature (74)..(74): n is a, c, g, or t
cgtagagatgggatctcactatgttgctcaggctggtcttgaactcctggcctcaagcagtcctcctgcctcanctgtaggcctcccaaagtgctatgattacaggtgtgagccactgcacaaggccagcaatttttttttttaacatatctgcttcccttaacaaattgtaatgaccttgagagcaggaactttaaatccctgtcttctacacctaattcctggcccatctcagagttaatctct

SEQ ID NO: 549734 - DNA, 157 bp, Homo sapiens
atatggaattgaatttgcacgctcagaggctttccagaagggtgaaaggaaaggagccaagaaggttatgattgtcatcacagatggtgagtgccactgacagcccagactctgagaaggtagatccagcaaagctaaagagactgcctcgccaaat

SEQ ID NO: 549735 - DNA, 125 bp, Homo sapiens
  misc_feature (99)..(100): n is a, c, g, or t
ggcctagcctgccatacccttacgagcaggctcagtgattagactttgagtctaagttaaaaacgccctgcccccttctcgcaggccacctacaccgtnnttttatcgatttgataaaaccacca

SEQ ID NO: 549736 - DNA, 197 bp, Homo sapiens
ctaattggttcttcgatgacgggtagagaggatgactgtcctgttgcttttcctcgctttaggcttccccactcacctcctctaggaagccttcctggatacccctacattctccaactttcttcggtatattccatggagactcccaccccctctgccggccaagcaacagctaacgtcatcgaagaaccaattag

SEQ ID NO: 549737 - DNA, 409 bp, Homo sapiens
accgagcgttgttagatctataggcgctcctccgtagtcgagccatggccacagagcctgcgcgtgagacggaactcgaacgacgcgctacagacttcctagctacggaaggggctgatacgttctgctgcagcaccgtgtatgtgagattaacgtgccagcgctgtagatagtccgtgctggactcgagttgcaagatcatggactgttggatcattcatgaactcacagattcattacttactacattgcaagcggaacctgctatgaaccaggacgaagagactgagtatcgagagaagctacagatggtaactcctagccaggaggatgtcgttcgcagtttgatgctacctggcgggcagatgtccacacatagcgctgatagttacagtctgaatggaggcat

SEQ ID NO: 549738 - DNA, 904 bp, Homo sapiens
ccaacgcgcatgattatgttaggaaaactgttctggcagcaatcatagagcctcagaactgagagtgacgtcgcctgtggatagatggcaggcgtgtgaaacaggggcatcgacattgttacgagttttactggggagcatggataagagctcgatctaagttttccggatgccagaggccggctaccttctggagactgtttcactcaaccatgtgcacccttggaccagtttgataggtggcttaagtagcggactagtacccaagtatgtagatttggctcaattcagtaccattgaaaaataactttgacgctggtcgcttatccttatgtacaccgttactagttcttaagtgcgtctgttgttcatacgttggtcgtgtcgttcgtcatatggactcaacatcccttgtggaaagttgactctcccacctgcacctgtttatcactgtatactatttgataaattgctcatgtggatctcatcgtgaaatattggctccatggttgtgtctaacttcaagcatatatacctggtcatttaagttactcactaaagaaccataacaagcgagctaggtattgaatagtcagccacgcagactttttgttgaagcgtctcatttcatcggatattacccgatgcactctgggagtagacatgtgtacgtctaatcatattgtgatttgcgctcatgccgaactcccatccttagtgtcatgccagtacccttgataaggtcctcggcaagttggcgttgccaacttgtttttggacgcaggaaattggcgggttacagcgtcaacgactcatccggtcaggggcaaaacaggggatatgggggaattcttgggggacaaaccttcgccgggacagatacacggtttttgacagtattcgc

SEQ ID NO: 549739 - DNA, 406 bp, Homo sapiens
gcgcgactggtgcacaccgcatggatgctcatgtgcggggacacgctgttcagcagcccggaggccctgtaatctgatatgagctactagacaagccctgtgtattcctggactaggtgtggctgtcctgtctgtccctggcctcgagttcccattcctaacatgacgtgctttcaaggactcaggagagccctatggctgctgccaggacgacggtatggactccgctgtagggaagcgccacgtgtagctgcggggccgagcatctggaaccctgctcctccttccccgctgtgccagcctggctcccaaaatcaggagaagggggctactcctccacacggctttcttaaccaacaccgagctttgccgtggtcaggtgaagctaggtgcacgctagcattcc

SEQ ID NO: 549740 - DNA, 245 bp, Homo sapiens
  misc_feature (126)..(126): n is a, c, g, or t
tagcatcctacagacatacttccgttgttctctcacccaccctggaactcctccccaggcgccatgaggaagtataaacacgcggcaagcgactgagaggcaaaacctctccagtggttaccagtnaccgctcaggtcacactgagcagcgtgtttcccgcccatcttggcagaaaggaggagcaagcccgagttgcaggtgtcctggatcgctgtcaggagacccggagcataccaggctcttc

SEQ ID NO: 549741 - DNA, 288 bp, Homo sapiens
  misc_feature (8)..(8): n is a, c, g, or t
tagctggnactgcaggcatgtgccaccatgcccgactaattttttaaagttttttttgtagggagggggtcttgctttgttgcccaggctgccctcaaactcctggctccaaatgatccttctgcttcagcctcccaaagtgctggaattacaagcgtgagccacagcgcctggcctgttttaactttttgaggaaatgctaaactgttttttccacaggtcttgcaccattttaaattcccaccaacaacaattttgttcaaccaccccctcttttttgatccaaac

SEQ ID NO: 549742 - DNA, 174 bp, Homo sapiens
agggatcccaaaaagggcaggggccccccccccaggcccttttttggaccatggagccaggtgaaacctgtttggccccttccccattgggtttttactccttcccaaggggcagcactcctttcccagcccccccgccccctgttttcaaaaaaatggggggggggaggggca

SEQ ID NO: 549743 - DNA, 116 bp, Homo sapiens
attaaggacaccatcgagaaactgaaggagaagaagctggccccatcacctaccgcaggccgtggactggccaaggagattgactcggtgaactacctggagtgctcagctctcac

SEQ ID NO: 549744 - DNA, 1060 bp, Homo sapiens
gtacgggtacagaaatccaggttgccctgccacgcgacctggccatgcgcacatcgcaatgtccctcactgtgctaatcttgccccctcgctgggagcacgataaagtgctttctgtgtctcccgtgcagtcgcgggaggatcctgctggctggtctctagagtgccggggagctcgtgctgtgtaccagtgacgggacggcagtcttcagtcgtcgccttggcgatgcccgctcgtcgatatgtccagctgctccgtcccgccacgcgttgcgtgtccgtcgctgctcgctcgcgcggccgtatcgtggggtgcgaggcgaatcaggcagggcgaatccgtagaacgacgtcgactcccgatacgggccctgtcatgtgccgcgcgcaaaccgagaaaggcttagatcccaatgcaaagaaatgacgtcaatggatgcgaggcatggcgtcgttccgtacgcgtggaccaagggatgccggcgcccgtggagggcgggtccagacagtggggaccgcctattatgggttgaacagactcccgctgatcgttggttacccgaagaatgcgaggggagccttggggccccttccccggcggactaacaggaccagcttaacttacaggcagacgctagtcgcagtggatccttggcacgtggagccaatgatttcgtttgggtttgctcaacccagttttgaaggaagcctcccaggggaacttgtgtttccctgaccaagaattcggaacctagattagcccccaggtcttgtgagacttggccagaatcggacccgtttccctgaaacctcaaaagatgttcgacggcaccgtggacaatcgaaggggcctacgttggcccgccaattggagaccggttgtgacagggaccggagcaatccaaagcggggcctaggcgcccaaggggttgacttgggattggaagcttgagcacctggtgacccaggggaacccgagccctgggacgtaattgccatgcatccggacacgggccctgaaagggaaagaagctgggcactaagcctgaaaagaaggaacc

SEQ ID NO: 549745 - DNA, 466 bp, Homo sapiens
  misc_feature (13)..(13): n is a, c, g, or t
  misc_feature (24)..(24): n is a, c, g, or t
tttgaggcaaganaggtccatctnccaaataattcaaccataggccaaagaggtttttctacctttaacctacaaaccagtgggaggaaatgagagaagagatgtattttgtacatggctgtggccagtgataaccccttaagttgtgtacggaacaggttggtggttaatagcagcaagtacgggttgggcactgtgggtcagactgttaatcccagcactctgggaggccgaggcaggtggatcacttgagctcgggagttcgagaccaaccctgaccatcatggagaaaccccgtctctactaaaaatacaaaattagccaggcatggtggcacatgcctgtaatcccagctactcagggggctgaggcaggaaatcacttgaacccaggaggcagaggttgtggtgagccaagatcgtgccattgcactccagcctgggcaacaagaggaaaactccatctc

SEQ ID NO: 549746 - DNA, 125 bp, Homo sapiens
  misc_feature (2)..(2): n is a, c, g, or t
tntaattgcaattaattggtgtcccccaccatatagatatttaaggaaggtgtacttaaaaatgttggctgtttaaaactgagcatgtcattaatccatatgtggactagtgatgaatagatatt

SEQ ID NO: 549747 - DNA, 148 bp, Homo sapiens
gaagtaatactgtcagacagctcagaacagcctcaccgtctggaagtctgtcggcaaagctgccaaatgaataaccggccacatctgcaggtagtaagactaacatggggtcatatatctcgggatctactggctctaccaccacaag

SEQ ID NO: 549748 - DNA, 349 bp, Homo sapiens
  misc_feature (24)..(24): n is a, c, g, or t
  misc_feature (33)..(33): n is a, c, g, or t
  misc_feature (47)..(47): n is a, c, g, or t
  misc_feature (54)..(55): n is a, c, g, or t
  misc_feature (81)..(81): n is a, c, g, or t
  misc_feature (93)..(93): n is a, c, g, or t
  misc_feature (173)..(173): n is a, c, g, or t
  misc_feature (258)..(258): n is a, c, g, or t
  misc_feature (277)..(278): n is a, c, g, or t
  misc_feature (289)..(289): n is a, c, g, or t
  misc_feature (308)..(308): n is a, c, g, or t
  misc_feature (319)..(319): n is a, c, g, or t
  misc_feature (321)..(321): n is a, c, g, or t
  misc_feature (327)..(327): n is a, c, g, or t
  misc_feature (329)..(329): n is a, c, g, or t
  misc_feature (331)..(331): n is a, c, g, or t
  misc_feature (335)..(335): n is a, c, g, or t
cgaaggaggtggcagaggctagtncagcctcanaagaacaggcaggnccccagnnctacagagccatccactccctcgcgngccggagagtgncctacaccagccagcgctgagcagaatgagtagctttgtaggtgcaggtgggtgatctctaagctgcaaagactgtgctntccttgtgatgtcactgcctgcaccttgtgccctggctgccttcctgtgcccagaagggaaggggctattgtctcctcccagccncgttcccttttctcctctnnctcctgtggantctcccatcagccatctcnttctcctctcnangccagntnangatngtccctgtacgtta

SEQ ID NO: 549749 - DNA, 288 bp, Homo sapiens
tcgcatcgtcaccacgtgggacgacatggagaaaatctggcacacagcttctacaatgacgctgcgtgtggctcccgaggagcacgccggtgtgctgagcgaggccccctctgaaccctaaggccaatcgcgagaagatgacccagatcagtgtctgaggaccttcaacagcactcagtcatgtacgttgctatccaggtcggtgcttatccctgtacgcctctggccgatccactgtgtatcgtgctggactccggtgacggggtcccgcatgttgtgcccttttac

SEQ ID NO: 549750 - DNA, 185 bp, Homo sapiens
gtatggtagggttaggtagggccagatgaggcattgtaaatgatggtgagggctctgggatagggttagggttgtagttggtgtaatggttagggttgaggttggggttgagttagggtgagggttagagttacggttgaggttgcggtctgttagtagtatagtgatgccagcaggtaggactg

SEQ ID NO: 549751 - DNA, 306 bp, Homo sapiens
gaattcccccccccccccccccccctttaaaatgtgtttgcaggcagtatgcttggtaaaagtcatcaccattctcccagtctcaaataccaagggacacaatgcactgcagaaggccacagggacctctgccccagaaagcctgggtattgtccaaggtttctgcctgctgagacagcctgagatatggcctcatgggaagggaaagacctgactgtcccccagcccaacacccgtaaagagtctgtgctgaggaggattagtgaaagaggaggacctctttgccagttgagataagaggaggca

SEQ ID NO: 549752 - DNA, 903 bp, Homo sapiens
agaatatgataatcctcatgcctttaatctcagcactttgggaggccaaggcgggcggatcacctgcggtcaggagtttgagaccagcctggccagcacggtgaaaccctgtctctactaaaaatacgaaaattaggctgggactacaggcgcctgccaccaggcccggctaatttttttggtattttgtatagtagagacggggtttcaccgtgttcacccaggatggtctccatctcctgacctcgtgatgagcccgcttcggtgctcccaaagtgttgggattacaggcgtgagccaccgcacccagcgatttagtatttgtttctaatagactatgttcaacaaataagtaattctcgaattagtgcagattaagacaatacaggaaccaagtagcatacccagtcatagaagaactttacgaaaggcttctcggaaagccctttttgtgaaaggacagtattcgtaagtaacatatcatttataatgagacatcttgacccagtgctagaagactaatcatcgtcaaaatgtatttgtctttgggcagtgttgcccacactcaggtgtgaggctgacgttgaagcagataggctccggctatattcatgccccattgggtggtcctacgattaaggctcctgcgttgcatttgggccattatttctagaaacttgcggtctccaaaccgatggttggcttcaccgattttacatcggggcgcaaaggctcaaatggaaggccacgcaaggaggagcgcccataagatttcgggacagaccgaccgcgtcaggagcactcggggggtggggaccgcaacggtgcacgggaaaggcgccacggtgatcgggacgcccataaagggcctgcggaacgggacccaaatggggtcaccaggga

SEQ ID NO: 549753 - DNA, 691 bp, Homo sapiens
gagatgagacgaaacgatgagatgaaatgaaaggaagagatgaaatgttgagatgaaactgactgagatgaggtgagatgaaatgacgatgaaacaagatgaaatgatgaaatgatgagatgagaagaaactgagatgaaatgagatgagataaaactgatgagatgaaatgaagtgaaatgaacactgaaataactgaaatgaaattgacactgacgactgacgactgaaactgacgactaaaactgatgaggatgaaactgactgagaacgaacatgacgatgaacatgactgaacactgactgacgatgacgactgactgacgatgacaacaactgactgacgatgaacatgggtgacgactgaacatgacacactgacacactacacctcgaacactgagcgactgaaccacacgacacactgactgaacactgactgactacttgacacaactgacaacttcgaaacgaatgacgactgaaactgaaaatgtttgacccactgaaacactacatgaacatgaacgacgactgttgaccatgaaaatgacctgaagctgaaaatggatgaaactgacacgtggaaaactgaggacttacgactgattgacgatgaaaacacatgactgagactgaacaactgacaactgaaacctgattgaattgacgattgacgatgaaaatgaac

SEQ ID NO: 549754 - DNA, 133 bp, Homo sapiens
tctagatatatccactcactaaggtccaagaagaagatgtggtccaaaagaacgtcacctcagagtccacttgctgtgtagctaaatcatataacatgggtcacatgtaactgggtgggtttcacaatgtgga

SEQ ID NO: 549755 - DNA, 177 bp, Homo sapiens
taccttgcttatatattctagagattaagcccttgtcagttgcatcatttgaaactattttctcccattctgtaagctgtctttttgtttcttttgggtttcctttgctgtgcaaaagcttttcagtttgatgaggtcccatgggtttatttttgctctaatttctattgctttggg

SEQ ID NO: 549756 - DNA, 438 bp, Homo sapiens
tggctcatgcttgtaatcatagcactttgggaggccaaggtaggtggattgcttgagcccaggagtttgagaccagcctggacaacatggcaaaaccctgtctctacaaaatacaccaaaaaattagctgggtatagtgatgtgcgcctgtggtggtccgagctactcaggaggctgaagtgggaggatcacctgagcccaaggaggtcaaagctgcagtgtactgtgattacactgaagcaggatatttccctgacccctttgtgggacttgagacaggggtaccttgtttactcagcctgccactctcaactccttgctggaaggaacgcctgagcaaatgagcatgggaactggggtgagtgagtgctggaaccagctggctgctttggcacgggcaggagtgaactctgtgcaggctctgcagcagcatccagg

SEQ ID NO: 549757 - DNA, 188 bp, Homo sapiens
tctatctatctatcttatctatctatctatctatctatctatctatctatctatctatctatctatctatctatcatgtgtgtctgtcctcatgtgcaccacaaaagcacgttctggattcagttctcttctttaccatgtgggtcccacatgtgggtcaattcaggttgtcaagcttgagtcgacgc

SEQ ID NO: 549758 - DNA, 192 bp, Homo sapiens
tttttttaatgggattttttttttcccccgccttaaagggccccatgggggggggggtttgggccccaacaggggccccccctgccccccttaggggagggggagcctttcccccttgggcccgggcccgggtttgttaacctttacctttttcccccactaacccccattgaaaccccctttcccggggga

SEQ ID NO: 549759 - DNA, 247 bp, Homo sapiens
ttgggctcattcaggtccagggaagagggaggagggagcagttaggatgattatctcggccggggggagagagaaaaatcagggaacgttcagaaaggaaatgtggacacctcatgcctctaaactcggaagaggggtggaaaactaataaattcataatctctacctctcaaacaaatcaatagtaagacatggcatcttataggcactggagttcccgtgaggggagcccaaaggggtaccggag

SEQ ID NO: 549760 - DNA, 296 bp, Homo sapiens
ggacgatataaccccgtcgggtattgagtatctccttgcgttgtgaaccagctgacacaagggcataaaaaaaggcactgtccatacgctggcgggcctttgaagttcgttggttattggactcacgatacctcgcacgctccgtttgaagtggtcgtggtggtggttgtcgaggtcaggcaatgggtggtcatgggggtgacacatagcattgtgattgtccgaatgctaggcaaaaaaaagacgttgtgggacatctttattcgcgagctgggtggcgtagagaaagggatcgg

SEQ ID NO: 549761 - DNA, 913 bp, Homo sapiens
gtctctgtcagtcgcgagcgacgaccaagagggtgtcgactgctagaggcgagcgaagggttgcctaaatcaagggaacttgttcttcaagctcttctgcagtgattctgacagttgagtgttggacaaacaatgttacggaggaaaaagcagagttgtccagaaaaactttgtaagagaaacaaaagacaggtgagacttcgagagccgtgtatcttctaaacagagcagcatgcagagaagatgatacacttgtccagatggggaaaatgaggtacgtaagttgtcgcgatttaaagggggcaacggtgctattgggatatagagaatatgggagtggactcctgagtggtgaaattgaacgcaggaagaaaggggtatttcttaaaatccagaacaatgtggagccagttgaaggaaaaggatttctgactattgatgatgcagtaagaaaatggtgtaaatattcgagcaatataaataaaagctgtagtgtctagttgttaaatcgtgtcttttaacatgggcttgtgtttctaagttggttcctcccaagctattgttatggtttggtcttggcggaaagacttttgtacacgattgaactaccttttttaattgtgccttacttaaaccaattttttggttgcacgctatttgtcccacctctaataaagggattactgttgtcttgccccacccacttagtggtaactaacatccaagtaataacactcttagtgtggtggccttttgagcataaacgtggcctgggttacggccaaagtacaggttaaaattttacgtcccccccgttaacacaacggttgtggtcggggaacactgggggcacactggtttcccacagtgtggtggtcccccgttctatttttcaaaacgcgcggccattttg

SEQ ID NO: 549762 - DNA, 570 bp, Homo sapiens
gcaaatccaatccaggttcccaaatcgcccgcacatccaactaacaggctcccctctaggtaagaagtactccgcgagatactacaataacgaacccgcctaagaattcgcccgtggccgcagtataaaaagtctcgcctaaagcggagttaccatctccctgccccactctagaggactccactccctaatactaaccaacgtcccgcgtaacgtagaaccgcgactataagtacaactctctaaaaccctacgaggaggagaaggctctagactatcctgccacagagttataggaggcgactccggcagtagagccgtcactaccggacgagtcagaggaagcctactccacgccgtacccgacggcacctacttcaccgacgtaaatgacgtcaaaataccccacctacacgaaatactccaaaccctaacctaactctgcccgagagtcaactgctaccgaaacgccaacgtaataacacctacctcctactattcctaagaagaagaagcaccttctaagttggtatctaccgtcgtcagaagcctactccccacctcctgctt

SEQ ID NO: 549763 - DNA, 280 bp, Homo sapiens
ctgggaggctgcagtgcacccggctaatttttatatttttgtagagataggttgtcactgtgttgcctgaggcttgtcttcaactcctgccgtcaagcaatcctcctgccttcaagcaatcctcctgccttagcctctcaaagtgttgggattacaggcatgagccttacgcccagccaacataattttttttttttttttttttggaaatgaatgtttcactctctggtggcccagggctgggagtgcactgggcagcctccctaggggtaccggagct

SEQ ID NO: 549764 - DNA, 299 bp, Homo sapiens
  misc_feature (121)..(121): n is a, c, g, or t
tttttaaatcatgcacacatggacttggtaaaaacatacttgatagaaaactaagatgaaagtcaaaacagcattgcacacagacagactgctgaactgttaggagtttttagccccgccntgtgcaggtaggcgatgaagcagagtcaggtggtttgacttcagtcctgcacagcacctgtgacttagaaagcattacagttgagatgtagatacaaaaagcatctatcaaagaaatcgcttcatcatcttgaaaacaggacaaaacacttttctttcacagacagttttctaaactc

SEQ ID NO: 549765 - DNA, 238 bp, Homo sapiens
aaaagtgattaggaattatgtacatgacgtatcagaactaggacttaccatacggagcagcataccagtgctttcaaccatctacttttacagactcaatttcacaacagcatacccgagactacttccccatacaggcgtgactaatacactctaaatcccaacgacacgagtcgctggcatcatccccaggccattgggtgagaactgaactaccatgtcaacagatctgtaaaca

SEQ ID NO: 549766 - DNA, 284 bp, Homo sapiens
  misc_feature (11)..(11): n is a, c, g, or t
ttatgataaancagaccatccaaacaaaaaccccaccccattaaaactgggcaggacccattaggccttgtaactttaaaaagtcccagcactgtttagcataataaagcgtctctttctatgcttggattttattcaaccctggaattccctcctcctcctcttaattaggctagagttaaaaattaggctagagttagaaaagtctaatctgtttctagactctcaaattctgcatctaatgcttgcacaacccatttaaaacttaggaatgctgccttttt

SEQ ID NO: 549767 - DNA, 937 bp, Homo sapiens
tgccatgttaatactgtgggctgtcccatctctctgcgtgggcgcgactagctggaagagccgaacgtgataagatgaagagtgagtgtgagaggagctgtacaccacaagagtgcactgagtggactcagtgataacgtggatgaagccgtcagtgcccccagaaacgaagcggcccctggacgaatttctagagtcacctgtctgctgagaaatgctgggcttgagcctgccatatttggaagccttggcaaaacctgaatgcaaatgaaatgcttgcctgtgtttggatctattgccagaccttctgtgcacgaattggtgagcagtgttgcgaggcgagggatgagccaagtatacacgtatgggcatgattagagccctgtgttggcttgccatgattgtataaccgagacaccgaatttccatctacctttttgtccgaagcaagctttatttgttggggtcaatgggactgtcatgtgtacgcattgccatatggtttataactgttggtcagtgcattgaagcatcatgacggacgtgccacttacttgtaaggcgggcaaattggaaacattgctcctagtgctggggtccatattttccttaggggtgcagagctgatcagtcaaccctttgtcaaactgggttacggatgaaaggccgctgatggcctgccatactatgcatctcggggcgggccacgataaggggacggcgggagatgtgccggcagaagggagtgcggggggcaaaacctggcgcccgggaccgatgacggccaaagggcagccagcaccatgatctaaatagaaggggacgaggtgaaaagagggcccggaggaccggggccaatggcctaggcaaacaggggcaccgaggccagggaatgggacctaggaaggaccgccaccgaaggagcctggagggaagc

SEQ ID NO: 549768 - DNA, 121 bp, Homo sapiens
tagaggatcccgacacaagaaatgcagcaaaagcacacaaacacacacactgacactcatctggggcaggccatcctcctccccaactctcagctgcctgcactgctggtcatgggtgaga

SEQ ID NO: 549769 - DNA, 385 bp, Homo sapiens
cacagaaatcgtcaaatcaggtttagcctaaagccacgtctttacatattttaagtttggcctaaaggtttttctgtacatcatgaactgtaacagggggaggtgtaaacagaccatagcctacacttgtgccagtcactgagttttggccaaccaaatgtagccaactgttcaaaccatgtgcaaataaggcaaacaccaagctgtaaccctccagctgtttctgtgcctcacttccattttctgtaagtcactttcttttttctgtccataaatcttccaccccatggctgcactggagtctctgagcctactctgactggaagcttgctggattctcaaattgttcattgctcaattaaattttatttggctgaaaaaaaaa

SEQ ID NO: 549770 - DNA, 619 bp, Homo sapiens
tgattaatctctgccatgaaatgcttagggctgatcgtgatggactatgtcgctacagttctagaaacaacaggtggagatattcaataagctcatactcgaacagtatgctaccagtagatgcagtttcaaaggaactcagcagacttatgaaaatagcgagttgacacttacaacaatattttaacagttcttgaaattaaaacatttcacgcatcttagagatactttgcatagatttctttatttatctatacttgttatgtgcttagtaatgttctggattataacacagaaatagtctctcaagcacaggtggattccataatgaatttggtatccacgttgattcaagatcagccagatcaacctgtagaagaccctgatccagaagattttgctgatgagcagagccttgtgggccgcttcattcatctgctgcgctctgaggaccctgaccagcagtacttgattttgaacacagcacgaaaacattttggagctggtggaaatcagcggattcgcttcacactgccacctttggtatttgcagcttaccagctggcttttcgatataaagagaattctaaagtggatgacaattgggaaacaagaaatg

SEQ ID NO: 549771 - DNA, 239 bp, Homo sapiens
  misc_feature (5)..(5): n is a, c, g, or t
agggncccccccccccccaaaattggggggggcccctttttttggccccccccccccctttcaaaaagggggggggtttttatccgggggggggccccttttttttttagggcccccccgggaaatttttccttttttcgggccccccggggtttttttcccccttttcccccccccccaggttttggggtaggggggggggggggggttttttttttttttcccctttccccccttta

SEQ ID NO: 549772 - DNA, 1522 bp, Homo sapiens
gggcacgaagggtacctcacagcagtgtgcctgcacagcgtgaagaatgctccatcagagccccaactctggccgaagctggacagctctgagtctgaggaagaaacgctgcacaagtcgaccagcagacagcagacgtgtctccctcatttccctgtacagatgccatgtccctggagtgccgtgtccacacaggaagcaacgcctcccaacaattcctgcccacaatatcatcaaacacacccatgacagcagagacgggaagcccaccccaagaagaccgcacagttaccaattggaaacacgggcaaaccgcccttacctaaaacgctagaggcgcaagattcccatggaccgcaccatatccaagggacccgaagtttcccctgcttcgtcgatatgcagcgaactaccttgacctacacgccaagagatgggcacatatgcccctcgccatactattaaccatatgcatgggacaacgcaacgttctgcacttgccaattattatctgccccaaagtgctacccctggagctacgcacacacgcgtccaacgaaagccttcgggccatccaacaaaagctaacgcccacatcgcacggcataacttcacaaacccagaacgactattcccttatacccaaccactaggataccccttcttgccaaccaccacaccaacccacgcgcgaaccacaccgcccctcccattcggcacctcaaaacctctggctacctcaggccaccagaaaagacacacccgatcgccgaaacagaggattatcagcatagaccctctctcaccttccacaccaccctacactcgcgaacaccaacaccaataagcagccccatcggacaccacaaacaaccacacaacggcccacaaacgcaaacaggagaccacggcgcacagccgatacgaccaacaaacccaaggagagggcacacaggaccaacaacacaccacccgcatgtcactcccccgtaccaacagacaaaacccccataccacgaggatacacaaacctagagcacccccaccacatccacacgcaaacacaaaaaccccaaccccaaaccccaaagacaacccccccccacacaccagccacgcgaccaggcaaactgcccgacaaaagccacaaccccaggccaacgaaccacaccccgcaacgcgacgaaaccccacaggaccagcacagcgacaggcgaccccccacggccccacaataccaaaaacacgagaccaccaacaataaattcacacgcgcagacaaaccactcccaacaccaacaaggcaaaaccaaaaccgacccccgccgcccccgccacagacacaccaacagagaaaaacacatcacgcaccagacccaccaccccgacacccacaacgcgagcacacccccgcaccactccatcacaccacccgcgacacacacacaccaaccccacacccccgcccctccaacaaaacccacgaaccccacccccaacgcgcacccacaccgccgcccag

SEQ ID NO: 549773 - DNA, 132 bp, Homo sapiens
ccaggagcagtgtggaaatcgaatcgtgaagcattacatttgcttgagccagaagcccgttcagtcacgttctcagcgtttgtggaaaattattcccattcttcagtgtcaccagccaacctccgtggacct

SEQ ID NO: 549774 - DNA, 334 bp, Homo sapiens
tagactcttttaatgggcagcagggaaggcaggataagatctgtactttagagcagggcatggtggctcatgcctgtaatcccagcactttgggaggccgagacgggcagataacttgaggtcaggagtttgagaccagcctgggcaacgtagtgaaaccctgtctctactaaaaatacaaaagttagccaggcatggtggcacacgcctgtagtcccagctacttgggcggctgagacagaagaatcacttgagcctgggaggcggaggttgcagtgagccaagattgtgccactgtgctccagcctgggtgactggagtgaaatcctgtctc

SEQ ID NO: 549775 - DNA, 101 bp, Homo sapiens
gaatcgagctcggtaccggcactatcgaccggtgaagtggcaccatcgaagtgggggcactcccgacaacgtcgtaaaggtgccgcagtgcacccatctgg

SEQ ID NO: 549776 - DNA, 882 bp, Homo sapiens
  misc_feature (30)..(30): n is a, c, g, or t
  misc_feature (344)..(344): n is a, c, g, or t
  misc_feature (452)..(452): n is a, c, g, or t
  misc_feature (507)..(507): n is a, c, g, or t
  misc_feature (514)..(514): n is a, c, g, or t
  misc_feature (516)..(516): n is a, c, g, or t
  misc_feature (540)..(540): n is a, c, g, or t
  misc_feature (559)..(559): n is a, c, g, or t
  misc_feature (567)..(567): n is a, c, g, or t
  misc_feature (574)..(574): n is a, c, g, or t
  misc_feature (588)..(588): n is a, c, g, or t
  misc_feature (626)..(626): n is a, c, g, or t
  misc_feature (777)..(777): n is a, c, g, or t
  misc_feature (856)..(856): n is a, c, g, or t
  misc_feature (878)..(878): n is a, c, g, or t
cccccctctgtcttgtgaaggcaggggaanggtggggtcctggagcagaccaccccgcctgccctcatggcccctctgacctgcactggggagcccgtctcagtgttgagccttttccctctttggctcccctgtaccttttgaggagccccagctacccttcttctccagctgggctctgcaattcccctctgctgctgtccctcccccttgtcctttcccttcagtaccctctcagctccaggtggctctgaggtgcctgtcccacccccacccccagctcaatggactggaaggggaagggacacacaagaagaagggcaccctagttctacctcaagcangctcaagcagcgaccgccccctcctctaagctgtgggggtgagggtcccatgtggtggcacaggcccccttgagtggggttaatctctgtgttaggggtatatgatgnggggagtagatctttctaggagggagacaactggcccctcaaatcgtccagcganccttccncnatccaccccatccctccccagttncattgcactttgattagcnagcggaancaaggangtcagacattttanagatggtggcagtagaggctatggacagggcatgccancgtgggctcatatggggctgggaagatagttgtctttcctggcactaacgttgaagcccctggaggcactgaagtgcttagtgtacttggagtattggggtctgacaccaaacaccttccagctcctgtaacatactggcctggactgttntctctcggctccccatgtgtcctggttcccgtttctccacctagactgtaaacctctcgagggcagggaccacaccctntactgttctgtttctttcacancccc

SEQ ID NO: 549777 - DNA, 925 bp, Homo sapiens
gctgtcctttaagcgtcgacaggcggcggagcgggcacaatcacagtgtccgggtcatgggggaacccgagaccgggtgcgccgggggaatccgtgcgggcgccttccgtcaccggatcccatcctcggcgcgctccagcaccttctgaagtttgcaggcgcccagaacaggaggcagaggcaagtgagggagtgtgtggaagaggagggacgtcaacataatgcatcaccctatgaacatgatatttcacaggaggataaagaaaataggggggggcgctgatgaattggttggggcaaatgtatagtaaaagagagtgaagcatgcgaagagagctgtgccattgatgagtggcgattcgtgctcggtgttcactacaatccattggtctctatacattggctcgagcgaaggcgtcctaaagactaagtctttccccaagggcgacgcaccaaactaaaccggagacgaaggggtcggttgcccgtaaccgactttgcttccaggggtgggacaatagtgttggatagggaacttggggcctcgggataataagggaaaattcccccaattccaaccaaagaacggttaggggctataacccaattttggtcggtgctaccaggttaggccctatgggggggtaaacctcccgaaaaatacttaacttatggggttgggcaacccagccaacaggacaaatttttccccccggggaaaggcaaaccccaagttcctgggacagagccagggtcctatagttgttgccccgagaagggtgcggaacacgccttcttggggaaaaggggccgccgaatacttggggacgcccaaattccgggggtggcgcttcaaaatatactcgtccgctgggggcttaaatacgcaaacccccattttttcccccccccgtttgccgccaca

SEQ ID NO: 549778 - DNA, 167 bp, Homo sapiens
cgtgagctagtctgagcgcgcaaacttccagcggcagccgtcccagttgcagtggtagggcttctcacctgtgtgcgtgcgcagatgcgccttcagatgcgatctcttggtgtaggtcttgccgcaggtcgcgtagctacaggtgttagtggtggtgcgtttgcggg

SEQ ID NO: 549779 - DNA, 355 bp, Homo sapiens
ggacgcgttgggtcgacccacgcgtcgcggacgcgtgggagcacatattgagatatagtaattctagggtaacaaccgtatgagtagtacagcggggaaagaccgcagccgcttagaccactattacgggaccagcctattgtatcaagcacaaaccctgagctatcgcgttgagcataggtggcccctcgtagaagagtacttcgtagattcgaccgtacgcatactttgccgttcgtttctacaactcgattcaagaagcttgatagatacgggcgataccgctctgccaatctacgtagaaggagaacaaaaatttttgtcagtgatgacattatcgggacttcaaggcaaa

SEQ ID NO: 549780 - DNA, 165 bp, Homo sapiens
gatgtgtagtatcactcatagattcaggtgtcttcagctgaatctcatgtctcagtacgaaaaactgaatcacatgctatgtaaggaacgtgctattcacccagtacaccaaaaaagcaatggataatgctgtgcattttgcctttctgacatttccttggaata

SEQ ID NO: 549781 - DNA, 220 bp, Homo sapiens
gagctcgagaacagcctggccaacgtggtgaaaccttgtttcccctaaagatataaaaaattaactgggcatggtggcgggtggcgggggcctgtaatcccagctacttgggaggctgaggcaaaaaaatcgcttgaacctgggagggggaggttgcaaagtgaacaaagatcacgccgttgcactccagcctgggcagcaagaatgaaactccatttca

SEQ ID NO: 549782 - DNA, 445 bp, Homo sapiens
  misc_feature (6)..(6): n is a, c, g, or t
  misc_feature (11)..(11): n is a, c, g, or t
  misc_feature (35)..(35): n is a, c, g, or t
  misc_feature (61)..(61): n is a, c, g, or t
  misc_feature (428)..(429): n is a, c, g, or t
gcccanggaancccccacccaaaacaaaatatatnccccaagttagttagcctggatgccntggggtgccagccgggtgaatccagaaccagaaagacccccatcccagcccaaattccacctcatcctttttccatgtcccagaaaagccctgaagggaaatgcccaaggtgtcaatgtaagcacatgcaatcataaattaaagctttgttatattcaaataaagtaatacaacatttattacttgcttgggaaacagcttgggaagcagccacattgaaatttcttgtagccatgaaaataatacaagttgcttgtggataacaaaattcacacagaaaccatttctgagatatcttatatttgatgtatttatgcattcatttaagtcacatattacctctttttaatggaattccaagtacaanntaattctcctgtatag

SEQ ID NO: 549783 - DNA, 842 bp, Homo sapiens
  misc_feature (106)..(106): n is a, c, g, or t
  misc_feature (235)..(235): n is a, c, g, or t
actttttaaagatcttcagctattctcttgtatcatgcatcatcactaaaaaatgccatccgtctcgtgccactgcactccagcctgggcaatagagtgagactcntgtctcaaaaaaaaaaaaaaaaattctcatctcgggggtcatctcccaccgtgccttaatttggcaatttgtgggtattctcacaaaccctatagaatttttaattctctaaaattaatctcggcgggngttggactacattaaagagttgggtgttccgatgtgagttaaaacacaaggcgggagaagtttcgggctcaaaattatttattctcaacaatggccgtggtttttaaaaaaagtgcattcaggtaacatcaaggtacaaaaatacctacattatttattttaaatcattctctcttttggaaagtatgggcaaccttttctacgtgggtaactcttatttcctaataccctttctcaggatataaatcgggtgtttcctgggccaatctctattggtgaacgcagttatgtacaggcaacaacgggaagatggacaaaggagcaccagagattcttctggtggcaaataaattccatatgaggatagagtggggatgggggaaacgacatcacgtgggaggtgccacgaattaaaactttgggggggaaccgtgtgagtcacattacgtgtgtaccggtatgggcttcttatttacggttccagaacccggtcttctggagagcctgaaaaactctttattgtagtacttaacccattttctaatacagcctgaataccctgtgggggataaggggcaccccttgggaggaagaggttttgaccacg

SEQ ID NO: 549784 - DNA, 115 bp, Homo sapiens
aagcatgtgtgttgagagcttttcagactatcacctttgggtcgctttgctgttcgtgatagtgagacagcacagttgcggtgggtcagagcataagggtgggtcagaacataag

SEQ ID NO: 549785 - DNA, 1153 bp, Homo sapiens
cttcacagcacaggtatcaaggacttagacttctggctgtctgaggtggaggccctgctgggttacgaagattatggcaaagacctggcttctgtgaacaacctgctgagaaagcatcaagctgctggaatgcagatatatctgcccatgaggatcgcctgataggacctgatacagacgcaggcagatcagccattgatgaccagcggagtgccttcgacacctcccaagtacaaggacaagagggacaccatcaacgggtcgcttccagaagatcaagagcatggcggcctcccggcgagccaagctgaatgaatcccaatcgcctgctaccagttcttccgggacatggatgacgaggagtcctggatcaaggagaagaagctgctggtgggctcagaggactacgagccgggacactaactggcgtgcagaacctgaggaacgaagcacaagcggctggaagcagaactggctgcgcatgaggccggctattcagggtgtcctggacactggacaagaagctgtacgcgatgagcaacaggcagtcgggaaagaggacgatacagcagaggctgggcggcacgtttggtggagcactggaaagaggctgaagcaggctggcagctgacccggagagtaagacggctggaagaagtccatggggaaatatcagcagatttgtagcccaatgttggacggaggcacgaaggcctggatcaggtgagaaagatgaacgctggtgggcagcgaagattactggagaaactcttgaccggccataccaaggggttaactgaaagaacaccatgaaagcatttagaagaacagaattacacacgatcaacaaaggattcgagatgcactgaatgttcttgcaccaaatggaacaatgacctcataaagaagaacaatcacaccaaggaaggaagaaacaatcaacctgcaaaaggattcgaggggccctgaaacggggaaacgagagaccacaccataggagaaaagctggcagcacagaagaaaacgagaacaagagagaaagaaacagaacaacaaacacatacaaaaagaaaagcagaaagcagaaaaccagaacggaagaacgaggaaacaagcgagcaacaacagcaaaggacagagaacccgcagaacg

SEQ ID NO: 549786 - DNA, 435 bp, Homo sapiens
tggtaacacacaaatatggggcagcatgcttataggactacaaaatagatcaaggaacttacagctatagaagagagaaatacctatgggctgctgacaagagcagtagatgtgcccacgagtacggatgtgtgttgtccttgggttagccactgtaggtttataacctggtaggaacttttcataggaagggccaaaaattcaagatgctcattagcaagtcgtcttctagggtgttgcctgaacctaggctgcagtagaagtggggctatggaggtaggcgatattgaaatcccaggttaatgctaatctccatctcagcatccaggcacactgcagaccagcttccttttgggccctgccggtccttagttcctctgtgctggctcttacatttctgatcacgctactggtgccaagctaaatccgccgcct

SEQ ID NO: 549787 - DNA, 801 bp, Homo sapiens
  misc_feature (597)..(597): n is a, c, g, or t
  misc_feature (672)..(672): n is a, c, g, or t
  misc_feature (694)..(694): n is a, c, g, or t
cagatctgtggggggggggagcttgttcttaggatgactccgaaggctcattgacataaatgctgacatgtacgtgcacatagccatataccccaagatatgcatagtgcgggtgtgatcatgcacacacacactctctatctagggtctatggctatctgtaactgtgtgtgacggtagtcatagagacactcgacacattagggtcctatgacaagctaagttgccacctatgatggcgggaccagatcgtctacatcacaagctcacgactctacagggtgcgaactggagggagcaaaacactggacagatactgaccagttcgtttgatactagatacacctgaagatagacatctgggaaacaatcttttgaaaacctcgacaccttagaggtaaacactcactgacacaaggggcacaagctcaatgcctatattggggagcgtatatgcatgtaggagatctattactgtttgaaacgcttcagatatgtgctggatatatatctactcatccaagagtacgtctgagctattatgactgacatagatgtatcacatctgcagcactatggaaatgatgagaatagttnctacctgtatggggagaatgttatatgaaatctaccctgcatacactttcccaaacagtgcatagctggtagccnataatacgaggcgcccacagcntcgggggcatcaattatgtctcctcaggagtgctcttcaacgggacgccgtgaagaacactggagctctacaggaactgataatgcggggcttctcatcacgacggg

SEQ ID NO: 549788 - DNA, 149 bp, Homo sapiens
cttatggatgctcgtcatgggatattgcatcccgatcccatcagatgggtcacgggtaccgcgctgctggtagggtagacacgctgagcagtcagtgtagcggcgtgagccggacatctagggcatacagactgttattgtcatctcgg

SEQ ID NO: 549789 - DNA, 313 bp, Homo sapiens
cgggaggatagttgaaccctggaggcggagatagaggtgagctgagttcgtgccatagcactccaggctgggtgacagagtgagagtctgtctctacaaaaaaaaataaaataaaagagtaaattaaggaatgtgaaattctggaccaccttgtgggtttaggagtatatttccgaaaagatatttggaaatgcgtattggaggaaatacaaaaaaagctagggaaaattacgacaaatttgcataatggaacaatataaaatggggtatataaactataacatacaaactaaaaccaagattccagacatgg

SEQ ID NO: 549790 - DNA, 845 bp, Homo sapiens
gatgtaagcaaaagtcattatttttcctattcatttgaaataagttatggcttaaaatgctttggagtttatttctcaaaattaaaatctggtcacatgagctttagtttgttttctggtttaaaaaataaaaaggtttctcttaacagtatttccagtgacaatgcaaggtaagtatatcaaaggaaatcaacagttgtgcttgggggcttttcgttatgggatattgatttcttgttcctttttccgtaacattgtctgctgcaatttaaataaaaattacgacattttaacggatatttcatagacaaaccaaacaaaaatatatgtttcttactttaaaagtgaatgtttcttctcttcagctgatctacaaaactgaaagcaagatatcttatgttacgaactatttcgacacactattctcttacagtgagctttcccatgttcttcactgtcttaagtcttctctcgctgcgtctatgtaggtggcaccaagaactttcactcacttgtcactggtgcctcagactttttgaaagtctacctttctaaaatttgccccgacgatctagattctacatgtaccatggggtttattctgtgtgcttttctgtattttaaaacttgtggctgtactaagcaaattgccaggttataactctcagcctacatagtagttcaccgcccactcctgactgccttatcgactccattggggtaactacgctgttcctagttcattcctcagcgaaatgcgtctgtcgacaccacgttaatacagcctgagagaccaccactaagtccggttgtttaaactcaccacatctcaaccccacaacacc

SEQ ID NO: 549791 - DNA, 912 bp, Homo sapiens
  misc_feature (912)..(912): n is a, c, g, or t
gggaaaccgcctactttggtgtggtgtcaccttgagctgtgcacataggacaccagtttgatttaacctaacaggcagtttttatctctagctttttcaagccaggtattgagcagtttcttggccaatggcctgagaaaccaccgtgtccctgtcaaggggtgatttatgggtttcaagtggggaagtaatcccatgtacttatttcttaaatacctaggaagttcttctggtggctcctcttggccctcccctctttctcccccaaaccaccatcctgcaaggacaagggaatggcctctccctccaagaggcaagggttgcagagggagcactgtggttgccatcccagttcctcttcaaaagccaaacagacactgctgtgactcaaatcttacagtatggagggtggagttgattgaaattccaggtgctgagtttgatagtggatttcaatgtagttgtcacaggtatgaatcatgtatataactgtaggaggcaagcaagttttattttttaaaaagttgggagaatcacttataaggtttctgtgaagcaaagtggtaattactccataacatacaggaaaagaatgtgttttcaaaaatccagctttgtctttaccctctggtacacttcagatttaattacctaataaaattatgaggggttttaaccattagttattaacttgccagtttattacttgataaaatatggagaacgaccaaaaatggattcgacgttccaaaatgggtttggccttttacggttccccaacatgcaacttggacaatttggatccattgtttgcatgagaagtttatattcaaagcgcgacaggcgtagggacatatggggggttcgccgacggtcctttggacaacagcggtggcggacacatatccggtn

SEQ ID NO: 549792 - DNA, 103 bp, Homo sapiens
tatcgtgcagaagcatccactcctctgtgcagaagcatcactaatctgtgcagaagatcaccttattgtgctgaagatcaccttatctgtgcagaagatcacc

SEQ ID NO: 549793 - DNA, 857 bp, Homo sapiens
agaagcagtagcgagaaagcaattcatgccggatgttactggattaatgcgaacccccgttgtaagccccttctttccacctctagagggccaaagccgcggtctaaaagtgaaggagctcccaacagtgggtggcgccccccgttggggttccccccccggttgggccccacccaggcagggggggcacacgccccccaagtgcgcccggacagggttaccccacaccggcacgggctgggccgcaccttttgggacgtgcccttttgcacatttggcaggaacaccccccgctgatgtagcagtacgcccgcccaaaggggtaaccccgggagggttctgcaagccaaactgggccggggttaaccatcttccgcaaggcatccctgttaataaagcgcgaagggcgacctggccaacagtcaaacaaggcgaccgccccccagaggggatacacagcccgctccctccaggaggtgatggagtatcaccctctcctccagggccgagacacttgacgggcacaccccgagaaaaaaaaaaccacgcgccgtgtacggtgaaggatcacctcgacgacgcgtcgccggcaagtcacgagggcagctccgcgggacgatccccccaaaaaggagcacacgtgtgcgtagaacccggcacggagacacagcatatctgcaaggggaaacgggccaaaactcatacttgtaggggcccccagggctcaaccatggagctcccgccgggctggaaggagtgagaggaagggtgccccatacgcctgacggcgtgccgccccgagcccgagggcgagagtgcgcccatcctgattaaaaataatatttcccccaacatgt

SEQ ID NO: 549794 - DNA, 889 bp, Homo sapiens
tccttgtttccccccctttggttgtcccgccgttcctggaagggtttggactttacgtctgtcgaggttcaattctatcccgtttagaccagtgttttgccaccattgcacctgttgtggtcaggcacacaagacctcctggacctgctcttggagaattccaaggacctttgttccgatgcttttttccggcatgtgccacccccgacatggcccttttgactatcctgaggcatcaccattgatcttggagccatcccacagaagattgagggccagctctttacctcggaggaggaaacacctggcagagactgtgaagagattctgacattccctctgagaccacccccctgagcttccctgagagcaagtgctgagcagagccctggaaaatcagtcccggcccttgaatatgccccctcctgtgccagtgtcccaccaaatcgttttcccgagcctgcagcctgtcatgccaggagttggcattaccttggtgtccttactaaggaagatggagagaaggaaacgtggaaggtgagtaataaatttcaccttgaagcccaccaccaagaagatgaaaggcagcccaagaagacagcccgcctggggaacagaatgatcaaggagagactggttccttgccaggacagccagagaaagaggcttcagcctcccccgaccctgcccagaagagcttcatctgtaaggcctgcgaccaaagcttccctttctactgccgccttaaggtgcacatgaagcgctgccgggtggctaagagccaacaggtgcagtgtaaggagtgcagtgagacccaggattccaagaaagagctggaccaacatcagctggaggcccctggtgcaggtggagagcccgatgcccccca

SEQ ID NO: 549795 - DNA, 1592 bp, Homo sapiens
gcactcagggaaccggaggccagccctcaactcactcttcagcttccctgctgtgttgcagcccagccagctccatacatgtcctatacagatgcattgacacagatagctgaaattcaaaggaggcaatattcatcactgaatcagacaagcacacacgagatagcctatcccaaagcattcaacccataaaaagaccaagcagcacgcgcagaacagatcccataaccgaagacaccatgcgagcaaccaaccaatccccaacacaaactagcacgcaacgagtccacgcgcaacaacgaataccatgggagaaaaaacacccgaaggcaccaactgcacaggaagcccgtaggcacaaatgccccacaacgcaaaaaacctcagaagcatcccagcaacccaacagctctgaccaatggcccattaacatacactagcgagacgccccactatatcacaacagcaacccaacagaggcaccctaagagcaccaaccacgtaacgtgaagagcgaacgctaagaggaacagacaaggacgcacgatggcgataagctcacaccaacaggcaccaacggggcacagcgccacaacagcgacctccacatccgactagagcgatagcctagaaaacataccagcgccacacaggctaaattaaagcaaaaccaccaagggagatagaagacagaagtaataggaccaacgtaaccggcaacaagccacaagcatggcgacaaaacccacccatgagaatagacgacacggagcccccacacgcaacaagcaactcacccccaacacaggagaccatggccaattccaaaacactaacagcaaacagacattacaagaggcacgaacagaccgacgaattccacttgatccctacctccctggcacacatggcagagagacatcgatacaaaagaaagaccacaagccccagtcggacgcactcacgcgaaacaggacccacggacccacgacccaaccacctcgagcatacaccacaactcacaacacacacccccagctgtgcaccaaaacactcccatccccaggaacccctggcaactcaccccaacaccaataccaggaacacaacaaacacggcccacacacggagaacacggatccacaaagcacatggaaagccacaatcccgctacccacaaccacacaagaaaccgtacaggcacgacaacatgacccgcaccagacaatacggccaactgccctagaccagaacagaaacacgcagagagacaagacagagacacatacacaagacaaaaacgcaagcaacagacacatgggcccaaaccctgcacacaagccacacaaagcagaccaaacgcagtattacaagaacctagcacagcaggtgaactccaaccacaagccacaccgtctagaaacagacgacagcaatgacacacagctacaggggcacagcaaccgagcacacaaacacaaacgacaccgacaacaacacacagtaccggccagcacaccaccacacagcaagacacacacacacaaccacgacggcggcgagcccacagaagagcaagcagcagcagcaat

SEQ ID NO: 549796 - DNA, 469 bp, Homo sapiens
  misc_feature (299)..(299): n is a, c, g, or t
aggcaggcgccatctcctcctccccagctcctcccctagggcacagataccgatagtcaagctccatctcctcctcaccagctcctcccctagtgcacagatacgcatagcaaggctccatctcctcggccccagctccatccctagtgcacagatacccatagcaaggctccatctcctcagcaccagctctaccccaagtacacagatagccaaaggcaatcttcacctccccagctcctcccctagtgcacagatacactataggcagggtccatctcctcctccccagctcctcncctagtgcacagatacctataggcaggcttcatctcctcctccccagctcctcccctagtgcacagatatctataggcaggctccatctcctcctccccagctcctcccactagtgcacagataccatataggcaggcttcatctcctcctccccaagcattgatgcact

SEQ ID NO: 549797 - DNA, 456 bp, Homo sapiens
  misc_feature (3)..(3): n is a, c, g, or t
  misc_feature (46)..(46): n is a, c, g, or t
  misc_feature (67)..(67): n is a, c, g, or t
  misc_feature (75)..(75): n is a, c, g, or t
aancggcatcgctcccttggggtgccatgggggggccccgggccanagtggaacgtgtctgcgaagncgggcccnggttctgccagcggacccccagttaccctgtgggtgggtgggtgtgacagcaggagcattgccatcttggacaaacatggccattttaagttctccgtgattaaaaaccagcccaaaacattcagcctaatggctcatgtcagtatgagcagaaacatttcaaccatgagataaacccccatctgaccagaaacatgccaatcctgagaataacctcccctccagccagagatattccaactctgcaataaaactctccttcacacagaaacattcgcagctgcggtaggctcccccttcctaaacccttaaatgcccttagtctgtaagagaatgtccctgaccgaaatcggccagaagcccctctcaggtttattccca

SEQ ID NO: 549798 - DNA, 223 bp, Homo sapiens
gcccttgcacttacagtagccactggctgcacatggccccttgagcacttggagtatggctagtccacattgagatgtgctgtaagtataaagcatacacaaggtttcaaagacttagtacaaaacaaagaatagaaaagagcagtaactttttatgttgattacatgttcagatggtatattttggatatattgggttaaataaaacatgttattaaaatta

SEQ ID NO: 549799 - DNA, 663 bp, Homo sapiens
ggagagagacagcgcgcgcgaggcggagaccgtggaggagaggagctgcggagaggggttaggcggagagagagagagagagacagcagcctccgagttggttgagggggcactcagtgggtgccaagctagtggcccttgagaacccacaggagacccgcagcccgcagcagtgtcgccagtgagccgtggtcccaaatgcacctgaggctcatctcactggatgacggctaggagccgcaccgcctaccccttagcacaacgatctgcctgtgtatccccgtaccccccaccgatgtccagcggggacgctcggaccgcgtgtgctcctttgcgctgagacctcaggccaggacctcgcatcccccccccacgtccatcgtcgcttactccactaacgtcgcgtgggtgctccccttcgcgtgcctctcgcacacatgtttcccatactgtatccttgtgcgcgaccacgaacccggcgtcttgggctcggatgcactgcggactctagtggcgcttccactctgacggcggatagcacttgctacccgtcatacaacgttccatataatttgcattccacgttctgctcccaagtctccctctttctttgtttgtcatgacagcatctgttgtcaactgtctcacgcatccttggtgacc

SEQ ID NO: 549800 - DNA, 251 bp, Homo sapiens
cgcgttacagatcccggcacatctgacccagactgacgtggatggactccgactgggcctgcgaggtgcatgcctcccctccactccggagcggctcggagacctcccaggtctcagttcctgggcctcacttagtgaagaggcttcaggctgtgtgcttggagccaccgtcgaacagcatgggagcgaagtgcaacagtgaaacttgacgtggtgagcctgcacgcagctactggtgtgagctcttggct

SEQ ID NO: 549801 - DNA, 148 bp, Homo sapiens
aaactggaatctggaggctgtatgagtagaagacgatgacattcagaataggacaatagagaattgaagtgtgtatggtgaatctagaatggtgtatgtcttcagagctatcacatctagagacctgaaagaagaggattaggtgatc

SEQ ID NO: 549802 - DNA, 138 bp, Homo sapiens
cgagctggcagagctgggccatggaaccggtagagacctggacccccgtgaaaggtggcaacttggctgagaggtcttgacgactccctgcaggactatccctttgatggactggcagctgcctggcaagaacctgct

SEQ ID NO: 549803 - DNA, 635 bp, Homo sapiens
tggggagacggggttcaggctcagctcagccaggctccctctttccgtctcagccgggggccggggccgccgtctcatctgaggcctcaggggggctcggtctcagccgggggcgggggccaccgtctcatctgaggcctcacgggacaggatcctcccaggctccctccaggcggcaggggcctccccaggggcggcgggcatccttagcacagggagcggggggtcagagagccacacccaggcagaagccgccctcggggagtccgggggtgagggcagagccaggtgaggatgtgcacatccagaggggcctggtcagcatctttaaatggcgagtgaagtcggcccgggacggcttcgaaaacggcctctgaactggtcggacaagtacatacggtcggttgcaggggaaccaacatctcagagatcccacacaaggcttcctctttagagaagaaaaacacagcaaaacaacacaggcagcctcggtttaaaggcacggggcccccgaacccggcctgaaagcctcggcacggggccttcatctggaagcctctgtattaaagacatgtgggcctcctccatctggaagctttgtattaaacacactgagacccgtctcccaggtacga

SEQ ID NO: 549804 - DNA, 274 bp, Homo sapiens
caagcatttgctggtcagtactcgtaatctagtctaacaagtacaacaagattcttaaggaaggctatgcactaaaatcatcaaaacatcagtaccatcaaagtatgcagaagacacactgtgcatcgaagggtatatcacaatcatacacctcctttaagaaaacagaagtcactactcagcaaaaccatgatagctgcttcctctccattatatctgtctgttcatactttcatacaatggtccattcactatgaattcttatcttttcatt

SEQ ID NO: 549805 - DNA, 431 bp, Homo sapiens
acgcgcacgagcggtcaaaggtgagaaggtgtaacggagtatattggcgtgagatcccagcacaatatacgatagggtataagtatgtaaaactagacatagagagctcaaaatgattgtaggaagcctctaggatagaatacgcactcaaaattctacatggtgccgtattattcagccagtagtagaagtaaaatagaatataatttaaaaaatacaaaaataggcagagaattagaaaaagaattaaggatagataagagaaacagaatacagagcacgatgattgttacaaacccaaatatatcatttattacaaacaacgttaatggcccaaatacttcagtaaaaaaacacagaagaaagccaggcgtgggggctgggtactgtaatgccagcactttgaaccggcggagcagcgtggaacccga

SEQ ID NO: 549806 - DNA, 295 bp, Homo sapiens
aattagggacctcgtgattacttacggccggtacctagcacccttcagatacaaaatggggtgggtttctgggcgtgggggcgcatgtcgtagtctcagctactacagcggcggaggtgcaaagcttgagcacaggagttccaaggccagccgggccaacctagtgagaccggacctgtctgaaacatacaaccccacccctaccccccaccaaacacagggactggtgcttcctggtcccttaccggagaccaacgacgaccaaacggacgacaacgtaccgttcgcgttttcc

SEQ ID NO: 549807 - DNA, 845 bp, Homo sapiens
tatgatgttaaaatcagcaactctttatacgttaaaaacttgaaacctgtggccgggcatggtggctcgcgcctgtaatcccagcacttgggaggccaaggcaggtggatcacctgacgtcaggagctcaagaccagcctgaccaacatggtgaaaccccgtctctactaaaaatacaaaaattagctgggcatggtggcgcatgcctataatcccagctactcggaggctgaggcaggataatcgcttgaaaccgggagacagaggtgtggtgagccgagatcacgccattgcactccagccggggcaacaagagcaaaactccatctccaaaaaaaaaaaacaccacaaagagaaaagggaaaaacacacaacacaaaaaacaaccacttgtggcgacccgagggacacaattgtgggccctgggtgggcgccaaaataggggtagtggtctctggagggtggggaaacttacccttaaccttcaatctactgggtgggaacaacctggacccacagaggggattggaaccccatggaaaaaagagggctggcgaccaggttggcatttcaataagaccccgggacttaccacaggaagatacggcccaccaaatgaatcctgtaaaaggatcctaaggaggctgcgtgcaaaaggcaggacttgtggccagaagtgaaccgcagaggcatggcagacccaacagaaaaggtgacaggcataatcaggcggagtgcagggcctaacacactatcggacaattggcctcactcaacaaggacaataacggcgaatcaacaaccacaacggagatcccggaacgcagggacgcgccacagaaccg

SEQ ID NO: 549808 - DNA, 195 bp, Homo sapiens
  misc_feature (87)..(88): n is a, c, g, or t
  misc_feature (91)..(91): n is a, c, g, or t
  misc_feature (99)..(99): n is a, c, g, or t
caacaatggcggcgccgaggaggtcgctgaggaggcggaagactgggtactcggatccggagcctgagtcgccgcccgcgccggggnntgngccccagngcatctccggcccatctccacacgggcaccttctggctgacccggatcgtgctcctgaaggccctagcttcgtgtacttcgtggcattcctgtgtt

SEQ ID NO: 549809 - DNA, 108 bp, Homo sapiens
acacacaattttgatcccttacattggtgctgaaggcaaccagcatagttctgatgcctgggggcgttaacaaaggcgagagggtacgtggttgctgcagctggaagg

SEQ ID NO: 549810 - DNA, 475 bp, Homo sapiens
ttaaatggagacacactaaaaatatttattcccattcaggggaggatattgaatttgaatgtaaatatggatatcataaagcaagaggatcaccgccatttcgtacaaagtgcattagtggcaccatcaattatcccatttgtgaataaaattgtaatacatttattaattgattttattgtttagaaatgcacaagcatgtcactaatatactttcaatttgcatttgaaatattgtttaactcatgtcttctcataaatataaacatttttttatatagtgattaatttttaactttaaagatgattgccaaaatgcaaatgcagtacattcaaaactcctaatccaaaccattatatgtccaaggacaaactcaaacaagaaaatttgatgtatgtttttcagcattgtttttctattcagaacttcctcagattttcctagatatcttttgatgtaatgttttgctggatt

SEQ ID NO: 549811 - DNA, 301 bp, Homo sapiens
ggggggggaaaatgtcccccccgggggtttccaaaaaaaacccctttcctcccccccattgggggtggcccccttcccctttggggggggggggggtttttggggggggggtttaaacccccccccccccttttttttgggggggaaaacccctttgggcccgcccccggggttttttccccgatttttgaaaacggttttagggggtttccccccccccccgggggccgggttttttttggggaaactgggtttttcccctttttccctcccggttttttaagggggggggggcccttta

SEQ ID NO: 549812 - DNA, 228 bp, Homo sapiens
gatgatctcgatatgcctcgcacttggtcttggcattgagggacatgctgaagagctcaagtggtggtgtagtttgaatgtaatagtaggcggcgatcatgcctaggttcagagggcgccccgttccatctcgtccttcgatgcttgatgccacttgtgacttgctccagtgtcacctcagtggtcttgctcacaccatgctcttgacaaagttggtccctgacaatg

SEQ ID NO: 549813 - DNA, 362 bp, Homo sapiens
  misc_feature (33)..(33): n is a, c, g, or t
  misc_feature (35)..(35): n is a, c, g, or t
  misc_feature (121)..(121): n is a, c, g, or t
  misc_feature (167)..(167): n is a, c, g, or t
  misc_feature (170)..(170): n is a, c, g, or t
  misc_feature (174)..(174): n is a, c, g, or t
  misc_feature (279)..(279): n is a, c, g, or t
tcactctgtcacccaggctggagcgcagtggcncntcatcggctcgctgcgacctcagccttccgagtagctgggactacatctcaaaaaaaaagagccagacacaaaaggttgcatggcntgcattagaggcccatctatgaagaaaggaggtcaggggttgccangtntggngggatgggatgggcgtcgggtctccttcggtggtagtgggtgatgaaaaagttctggaaccagatagaggtggcatccacacaaccttgtgaaatgtcctgagcngcatagaagtacacaccttgaaattgtgaatttctttctttttttttttttgaaggcagtctcactctgccaccccaggctgg

SEQ ID NO: 549814 - DNA, 427 bp, Homo sapiens
ggtcgaccctacccagaaagtctcctagtggtgaggaggtaaatagtttgatgtatagtcttctggtttcctcttttgcatttataaacacactattttaaaaatataaatgtggctatgctgtgtatagtatattagctactaacttttttcttatattcaatgctattttatgtatatctacctcattattttttaacaggcatatactatttaatagtatgaaaatatatagtttattttagcttttctactggtggacatttagctggcttctaatttttctttatttagaggtgctgcaatcttgtcagattcatctttctgaatgaatatgtgtgagcatttctattaggatacatacctagaagtgaagtcactaagtcaaaaggagttatttgcaatacaaattttgttaaatactgtc

SEQ ID NO: 549815 - DNA, 1352 bp, Homo sapiens
  misc_feature (468)..(468): n is a, c, g, or t
ggtggagtattagctggagccagggataccagtggacgtggagcagaaccattctgagctaccagctccgcaattaggggcatcgaaagagcggtctcgccggaggatgatagaaagaggaggaggcttagggataggaatgcgatcgagaaacaaaatggtactcgagaacgcggtcgactatcgaggaagatacgaaatgactgtggtggatgggagcggatgatgacgaagaataggctgatgtgagagttattgagcagagtatgtggtgaaaaaggaagaaggaatgagcgaggggagacgcatctggtatgggaccaggcgtacagctgtaagtatacaagtgagtccgtcacagtttgaacctgcggaatcactactatacataattcgatgcacaattgcaggatttcatacgcttttccgaagactagatccgaaagaacggtttcatgagaaatccgnagactggcacacattaagattgttagctaatcgactatgcaggagactgccacggtggatggccgatcgaggccagtacctctgctagcaactcattcgggatgtgcagacttgaatgcgggggtgacagacgcgttcatcggctttgcctcggacacgtatacactactggatgttgttccatagactgtggtcgatttggctgtcaggcaattaaccaagaatagtgtgaacacccctcgcatgaaggaagttgaacgaggggagctggagaggggctgcatccgagtcggctcttgggtgggaattggggccgaggtgggcaggccctgtgctgggacccgaaaatctggggcggcccggagtgaggcctccgggaaacagcggcggaaggcatcggaggtcctggcacacgccgcgcatttggggcaacatctgcgagtgcgcgaccaaagatctcagcagcggaccacggggcctatcactcgtccctcacacagctgaagcgactattgttgcacaaagtcctatcgaagcggccagatcggtcaagaagcgaaaggcgcgaaacatcatacaaagatgaaaccataacgagaaaacacctcctgtacttgttgtccctcgcgcccccgccctcgtctgccctccattcaaagagcgaggcgagcgcgaagagaggggacacagccgggacaaagaccacggacgacacgaagacaggagagaccgaacaggaccgaaagccacgagcgcagacagaagcagacagaccaacacacgggcacgcgccagcagacagccacggcgaaagacacaccgaaacacgcaccaaagcgccgcgagcgacgacagcaagcgccagaccacgacacgcgacagcc

SEQ ID NO: 549816 - DNA, 314 bp, Homo sapiens
cgtccatcccccttcgtatgatagaggtggtattgactgacttgtattaatatagtgtcaatgctattgataattgtcgattgtatgttaatccatagaacatggcctgctgccaacacccaggacacccaatagatggtctttgctgcttgattatcctcatccccagtctcaatgggacaccacgaccatgacaacagccacttcccatcaggactcactgcctagtcaccaagctggcatggatgggatataataacctcgatagaagttggcacaaaggagttatgggacaaacggtccaatatatgcat

SEQ ID NO: 549817 - DNA, 104 bp, Homo sapiens
ctagtatgcactgtcatgtctccgacgtgtgataagaaacttttcccgccactgatgaagttccccagcacatcaccagcacccccaactatagggtttgatga

SEQ ID NO: 549818 - DNA, 445 bp, Homo sapiens
  misc_feature (81)..(81): n is a, c, g, or t
  misc_feature (141)..(142): n is a, c, g, or t
  misc_feature (146)..(146): n is a, c, g, or t
  misc_feature (150)..(150): n is a, c, g, or t
  misc_feature (171)..(171): n is a, c, g, or t
cttttaacatgtcatcgtggaagtccctttcacctcccaggctgaggcacagatccattttcccacagatctgattcttangctagggtagggagcaaagccttgtcttgtgtatcgaaagttatcttgctgctgtgctgnnttcnctgntggtgtgcacagcatgagctntcaattatacactaattatatggctgacttcattatctcccttctgaaaatatgcagtctgtcccaaacaattagcactgaattatttccctatattgtttcctaatttttccatatgttggtttttactcttcagccagactacacacctccggaaggcagagacggggacttgaagttctttgaactcaaaacatggcaatatttattggtcctaatactgtcactggcaaggttggtgttttagggaagagatgatagtgtaagtgtcaac

SEQ ID NO: 549819 - DNA, 348 bp, Homo sapiens
ctaacactacactaatgtacatcaggagaaagatatgtttggaaaacccatcattgctacagccaaagactgttatacatccgtctgtccctttccgatgtacttaactatgaagcttgtaccggtgtgtgcaaagtaaaaggatatggcataggccaaggttttcaatgcatatgtgtggtttggcataagctcctgctgtctgcatgaagaaagtatgctccaggtagctgtggctgctgtcagaataagtgaccacagagcagaattaaacctgacctgtggtctagattgcaaactggtccagacccatgtgtagctaagtccatcttagctgcaggtcgacgc

SEQ ID NO: 549820 - DNA, 227 bp, Homo sapiens
tgattacccgaatttcgagctccgtaccctgcaaggagatctgcgacacctccgctccttcatgaccgtccactgtgcttcgggcgtccttgtcacttgcttcctcacgttgaattttatgagcttcgagagcctgatttctccccgacccctcctaacacggctcctggcaggctgaggtgtcgcaaaactccttgcagggtaccgagctcagaaattcgtcaatc

SEQ ID NO: 549821 - DNA, 340 bp, Homo sapiens
aatcaccatgtcaaggagagaatggtgcaggatggccgaatagttctcaccagtgatggaccttctataaaaacatctattcgaataactatccacaaaaaggacttcacaggagctatgaaaaccaggtgataaatcacaatacctggttatagcataatacgaaaagaggccaggcatgatggctcatacctgaaatcctaatgctttgggaggatgaggtgtaaagatcacttggcaccacgagttcaagaccatcctggtcaacatagcaagaccctatcgctacaaactagaaaaaatatcttcaaggaaagagaataatcatgtggcccgacta

SEQ ID NO: 549822 - DNA, 1225 bp, Homo sapiens
gaacgaactttgtggcaccggaggatcggaggtgtggaactgaacatagggaggggtttggaagtgtcagcattctattgcagtcagcacgcaggtttgcctgactttaggtactggagcccaaggcctcggtggcccgacagtgtgtgggctcatagagacaggacgtcgatgccctggctggctagggaagactattcatataattagtacgaagacgcgggacatgtcgctggacttgtagcggatagatttcacatattacacacaaggcacgagacgatggctatcgcttgatataaggcccctgggtacacaacgcgagccccatggggacctggacgtaataggctgtggtgtgatgtgaggtacccgaatactatactacattggtgcgctacatcttcactgtggaacgatgtccctgctctgtaaacatacaagggcggggaaatcctcatatctgccttctacgtgcatgggagggcccttatcaggtgccatagcgagacctacatgtcacgcaggcaaggcgcgatatgtacgaacatgcgttcgcaacatagtggcacccatactgggcgccccctattacgagattcttggaatatgcgccacacggcacaagatctcacaaaggtttcacaggctcacgccaatgccacgtaagcatgcgccactccatgtgtgattaaaaaaatcccattctcctaaatgtacgcaatcaggtacagtgccttcagttcaaaacgcacctccatacctattccgagagttgcgatacacatgtgagctttcgcagttcctactggtacattcacaagtgtgactaggtaaagttggtctcaccatggtatatatagctaaaagtgacgggagccaatggggtgaaacatgttgcacccttctcatgcaccgatactactatgagggggagcaaaaactaatccacagacgattacagtacgcacgagggaaaaatgtgaacattcccaagttacattagccgaagataccgatcagcatatgcgggcatgttacccctagtgagctgcgatggtccgatttggtaggggggtggagttgcgaaacaaaggacagattcgaaacaacttgcggttggcatatcaaaccaatgcaaggttggtgcgaatgaagcagagtatacgattgtgccaagggaaagcgtgcgccgttgtcgtgatttgtgattggggacaataca

SEQ ID NO: 549823 - DNA, 238 bp, Homo sapiens
aaaaaaaatttttttttttccccccgggccccttccccgtttaagggttttaaaagggggttaacccccccctttttaaaaaaaaattaacccgggcccctggttttttccccccacccccttttttcccggtttattttaaaaaaaatttttttttggggcccggttttgtttttttttttggtttttgggggaaaaaaaaaaaggccccaattttgggggggggttttttttccca

SEQ ID NO: 549824 - DNA, 682 bp, Homo sapiens
gtgcatgcccaagctggagctgccccttcgctggacgtggccccgctacatgctcaatggtccgctgtgagccagagggagttgatgcctgcggctgtgtgctgccgagctgctactcgcagtgagtgtcttcgagaagaccaagcgactcctgttcctcgtgtgtgcccatggcctacctgtgaccactgtgtgtgtgattgaatgtgcttgtgcctgtctgtatcaccttgccagatgtccccaaatgcctgtgcccttacatgtggtgcccctgagtgtgctgcactgtgggcatgatgcttgatttgtgaccatgactgtgcctgcctgatcatggatgccttgtggcatggcctccgaagctgacccatctggtgtgtagcgtccattgcctgttcctcatgcgtgcgagccgtggatgggaaggcggtcttgctgtgtcagttgtgagctgagccctgtgcgggcagttgtgtgctgcacctgctgggggcttgcggctccgtggccttgtaccctgtgtggcctcgtggactgcagtgacatgtacgaggaaatgtgcttgtgcaccagcttgtgccatgttctgagacctgaggctgggctcacgccggctgccttcacctgggagccacgcctgtgctttgcagccttcccctggacggagcgctcggtgtca

SEQ ID NO: 549825 - DNA, 781 bp, Homo sapiens
  misc_feature (136)..(136): n is a, c, g, or t
  misc_feature (180)..(180): n is a, c, g, or t
cctctgtgccccattcctgctgtgagcagggccgtccgggcttcctgtggattggcggaatgtttagaagcagaacaagccattcctattacctccccaggaggcaagtgggcgcagcaccagggaaatgtatctncacaggttctggggcctagttactgtctgtaaatccaatacttncctgaaagctgtgaagaagaaaaaaacccctggcctttgggccaggaggaatctgttactcgaatccacccaggaactccctggcagtggattgtgggaggctcttggctttcacttatctagcgtgtaactgtgagactgtcgtgggggcaaggagtacccacaggggttgactgctgtgctgatagatcttcatagaacgtcactagctccaggctgggatgcaggaggacttcaagtgtgtggacgaaacgacagactgatggctcaaagggtgtgaaaaagtcagtgatgctccccctttctactccagatcctgtcctttcctggagcaaggttgagggagtaggttttgaagagtccttatatgtggtggaacaggccaggagttaggagaaagggctggcttctgtttacctgctcactggctctagccaggccaagggacacatcactgtgagaggacgcctccacctcatgttcaaactatatactggagcatgggctgaaactacgacagatccttctgctgaacaagcagcaagccagaagagtgggactaaaggagcctccctaaaccaatcggtcgccaacagcgaga

SEQ ID NO: 549826 - DNA, 433 bp, Homo sapiens
taatgtatccaaatggtctttccaccggagatagtcacgtcacaatcatgggagattattccagcagcctggtcggatccgcatatacacttcagggtgcccgaacactcagaataggtgtaggtatcgcagtggggtctcctcctccggcggggtcgaaggaggtggtgttgaggttgcggtctgttagtagtatagtgatgccagcagctcaggcactgggcagcagcatcaggcagcacagtaggcactgctgtgcattcaggcacggatcagcacaaagaggggcgttaggtattgggttcatggccgggggttttatcttgctaattgttgtgcatgcaaatggatggcccctaagatcgcaggcagacacctgctcaggtgtaaggcgcacagctggttaggtctacggagcacaccggtggggctg

SEQ ID NO: 549827 - DNA, 149 bp, Homo sapiens
ggctgtctccgcttattacacctccccgaccccctgccatggccggcactgactctgcctctgacgctgaggatacgcactgacacacgccctgccagaatgccaaaggaagccattcttctggaagaagactttctcctgaaagcctc

SEQ ID NO: 549828 - DNA, 909 bp, Homo sapiens
gtcctgtcgacaaaacctgtcctcaacaagctgaccgtatacacaaccttgcatagatgtcaccaaaggtcaatgtccgataatattacctgcgggtactgtccctgacccttgtataggtgggtgagccaatacgtctggcctgacagaatgcggcctctgagacatgaagacaccatctccatgtgacgccgaacaactgcaagcggtgtctgacgcgttgccaagagactaagactcgcggcaggatttctctttgagtcaatagcttgtcttcgtcctatctgtcgacaaatgacgaggatctttttttgtgtatcccccctatcagttcgtacttgttgctctattgtaccagaatagaccttctattagcgggaagtagaaatcagctctatctgagaaattgcagctggaggtgcaggtatcagctccccgaccatcattggggagctggtgggtagtcgaacctgtggtgaactccgcctcggtgaataaaatggagatccagggtgggtgtgaatccaagcagcgtctgtgtgagtaacgggcacagtgaaatctactccaactgttcgttcagtgtgtgtgcacttcgtcacctacatatccgtgtattgggattgtcgtgtaataacatgcccttaccctttcttgttttcatgactcggctgttaaactccatatatcagtcatcttggctgttatgagaccacccatataggttccttaacatatcggtgacgaggggattagaacggacattcagcagtagtattacttaaaggggctcataaatggggcgtagctcttaaaagccattattgggttcaagacctcacacgattgaaaggacttgaaacaaatggaagggtccattcaaaaaaactcatccatgacctaaggatg

SEQ ID NO: 549829 - DNA, 1135 bp, Homo sapiens
  misc_feature (1120)..(1123): n is a, c, g, or t
gatccactccacgaacgtcaaatgcgtcatctgaggagggggagggccggggcaaaggaggggcaccctgacatggagcctgccagctccgtcagccctgactcggcccggagctgagctccccacctgccggtagcccaggagatggagcagcccagcccacgtgcccggccttccgcccctgacttcacttgataacaaactagaaactgaaacagggtcgggatgccgatgccggcttggagttagagatgagtcaccgctgagagcagctgcagtagctgagcagtggcagcagagaggcagacgtgagctgagggcgcagaggcaggcagcatctctgagggtccccaaggaacatggctgggagccgtgaggtggtggccatggactgcgagatggtggggctggggccccaccgggagagtggcctggctcgttgcagcctcgtgaacgtccacggtgctgtgctgtacgacaagttcatccggcctgagggagagatcaccgattacagaacccgggtcagcggggtcacccctcagcacatggtgggggccacaccatttgccgtggccaggctagagatcctgcagctcctgaaaggcaagctggtggtgggtcatgacctgaagcacgacttccaggcactgaaagaggacatgagcggctacacaatctacgacacgtccactgacaggctgttgtggcgtgaggccaagctggaccactgcaggcgtgtctccctgcgggtgctgagtgagcgcctcctgcacaagagcatccagaacagcctgcttggacacagctcggtggaagatgcgagggcaacgatggagctctatcaaatctcccagagaatccgagcccgccgagggctgccccgcctggctgtgtcagactgaagccccatccagcccgttccgcagggactagaggctttcggctttttgggacagcaactaccttgcttttggaaaatacatttttaatagtaaagtggctctatattttctctacggccaaaaaaaaaaatcggcctcgtggcctacagcggggagtattcgtccaagaggccatttttttggactttattttatattttctcttttatttcttnnnntaatctttataa

SEQ ID NO: 549830 - DNA, 1087 bp, Homo sapiens
ggtcatttggcggaggtctctggagagcgcagaacctagataaaagccccagcttggctgcagaaaggtcccaggtagacctcactagtgtgaacagctactcaggcccccgtagcctaccccagccaggtctcctacctgtctgctgccagtatagtaggtcccggtcagctctggagtgctctcatcggagggccatgcctgtctcactcctacttgactcttttggcaagggctctcatctccaggtcagcgctggaagagggacagatgtcgatttcgttgttatgtaaatggccacatgggcactcgactggtctgggacctacacgcaagtcacgttcccttcagaacctgggcctatagagcccaaactcaggtcccaagaagtgcatgctacagatggtcatgttcctggagaggcagggagggtgaggggcagcgtctgactggttccctgcacccaaaaacgcctttaagtccatttctccatgcctgcccatcctgccttgtatccgctggcccaaggggacggtgagtcccgtcccgtagatatccacctgggatccatatgacaaggatggtcggcgaatcattgcgagttgaagacagcggggtgtcaccgtagaagaccagccagactgtctttagacacccccggtggccaaaggtcatccaatgggacaagtttagtgtattcagggcacccgtgacgtcgtgaacagccgtgcagtgaccactcattggcacccaaactacctgggatgtcgccctccggggagctctgtggcgtgagggccgcggggtgttccggagtgtcatggctgcctctggctggcgctggcgaggtgcgggcaggtcatgcgtgagctgaggggaaggtcaccggcatgggctcgtgttcgcgtgcaacgtttagttggggcctggactgcgtctgaaaaacctccaattggtgactcacgaggggtgtagcagcgtggaggccctccggtcgcggctacttgccggggccttgttggggccacccccttgccgggtttcccaccttcccctcgtgacagcgcggggtccccgcggagacgcc

SEQ ID NO: 549831 - DNA, 969 bp, Homo sapiens
  misc_feature (6)..(6): n is a, c, g, or t
gcattnctcttgactgagaatggtgccacgtgtggtctgtaagtagcatctctgagggtccccaaggaacatggctgggagccgtgaggtggtggccatggactgcgagatggtggggctggggccccaccgggagagtggcctggctcgttgcagcctcgtgaacgtccacggtgctgtgctgtacgacaagttcatccggcctgagggagagatcaccgattacagaacccgggtcagcggggtcacccctcagcacatggtgggggccacaccatttgccgtggccaggctagagatcctgcagctcctgaaaggcaagctggtggtgggtcatgacctgaagcacgacttccaggcactgaaagaggacatgagcggctacacaatctacgacacgtccactgacaggctgttgtggcgtgaggccaagctggaccactgcaggcgtgtctccctgcgggtgctgagtgagcgcctcctgcacaagagcatccagaacagcctgcttggacacagctcggtggaagatgcgagggcaacgatggagctctatcaaatctcccagagaatccgagcccgccgagggctgccccgcctggctgtgtcagactgaagccccatccagcccgttccgcagggactagaggctttcggctttttgggacagcaactaccttgcttttggaaaatacatttttaatagtaaagtggctctatattttctctacgccaaacaaaaaataaaatataaaagtaaaaagtcggaggttttttggggcgggggcaaagggataggaagggcaggggtaataggtttcggacccgttttggtcaagggggaatcgggtccccaaagaggggaataattggagagagagcagttattactagaaaatgacgagaataggagaacaaagaaaaaggaaaaaatataaaaagaaaaaatattaaaggaaattatataat

SEQ ID NO: 549832 - DNA, 363 bp, Homo sapiens
  misc_feature (344)..(344): n is a, c, g, or t
gaacacaggtgtcgtgaaaactacccctaaaagacaaaatggggaagggaaaggactcatattaaccatttttgttattcggcacggtggtttgggccagttccaccctatcttggccattttatctttaaattccggtgcgctctgacacaaagttccccttgtaaaaatttttggagaggggagccgtctttgagtggggaaagaggctcccctcacagtgatttcctcgggcctctggatataactctaaagcctgtgcgtgtaacacggggtctccaccagtgcaactcctcttcgggatatcagagccgcaacgaggctcatgtgtcttatcagttggncccgccgacgacacacatc

SEQ ID NO: 549833 - DNA, 1133 bp, Homo sapiens
gatccactccacgaacgtcaaatgcgtcatctgaggagggggagggccggggcaaaggaggggcaccctgacatggagcctgccagctccgtcagccctgactcggcccggagctgagctccccacctgccggtagcccaggagatggagcagcccagcccacgtgcccggccttccgcccctgacttcacttgataacaaactagaaactgaaacagggtcgggatgccgatgccggcttggagttagagatgagtcaccgctgagagcagctgcagtagctgagcagtggcagcagagaggcagacgtgagctgagggcgcagaggcaggcagcatctctgagggtccccaaggaacatggctgggagccgtgaggtggtggccatggactgcgagatggtggggctggggccccaccgggagagtggcctggctcgttgcagcctcgtgaacgtccacggtgctgtgctgtacgacaagttcatccggcctgagggagagatcaccgattacagaacccgggtcagcggggtcacccctcagcacatggtgggggccacaccatttgccgtggccaggctagagatcctgcagctcctgaaaggcaagctggtggtgggtcatgacctgaagcacgacttccaggcactgaaagaggacatgagcggctacacaatctacgacacgtccactgacaggctgttgtggcgtgaggccaagctggaccactgcaggcgtgtctccctgcgggtgctgagtgagcgcctcctgcacaagagcatccagaacagcctgcttggacacagctcggtggaagatgcgagggcaacgatggagctctatcaaatctcccagagaatccgagcccgccgagggctgcccgcggtggtcgaatgagccatcagccgtcgcggactaagcctcggctttttggcagcaactcctgcttggaatcacttctgtaaagaaacacacaaacataaaaaaaacaccgcgcaaaaaaaagtggtgcgccgcggcgaaaaaaaatgtgggcgaataaaagtccggatcgcaggtgccaaaacgcgggtacacggttgtgcccgaccacatccgtaacatgacaaaaccagtatccccatccgagct

SEQ ID NO: 549834 - DNA, 307 bp, Homo sapiens
  misc_feature (72)..(72): n is a, c, g, or t
tgtgcacagtcccggacgaggtatcagacagtggcgcccccaaggatctgtcaccttcacgcgagactatantctccccacgccagaaaactcttgtgttcttgctaggccaggtgttcctggcagtcaaatcgagtcctccattttctcttgtggaccagttagttttgctcataacgcagtattctgagtttgcaactgtctctctgatgttgttgcttttgttcaccaccagtattttctgcattctgctctggtctaaatacacctaccttgagaaagtctttcccttattttcacctaaatg

SEQ ID NO: 549835 - DNA, 456 bp, Homo sapiens
acctagatgcttgttaagtacacaccattacctggtcatatatttccttcagcttcagggactggatctggatatggaccagatatctctagccaccatgatggcactggctccttcaccagatgaaacaatacttcaaaacaagccagtggagcaggtcacgccacccgacaactcctagttccgctgcctcttctgcactccaaactctctcttcaaaagctcctggattccctccacaaattgaaaagtggaaatatttgcaaataactgcactcacttctccccttgctagcatggataataaaactcactctctttatcacacttcactcttattatattggcttctttttacaagtggcgagcagctgcaccgttctactgattacaggaggatcacttgaggccaggagttcgagaccagcccgggcaacataagacgctgtttctaca

SEQ ID NO: 549836 - DNA, 854 bp, Homo sapiens
gtgtggtctgtaagtaggtggtcagctgtagctggatgtgtgccttgaaaggctgacaagtttgccctgagtgactcacctactgtcacctgatccaacaagatttgtgggcgtagcctgccgatgggtgacgccagttaaagcatctctgagggtccccaaggaacatggctgggagccgtgaggtggtggccatggactgcgagatggtggggctggggccccaccgggagagtggcctggctcgttgcagcctcgtgaacgtccacggtgctgtgctgtacgacaagttcatccggcctgagggagagatcaccgattacagaacccgggtcagcggggtcacccctcagcacatggtgggggccacaccatttgccgtggccaggctagagatcctgcagctcctgaaaggcaagctggtggtgggtcatgacctgaagcacgacttccaggcactgaaagaggacatgagcggctacacaatctacgacacgtccactgacaggctgttgtggcgtgaggccaagctggaccactgcaggcgtgtctccctgcgggtgctgagtgagcgcctcctgcacaagagcatccagaacagcctgcttggacacagctcggtggaagatgcgagggcaacgatggagctctatcaaatctcccagagaatccgagcccgccgagggctgccccgcctggctgtgtcagactgaagccccatccagcccgttccgcagggactagaggctttcggctttttgggacagcaactaccttgcttttggaaaatacatttttaataggtacaaaaacaacaacacaacactaccctctactccacaaaacaaaggggg

SEQ ID NO: 549837 - DNA, 844 bp, Homo sapiens
  misc_feature (739)..(739): n is a, c, g, or t
agaggcaggcaggtgagagcgggagctggagcagcagctggggaggcagcgggaggggcttcccggtccccaggctgcggggcaggccagaggccctgggacacacgggcagcatctctgagggtccccaaggaacatggctgggagccgtgaggtggtggccatggactgcgagatggtggggctggggccccaccgggagagtggcctggctcgttgcagcctcgtgaacgtccacggtgctgtgctgtacgacaagttcatccggcctgagggagagatcaccgattacagaacccgggtcagcggggtcacccctcagcacatggtgggggccacaccatttgccgtggccaggctagaggtccccttcccatactctccaacggaagcatgtgtgaaagcaagctgactggcctgtgtgacagagagggaggatgacatgtgggaggcggggcagaagaaacggcggggttgggacatcacaagatgagcgcatggtgtgttgaaggactggagtggtagacaatacttctggtcagttgtggaaagtggatggggagttcgtgattcataccaatggaatcaaagggaatgaattggcataataagggtgagtgtcacagtaatcagatgggagatggaaataagacaaaaaatacggtacaacaatagcatattattcagatagaaacgtgaaggatgggaaggtgtacggagaaagacaaggcaggaagtnaagacttgaaagtggagattgaaatagacagtgaaacaaatagtagtgttggtagagcatgagaaaaaatatgagggaaacgaggttaaaatgagaaaggagcgc

SEQ ID NO: 549838 - DNA, 927 bp, Homo sapiens
  misc_feature (1)..(1): n is a, c, g, or t
  misc_feature (3)..(3): n is a, c, g, or t
ngntcgtgatgatacaaaagcggcaacgacgcacagatgagttggccacctctgcgcgctgggtgaactggttcctgtctcacctcgacccattgtgcccgtcactctgtttcaccggtccccatcacccatggctgtaaacacatgggcgccaatgtcttcccaaggccggttatgccgggtaaaatcctttttccagcgtggacaagacacattcggcatggtataactcttcgccttttcaccttgttcccgactttcccttgatgctccctagcccctggctggtcggtgtctccccccctgtttccacgttttcgtccgcacccaggtttccccttccccaattggggggcccccaccacgggggcaacaaaagcgatcaaaattctcgggaacccaacaacacgggcgcgccagaagtttcttggcacgcgggggcaaccccggattctccccccctgggcgccacaagaggactcctttcacaccccggtcgtcggtaaaacaggtccccggcaccacaacagagcgtttctctgtgttcggtaattaataggcacactttcttcccccggtattgatattgtctgagggcccccctccctccccccggtatggttggtcccccccctgcattgttgaactccacggccgacttctggggactcccgagggtttcatcattaagtagtgtaggacccaagcggcccccccctcctttctctatgagcggggccatccccggagtttatctgggcgcgccaattcctggccaccccgtccttcatttcttgtgtgtcccccgccctcccctcgggggcgaatttctccctccccctcccccccgctgcaggcagtgcccgtgttcggccccccggtgcctttctaacaaatcctggggggggacccccccaaaccataaca

SEQ ID NO: 549839 - DNA, 1258 bp, Homo sapiens
gatccactccacgaacgtcaaatgcgtcatctgaggagggggagggccggggcaaaggaggggcaccctgacatggagcctgccagctccgtcagccctgactcggcccggagctgagctccccacctgccggtagcccaggagatggagcagcccagcccacgtgcccggccttccgcccctgacttcacttgataacaaactagaaactgaaacagggtcgggatgccgatgccggcttggagttagagatgagtcaccgctgagagcagctgcagtagctgagcagtggcagcagagaggcagacgtgagctgagggcgcagaggcaggcagcatctctgagggtccccaaggaacatggctgggagccgtgaggtggtggccatggactgcgagatggtggggctggggccccaccgggagagtggcctggctcgttgcagcctcgtgaacgtccacggtgctgtgctgtacgacaagttcatccggcctgagggagagatcaccgattacagaacccgggtcagcggggtcacccctcagcacatggtgggggccacaccatttgccgtggccaggctagagatcctgcagctcctgaaaggcaagctggtggtgggtcatgacctgaagcacgacttccaggcactgaaagaggacatgagcggctacacaatctacgacacgtccactgacaggctgttgtggcgtgaggccaagctggaccactgcaggcgtgtctccctgcgggtgctgagtgagcgcctcctgcacaagagcatccagaacagcctgcttggacacagctcggtggaagatgcgagggcaacgatggagctctatcaaatctcccagagaatccgagcccgccgagggctgccccgcctggctgtgtcagactgaagccccatccagcccgttccgcagggactagaggctttcggctttttgggacagcaactaccttgcttttggaaaatacatttttaatagtaaagtggctctatattttctctacgccaaacaaaaaataaaatataaaagtaaaaagtcggaggttttttggggcgggggcaaagggataggaagggcaggggtaataggtttcggacccgttttggtcaagggggaatcgggtccccaaagaggggaataattggagagagagcagttattactagaaaatgacgagaataggagaacaaagaaaaaggaaaaaatataaaaagaaaaaatattaaaggaaattatataat

SEQ ID NO: 549840 - DNA, 409 bp, Homo sapiens
agcggtccttatcgccaacacataaagaagagctgaaacaaccctactaaactatccaaaaaatgagaagggactcctcgtcaaatcattctatgaagctagcatcattctgataccataactttgtagaaacacaacgaaaaaagaaaactttagaccaatatccctgatgaatatagatgtaaaaatcctcaacaaacactagcacaccaaaaccagcagcacatcaaaaacctaatctaccatgatcaaaatggctttattcctgttatacaaggttgggtcaacatatgtaaatcagtaaatgtgattcaacacataaacaaacctaaaaacaaaaaccatatgatcatctcaataggtgcagaaaaggcttttgataaaatttaacatgtgttggggataacat

SEQ ID NO: 549841 - DNA, 622 bp, Homo sapiens
  misc_feature (36)..(36): n is a, c, g, or t
  misc_feature (607)..(610): n is a, c, g, or t
gctcccttgccagccccagccccacccagaagatgntgggtcatgtaggggtgggcacatgtcttcctggccagatcctgcagctcctgaaaggcaagctggtggtgggtcatgacctgaagcacgacttccaggcactgaaagaggacatgagcggctacacaatctacgacacgtccactgacaggctgttgtggcgtgaggccaagctggaccactgcaggcgtgtctccctgcgggtgctgagtgagcgcctcctgcacaagagcatccagaacagcctgcttggacacagctcggtggaagatgcgagggcaacgatggagctctatcaaatctcccagagaatccgagcccgccgagggctgccccgcctggctgtgtcagactgaagccccatccagcccgttccgcagggactagaggctttcggctttttgggacagcaactaccttgcttttggaaaatacatttttaatagtaaagtggctctatattttctctacggccaaaaaaaaaaatcggcctcgtggcctacagcggggagtattcgtccaagaggccatttttttggactttattttatattttctcttttatttcttnnnntaatctttataa

SEQ ID NO: 549842 - DNA, 1075 bp, Homo sapiens
  misc_feature (1060)..(1063): n is a, c, g, or t
gatccactccacgaacgtcaaatgcgtcatctgaggagggggagggccggggcaaaggaggggcaccctgacatggagcctgccagctccgtcagccctgactcggcccggagctgagctccccacctgccggtagcccaggagatggagcagcccagcccacgtgcccggccttccgcccctgacttcacttgataacaaactagaaactgaaacagggtcgggatgccgatgccggcttggagttagagatgagtcaccgctgagagcagctgcagtagctgagcagtggcagcagagaggcagacgtgagctgagggcgcagaggcaggcagcatctctgagggtccccaaggaacatggctgggagccgtgaggtggtggccatggactgcgagatggtggggctggggccccaccgggagagtggcctggctcgttgcagcctcgtgaacgtccacggtgctgtgctgtacgacaagttcatccggcctgagggagagatcaccgattacagaacccgggtcagcggggtcacccctcagcacatggtgggggccacaccatttgccgtggccaggctagaggcactgaaagaggacatgagcggctacacaatctacgacacgtccactgacaggctgttgtggcgtgaggccaagctggaccactgcaggcgtgtctccctgcgggtgctgagtgagcgcctcctgcacaagagcatccagaacagcctgcttggacacagctcggtggaagatgcgagggcaacgatggagctctatcaaatctcccagagaatccgagcccgccgagggctgccccgcctggctgtgtcagactgaagccccatccagcccgttccgcagggactagaggctttcggctttttgggacagcaactaccttgcttttggaaaatacatttttaatagtaaagtggctctatattttctctacggccaaaaaaaaaaatcggcctcgtggcctacagcggggagtattcgtccaagaggccatttttttggactttattttatattttctcttttatttcttnnnntaatctttataa

SEQ ID NO: 549843 - DNA, 706 bp, Homo sapiens
  misc_feature (552)..(552): n is a, c, g, or t
  misc_feature (555)..(556): n is a, c, g, or t
  misc_feature (558)..(558): n is a, c, g, or t
cagtgcaggaagttggattctattgagcccgccatgaacttactgcgtgtctgacaagcaacatgacgctagagatatcatcgtagaacaaccgaagcttcactcaggcaggctgcgcgcatcgggatgtcctgatccaacatcgaagttgtgagttctatccactggttggagacggaagagtaacacagggtgctcgagatgcctcgagtaagaaggaccagagacagttctaatccgactcttggggatctatgtgggctgggtgatggattcccgtcgaacacatggtccctcgtactgcttccatcagctcctagcccctcagaagcggacgcctacagttggcagctatgcctgtacccctcagtcgtttgcccaagttccagcatccttcccatgaactgctcaaggaaaatggcttcacacaacacgtctaccataagtatcgtaggcgctgccttaatgagcggaaacgcttgggcattggccagtctcaggagatgaacacactcttccgcttctggtccttcttcctccgagatcacttcnacnnanagatgtatgaggagttcccagcatgctggctctggacggacgccaagacaggctacagatatggtttggagtgcctttcttcgatactaccgttatggcctggcaaaagaagttccggctggaatatcaggattttcacggagaaacg

SEQ ID NO: 549844 - DNA, 952 bp, Homo sapiens
ctcgccaatagaaaatctttgatctacaggactggacccaggcacgatgaagtgggacaaaaatgctgctgagggcaaatctcaagttacattgtgctcgatggaagcgtataggatgtccttagcataataggcatgctgtagttgagatatgggcgagagtggactatagttataagagttcatggagggactatagacaaattttgcctgattgtaagagtggaggggttgcatataagtcaggatcaagttacagcagaggtgatttaagctttagtcaccttcagtagtacacagaaggtcagctggcatagttctggtgcaaactgttttttggggaggaactcattgggtctgtgaatgttagtggcaacagggtagtagatgatagggcgagtagtgaggacttggtcgagttaaaaaataccctgttgtgggaagaggtaagcaacggatacggagagtgcgacttgattgtctataggcacctgagtagcgaacatgcgggatctaaaaatagagctgtggcttgtggactgactttgggatggaagggctggctaggaatggtagtaaaagttctcatgaaaataagtgaagcttaagtggaacgttgagcaggatgtcggatgtgagattgtcacttgcgccgatatgatccggaagcacccagtgaatggcagattggttgtccaacatgttgcgaattgtcactgaagaaatgcctgtgtcccgtggaatcggtcatgcaactgtgcgacgtgtgtgagctgtgtggatggcatctgggccacacagcactttaaatggcattggaccgctttaattggccttcacggacgggcgctaggccaaggatgataacgcacgcatcacttttgctgtaaacggccctggggcaataaaggggggttgcgctacaatggggaacacccccggagaaccaaaa

SEQ ID NO: 549845 - DNA, 936 bp, Homo sapiens
atcgttacccggggcagcagttgagccggctgggaagggatgcatcttttactttcatgtatgcttgcagtgaagaagtctaagtcatcttggtgagtaccgggtggatgcttaaagactgcaggataataacgatcagaactttcaggaacagaaagcactatatcccaacaatctcagtatatggcagaggtgaagtcgaaggttccgggaaaggttcttccaacgcaagggccgaatgtatcgtggatagatatggtgaccgcaactggtgctgtgtcatacccaagaaattgttacccttagaacaaccattctgctgtactctggaaccaaactagagatagaatgcatcaagcgagacctatgaatacgatgtgcgacatcaaagaaatgggtcgaaaaaggatcacgggcgaaaataaacctactgaatagataaatgtgcagctggtttgggaacaagcctgccttatcgtactgatgtggaaccaagtaagtacaagagtatggctacttgtgtgcgtgaaaagtagtattgtgtggtcaattaaaggttgataagagttcataagaagagaagtgtgtgtccatgattggtggaaaatttggtattgttgaatgtaatagagtctggtttgtgttgaagcatagaactgttaagtatgaaccaagtgtaatggggtgacacgtcatgttgctagagtggaaatcaattattggtgcaacatactatgcagtatacatagataaaatactagggatgtttataggatatgggtgacaggattcataacatttatatacagaggatctaggggttcataaattggatggaaatcatacagacggaataagggaggaggctcacattagaatcgaaaaaatatagaatataggcgtaagttagggtagtacaatacaaaagacaggaca

SEQ ID NO: 549846 - DNA, 593 bp, Homo sapiens
  misc_feature (6)..(6): n is a, c, g, or t
  misc_feature (578)..(581): n is a, c, g, or t
gcattnctcttgactgagaatggtgccacgtgtggtctgtaagtgatcctgcagctcctgaaaggcaagctggtggtgggtcatgacctgaagcacgacttccaggcactgaaagaggacatgagcggctacacaatctacgacacgtccactgacaggctgttgtggcgtgaggccaagctggaccactgcaggcgtgtctccctgcgggtgctgagtgagcgcctcctgcacaagagcatccagaacagcctgcttggacacagctcggtggaagatgcgagggcaacgatggagctctatcaaatctcccagagaatccgagcccgccgagggctgccccgcctggctgtgtcagactgaagccccatccagcccgttccgcagggactagaggctttcggctttttgggacagcaactaccttgcttttggaaaatacatttttaatagtaaagtggctctatattttctctacggccaaaaaaaaaaatcggcctcgtggcctacagcggggagtattcgtccaagaggccatttttttggactttattttatattttctcttttatttcttnnnntaatctttataa

SEQ ID NO: 549847 - DNA, 725 bp, Homo sapiens
  misc_feature (144)..(144): n is a, c, g, or t
  misc_feature (158)..(158): n is a, c, g, or t
  misc_feature (710)..(713): n is a, c, g, or t
ggcacagatgcagacagaagggaagtcatggtagcttgtgaacagggagagatttcagctgtaccagcctggtagccttgcacaggtgggagtgtcctgttggggccctgcacctggagtccctctgggtctcagccagatganggaggaaggcttantatccagatttgccccaggatcctgcagctcctgaaaggcaagctggtggtgggtcatgacctgaagcacgacttccaggcactgaaagaggacatgagcggctacacaatctacgacacgtccactgacaggctgttgtggcgtgaggccaagctggaccactgcaggcgtgtctccctgcgggtgctgagtgagcgcctcctgcacaagagcatccagaacagcctgcttggacacagctcggtggaagatgcgagggcaacgatggagctctatcaaatctcccagagaatccgagcccgccgagggctgccccgcctggctgtgtcagactgaagccccatccagcccgttccgcagggactagaggctttcggctttttgggacagcaactaccttgcttttggaaaatacatttttaatagtaaagtggctctatattttctctacggccaaaaaaaaaaatcggcctcgtggcctacagcggggagtattcgtccaagaggccatttttttggactttattttatattttctcttttatttcttnnnntaatctttataa

SEQ ID NO: 549848 - DNA, 380 bp, Homo sapiens
cgggtgcggtgttatgtggatgtcttgtgagtgttgcagcatcgtgacagtctgagctggtctgtggtacattgaatcatataaactgtgttgtcacagtgacgattgacccacttcaaatgagcacagaataagcgctctcactgcacgctgtggaagaggctgtacacgtggacatctggcacatgctggttcaggtgcggcggcacggcgcccctcctagggctcttcacctgctctcttttatttttaccaaagtaaaatcataccacgttcgcggttcttccagtgtatgagttccgtagtgctgtgaatcgggcacagaggcagcttttctgcccccgagtcctgcaggtggatcagtgctatcccgcgttaaa

SEQ ID NO: 549849 - DNA, 110 bp, Homo sapiens
acggccgtgtattactgtgcgggagaggtagtaccgcggtattatgattacgtttgggggagttatcccgatgcttttgatatctggggccaagggacaatggtcaccgt

SEQ ID NO: 549850 - DNA, 1769 bp, Homo sapiens
caaagatgtagcctgattagccctgtctctctacgaccagggccttggggctaggcccggctggccgggggaggatgagtcgcgttgggttgggagtcgggcggcggttggccgggctagggtgtcgctgacgtggccggtgcggggctcgttgaggaggacccgcgactgttggtctgggaccggtctaccgcgctcggcggcgtgcgtcaagtactggtcagatgttcacgtgacgactggcgggttcatctagcaggactctccgtgcagtacaaggctgagcaaccgtttcggcggcgggtgctctccatgtgggtgctgcgatagcgcagcttgtccgtggccccggagtagcgtgagccgttgcaccctgtctataaaagcgagcgcgaatggagactggcggcgtgtggggatggacccgcgagttccagcccgatgagacagagaacgccgacacagtgaagccagggaatacgccgtaacgggaagggcaacaatgggccatttaccagatggcgtgcgcaacagggcaatggcagttgtgaaccgtcgggggactagagataccaaaggctgccatttgatcagcacccaacaggggcatgggttcgggaacaacgccccaaattacgcagaagtaggccttctatccaaatttcgggtccgcccaattgggtttgcgcaaccgtggctactgggggccaaaattcacggagtgaaaacccttggttgggacaagcgtgggctcgccccgccaatctggagggcaccccgagacagcgctttagttagagtgcccaaattgcgaaccaaggggtggcgccacgagacgaacaaccaacatggcggagccgcgaaattgcggcctggagggatcgacgatagatctatatgccgcacagagtttgcggcacgatgtgtggcaccacaaagccgggtgtggttaaagcagattgttagcctcgggggccagcagtggctggggccacacaaactagtgcccgccgaaacttggagagcgcagcactttggcggctgaggcggccattaagcgcgaataattccagtgcccccattgttttaagttcaccacaagatgtggaagagtggggctttgcgaaaactgttccacacggagaagagggattgagggtcgcgtaagtagcgcgagctttatacgggagcggacgcgttatgcgcatgatgagtcctgagtgtgccgcgcgcgacccgtatggcgagtatagcatatgggatagagttggcgtttatcctacgcattgcaggaatgggtgccactagtctgctcacaccctcgggtatgtggcgatagaagacgccgaaagcccactaccacagcgaagatctcgcgaaaagacctcactatatgagggagaccccacggggcgaactgggccatgccaacgttagtacgacccggggcagttccatgggaaaccacgggggcacggtgccaaaaccaccgccagcaacgcacaggggggtgataacaccacccaaggcaccctaataggtgcacacaccgcatggggacatcacaggccgccaaccacagacgggaggcacaggggcgacacaatctgtggcaatcagacccacacaggaggatgcctagcactcatactacgaggtggacaacaacacaggacagacaaaggatataaacaaacgcggcacagacccactgatgagcaccaacacaaaaaggagcaagcacgcgagagtaccacgcggtgcacaaa

SEQ ID NO: 549851 - DNA, 338 bp, Homo sapiens
cacacttgtaatcccagcacttggagaggcagaggcgggtggatcacctgaggtcaggagttcaagaccagcctggccaacatggcaaaaccctgtctctactaaaaatacaaaaaattagctgggcatggcagcagacgcctataatcccagctactcggtaggctgaggcaagagaactgcttgaacctgggaggcggaggttgcagtgagccgagatcacaccactactctccagcctgggcaacaaggcaagactccatctcaaaaaagaaaaagaaaaaaccactgaactaagctaaaggaaggtaacaactcaaagtaaagaaaaaaacttt

SEQ ID NO: 549852 - DNA, 479 bp, Homo sapiens
acacgaagatctgcatcccacttctaagagggagcaccagggtgcgggtggactcttgctggatgtggtagtcagagggggtgcgtccatcttccagcctgtttcccagcaaagatcaaccttggcggatcaggagggatgccttcctggtctgggatcttggccttgacattctcaagggggtcactcggctccacctcggagagggatggtctaaccagtcggggtctccacgaagatctgcatcccacctctaagagggagcaccaggtgcggggtggcctcttcctgggatgtggtcagcggaggggggtgcgtccatcttccagcggtttcccagaaaagatcaagctcggcgggtcaggagggatgccttcctggtctgggatcttggccttgacattctcaggggtgtcactcggccccacttcgagagggagggtctcaccagtcagggtctacacgaagatctgcatccc

SEQ ID NO: 549853 - DNA, 762 bp, Homo sapiens
  misc_feature (57)..(57): n is a, c, g, or t
gaattcggcacgagcaggatcgaagccatgactgggtgcaggcgggcgcaggcccgntgtgggtgggcaccagttctcagcaccgctcactgctgccgggcacactgggaccagcaggctcctcagccaaccctgtccctcgtgcccgggcccgtgccagagatggtgacccccagccactatcggtggggcacgggcagggcttcagccggctcccacctccccacagaagcccaggagtgtgtggacgtctgagcccagctttctgcgtgccctcctgggccccctcactcccgggcaggcgggccgggcctcgccccccattccccctcctaccccgggcaggggcttccgggggcccttttcacctggagaaacattcccactcccctttgcctcccttgtactctgagctgtgaatattttaaccctgtaaataccggccagctctgtgtgaccacagagactattttatcactgtgtcagtcccggttcccttttaacccaataaggggaatttctcccagcatggtgggcttttcccggaccttcaaggggcctccccaaatgtgggacccaaaatattaaaacacggcccgtttatggggtttccgggttaaaagcacacacaagtacacctacacaaacacaccaccaatgcggggggcggggcgcgcgtctttaaaagaaagtttccccctcaggggtgggcccccagggttttaccggcgtaccccgcgttttctggtccacagtggggct

SEQ ID NO: 549854 - DNA, 931 bp, Homo sapiens
caacaacagagaaaatcaagagtgttgcaatctataacagttaatattgattcattcacattcctgtgtaaagtcattttatatggaaaggcttacaaatcaatatgtaagcatgcattattataagaatgtacaatgtattgtgtaattatagaagtaaaatctagatgttgagacctgttggtctaatagatgtggatacagttattttacttgaccatccttgttgtctacttgtgtgtctaacgtaaatatatgtcagagtatagaatctgcctgcagtcgtgacaacagaaagcttaagtgcatgcagctctatcggcaagatgcaatgataatggaaaaatagaaagcgaatactcagtttaagccaaggaaaatatgtggatttaatcatcgataaaactgactttctgtcacaaacaggaacaattttatagcatcagtcatataacatctggtttatcaatgcacgttcaacacaataaatactctgcagtggaggacacagtctaacaagatcgaagcaatagacgtagaaaatatatcttacaatagttgacctagatgtcatcacaatagctacttaacgatgtcaaagataggaagctattgcttgcaaccgagacacttgcacatcaggtgcacccccattgctatagaaagctcatagacattaacaccatacgatgtaccccagaacgacgtaacaagactgacagagacagcaaagaaaccatacatgctcaaaacgatggcgcactgaaaccaaacggacgcaaagaaataagcacccaacaatatgaacaacagccaccacgtcaaaagcagaacaacaacacaccgaccagcacgcccacagcacaacacgggcaacacagaccaacacgaaagaacacaaagcagaagaaacaaaaaacaagacaaaaac

SEQ ID NO: 549855 - DNA, 606 bp, Homo sapiens
accgtctcatggccagagtctagagcatgaacctaagttctgacccaccatcagtctgaaggactctgtttctttggacacatgatcctttggagttaatccttccttctcagttctggcctcatcccctggacagatacctctgagagcctccctgcccataggttcccagggatcgaggccccatggcagttccccttgctccagctgggagaccagaacaggcgtggtgaatgggaatgccagggaagccacatttgcataattctccagcatcacttccctgtacagggccctctgcacagagtccaggctggcccattcattctgggtgaagtacacagccacatcctcaaaggtcactggttcctggcgccaagcggtctggaacatggctggcgtcccagcttcacacactgcctcagggttcggagaagtgaaactcttcagctcggaccgcgaatcccgcgcggcgcaggcgcagataaagcgtggaaattccacctgccgccgacaccggggaaagcttgagaccctccgccggaagtgcgttttccatgcccctcctctctaggaggtgggtcagaacataaggggtaccgagct

SEQ ID NO: 549856 - DNA, 447 bp, Homo sapiens
acgatcacctttaccaggagatggaggctgcagtccagtcatggcatgcagacggccctctcagcaccgccgtgaaagcgacgatgcagtcctacacagggtcccagcagcttcacccactccgggaccaccatggacccttcacacacaggcagtgtggagcagaggaggccattccactctacacacaggaggaggccattccactctacacacacaaggctcccaaagctctgtgagcaacatctcagcctctccccgtgctcctctttgcgcattcgcgcgtgacaatcctgcagaggtgggctccacacaccagccacctggcactcggtctctttccttctaacaggaacagcaccctcaatcctgtgatagtctcaactctcttgggcccatgcttacctggcaaacacctgtggttaacccagcaatcccacatcaaaa

SEQ ID NO: 549857 - DNA, 239 bp, Homo sapiens
acatcatttccttgcaatatttccaccatggccttttcatctcaaagcacatgcaaagcatggtgcataggcagttggtccctgcagcaaacaaggatgagtggtcaggcagatgtggagccatatttcagccaagcatcttcaatagtcagcagtcagcatattggagtagctcaattctgtgtttttgggtttggagttttattcactcttcccactttcatggtaggcagcacaca

SEQ ID NO: 549858 - DNA, 1173 bp, Homo sapiens
  misc_feature (788)..(788): n is a, c, g, or t
  misc_feature (817)..(817): n is a, c, g, or t
  misc_feature (842)..(842): n is a, c, g, or t
  misc_feature (911)..(911): n is a, c, g, or t
  misc_feature (982)..(982): n is a, c, g, or t
  misc_feature (1067)..(1067): n is a, c, g, or t
  misc_feature (1135)..(1135): n is a, c, g, or t
  misc_feature (1159)..(1159): n is a, c, g, or t
  misc_feature (1165)..(1165): n is a, c, g, or t
actacacccaaacctataaccttagagactctcagtctttctggatagggctgatttgaactttccagaaagttgaccagatacattactgagcctttatgagtactgaaaaacaaaacaaaaaaaagatccctctttgaccatgtttcctccgaaaaatggaaataaaaccaactcaccattatgaggaaaaaaaaaaaatatggcctctgctggccctcagtggtggattctttgactggtcgcttcacctttacgagagggttacatacactgatccatacgtccactgactcagatactcatatgatcgcatcgcttgcatcataagcgcgcaccagcatgactccacagagtaggtaaatacaggttatctcacacaactcaccggagatacccgcagcgaagagaatcatacccaccaaacgagacagctataaaagcacagaaaaccacaaaaaaatgggctgtgttagtttggctctttttactatgctgcttcgcccctatcctgatcacacgatcaccacaaatcgatcatccaacaatataataggtggtttatactcacgcattggtactagtcctagctaacgctagatgcatccttcacaagtgcataacttcacccacgagtaagcttcaacatggttatcaaacccatacacacaattatcctgaaacacctaagccagaccactactcaacatgcaggataatcggaatcaacacttatcaacatagtgctgacatctatgacaatcaatcttccatacattcgattatcnacgctagtactaactcacgataggcgtgncacgtagtacgccacaagaccgccntacatcataaatcgactcaactatatgaaatctctgtatgacgtgaatacatatatcacctccattacntctacacacactacgtctagaatctcatactcaaccagacatctgagagctagtgctcttagtcatatctntataactcacaccaacaaacaactcagatacagtcccatactctctctgatactgatcccgcacatctataataacacgccacanctatcaggatagacagatgatacatctcacgatctatcacgtaagatactcagcgatcaatacataantatcactcacaactgatctatcgnacttantccagtcg

SEQ ID NO: 549859 - DNA, 598 bp, Homo sapiens
gcacaattcttgccttttatcggccacaaacgtcttatcccctaaaaagggggcaaccgtaaataaatttctcccaccttgttcacaagctctgcttttaaatcccactctccctctgcgaactgggacataacccgaatctgtttgtccccgttcatcagtcctccttacaagataccccacacccggtgcataccttctcttattagttttcaacacccccgcattgaccctccccccagtttcccggcatctcccccctcccataataaggtgaaagtttctttttcatcggcgcttcaagtcagcgcaccacaacatatggtattcttaatcattgctcctagtagtccacctttttgtttccccgagggtttccccgctaaccatcttataattctacccaacacattcattttctcttgcttatctgtaacacatgacaccgcaatgggtgtttacggcgcctcaatttatgatccctctcggaccgtaatgttcttcacctacctaaattcccacccacgttcaattatgcgccacccaaatgacgcccctatttaaaaaaaacccaaaacagtttttcgaccacaaaaca

SEQ ID NO: 549860 - DNA, 130 bp, Homo sapiens
atcatgcgtgtgcctacagtattgcgggccagatacttcagtgacagcagaagtgtttgggtgactttcctactttaaattttggtcatatcatttcaaagcatttgcatcttggccttgccatatgcaa

SEQ ID NO: 549861 - DNA, 608 bp, Homo sapiens
  misc_feature (422)..(423): n is a, c, g, or t
  misc_feature (574)..(575): n is a, c, g, or t
tatagcggaacccaggcgctgcgaggtagatagataggagactccgatcgtcataacaagtaactaacacagggttagccgaataaggtggtgcacgcctgtaatcccagctactcatgaggcaagtcagtggtatgttcggtatcatggctgagtgtaggagcattttagggaatagaagttaaatcctagacgacaagcgagtggggtaacaacactttacctgtcatggtaactacttcattgaataggaaaacagaaaaagaagaaaccttatagagggtgatggtaaagcaaccccaactgatatggaaggcagtgttggcaatcactgaaggtcaggattttgaaagcacaacaattaacaatgtaaaatttgcaagtgtgggggttggacataggttactatgtgtttaatgtgnnctccaacaaaattagcagagcccaaatgagaaggaagtattactctgtttaacaagattgaaattaaggggacagtatacagtttaaaccctttgggatttaggaatgtcagagttgtagggtggtattgccccttgatccacgtatgcannatgacgtctggaccggctcgattcgtatctgct

SEQ ID NO: 549862 - DNA, 241 bp, Homo sapiens
cagcgagtgatcagaatgtatagtcacgcatgtatggagaagatagtctctggtatgctgtaagtgaaattgaacctgtaacacgtagatggtaagaaaatacagatatgttgctctgtatggtacgtactaatactgttacgtcatgtacataattactaatcgcttatcttcccctttacagcacaaataaagtttgagttctaaactcattagaattgtagtatcagctcagaggatc

SEQ ID NO: 549863 - DNA, 363 bp, Homo sapiens
aagtctatacaagagaatactatgtgggactgttggaatacatatagaaataggcttgttgtcaattataggtcactggttaaataaatgccgatcagctcttcaaaatcacataccaaagccagtccgtgagggttttcaacttacaagatgatcagttcaccaaaattggtatcttttaattatttcagatttacgtaatgtcatataagatgggatagttttaacagcttaagtttataacagttggtataagttgtggtgctttcatagcttaagagtatagtaattctttttttaaaaataatttcaacttttattttaggttcaggaatacatgtgcagggggtagcccttaaactg

SEQ ID NO: 549864 - DNA, 1929 bp, Homo sapiens
  misc_feature (448)..(448): n is a, c, g, or t
  misc_feature (1385)..(1385): n is a, c, g, or t
  misc_feature (1671)..(1671): n is a, c, g, or t
gtatctagttgtaatgatctagtttctgttcgctgtgagtgcggtcgttgcctccttccctcgttgggcttgagtctgtctgactgataagtacctaccgtataggatgtatgtggtgtttgatttagttacttgcacttcaccaactattgttggtgctatgtattactctcccttgtgtggctcgctttctcctcctcgcgggtttcttcacccacatgtgggggggggatagtgagcgcctgctcgtttttcctgttggggccgcaagctgaggagaagacctcgtgggtgtttgtgtgtaatacaaaagccgcccggcggattgtggggggtggcacactcactgtgtgggtggccaccacttatccaatcctggtttatctagccctcgcgcggtagtgttataattctcttgttgtcgtagatatgtggccgcctccctggncaagccgtccttggtcagggtgagttaaaacgctcttttttctccttcctggggggagaaccaaaatattgaggggccgctctcactaatatgtgtgttccacaagaagaagtctgtgtgtttctctgttctaccacacgggggacatttttgtttccttgttctgcgtggtgaccaacaacaccatttttggtacttgtggggggtggcacccaatgctgcctaatatatgatttgggtgtcgcccccctcccccgccaacttggggggggacgacccctcgcctgtggggggctttcatctcaacctgtgtggcttcaccaacaggcgtggggatgatgttatttttcctgcgtcggttgcgtcccctcttttcccctcagcgcctcccctataatttatgtatggccgccccccggcggctcttaatatgtgtcgtcccccctggtgtatggatttcgggaagttgtgtcgccacacaccacgcggcgggcgtcctacaccactgtgtggccacataggatcacaacaggttttttgcggcctgggaagcgcccttcgtaatagcgtcgcagaaatagagtagcttttggtagttgctccccccgcttctttatcggcggttatataaaagactccttgtgagaaagatattgggcccccccctagaagtgtcctctgtgagagagcgtctctgggtgtgatatggccctggcaccaccactgtggtgtgtggagaatatagtggggggtgtccctctggtgcgacacagcccccacattgtgtgcgtgttttgagagagagccctttcttctctacagagacggtaatttctcacaccccttgtgtgggttctcgcccttgtgctcatgtgtgtctgcgttgagatatattgagagacacacagacactacagcgttgctcgcgcgtgtgggngtgtgtctactactctacacacactcacactttgtgacacacacagagagagggcttgtcatgtgagagcctgggctcacacaggggtctacaccacacagcgtgctgtgcgcctcacagaaaaggctctcacgagaagggcctattaataggagatatttatatcctctcacaagaacctgcggccacacccctacactctctttatatacacacagtgggggtgcggagaagagacacgcgtgtctccacagagaactctgtgtttgtgttcccacacttgggngccactcttatagtaaaaagaactggtgtataatgagtgaaccacacatgcacttcgtgaaagcctctcacagaaggaaaaggaggaaatgttttcgtggagcccctcttggtgtttctctttttcgcgtgtggcacacttttaaagttaattatagtttttaaaataccgatacatttttaatgggacaccacttggccccaaaatttgtcaccagaattttgagaccccactttaaaaagtttaatggggaaaccc

SEQ ID NO: 549865 - DNA, 329 bp, Homo sapiens
gcgagtcgtccagcaggacataggtctctacgtctggtcggagctgaccatctcctcacttacgacataccccgctcaggttccagggactggagaaacaagaaggtcctccagcagctaccagtccaggtactggtcacagtccgtcagactcaaagagaactgagaggccacaacagtcttccagacccagcaaccttaggcatctcagttgttaactccattccagcaaatcaccctgttccaggcagggcaagtccaggaagagctgccacagagtgatgccatcctaacttggccttcccatatgcgagggttccgagctcgaa

SEQ ID NO: 549866 - DNA, 295 bp, Homo sapiens
aaattgctgaaaacaggctgggtgagctggctcgtacctgtgatcccaacactttgggaagtgaagttgggcggatcacttgaggtgaggagtttgagaccagcctgcccaacatggtgaaactcgtctctactgaggatagtaaaattggccaggcatggtggtaggcggctgtagttcccgctattcgggtggttgaggcctgagaattgcttgaacctcgaaggtggaggttgcagcagtcgagattccaccactccactccagcttgggtgacaaaccagactctgtctca

SEQ ID NO: 549867 - DNA, 195 bp, Homo sapiens
aggtagctgatccgttaagctgggtactgcctagggcatacctgcctcccattctattcaaagtcatccctctgctcactgagataaagggacatctgattatctgattgcctccttgtggacagacaaatcagaaactcaaaagaatgcagcagtttgtctctcatgtacctgtgacctagaaacactatccct

SEQ ID NO: 549868 - DNA, 344 bp, Homo sapiens
attcgcggccgcgtcgacggagtttttaatagatgtctgcttactccactagagcaaagttctctatagtcagcaagtatatctttatcactcttttaaaaacattagtgtttaggctgggcgcggtggctcactcctgtaatcccagcactggccagcctggcgaaaccctgtctctactaaaaatacaaaaattggccaggtgtggtggcacgcacctataatcccatctactcaggtggctgaagcaggagaatcacttgaacccgcgaggcggaagttgcagtgagccgagatcgcaccacttcacttcagcctgggcaaaagagcgaaactccgtctca

SEQ ID NO: 549869 - DNA, 100 bp, Homo sapiens
gcctggtgtggtggttagtcgggctaacaagcgcagctggcgcggtgccgggaggcagcggtgtgcggggtgatgccagatggggctggagtgaggaacc

SEQ ID NO: 549870 - DNA, 109 bp, Homo sapiens
ctaggcttccggggctctgcagtcctcggcgtgtgctggcagcttcggagcccaccgagccgggcggctaggatgatgaaccggacgacccccgaccaggagctggcgc

SEQ ID NO: 549871 - DNA, 176 bp, Homo sapiens
tcgcgtcgcttctagtcttcgaggtcttggcagtcgtgctctcatcaaagatagatgggtcctatgcctttccatatacattttagaataagctgttacattgtgtgtgtgtcgtgtgtgtgtgtgatgacaaactccctcctgggactttctgatacgacgagttgtacttgaac

SEQ ID NO: 549872 - DNA, 1053 bp, Homo sapiens
  misc_feature (102)..(102): n is a, c, g, or t
  misc_feature (200)..(200): n is a, c, g, or t
ggagcccttatccctagatgaatgaataaatgatttgctgtaatgtttcacgtgcatgaccatttttctcaggggattttatactgagtgtttttaagtatncctctcattcttgagatttgccgttctgattctgtctggtccataacccacatagttgcaaaacagacaggttttcatgaatcaattaatatagcaanccttttgcatgtgtgtgtgattctataatttccctaacacaggagaatccagctttggcggttgcaattaaaacatgtaaaaactgtacttcggacagcgtgagagagaaatttcttcaagaagcctgtaagtgtctagaaatttctgtggaactccattgactttctatctgtgaaatccaaactgtctctgaagaaataagaaaaatagtgttttgacttttaggagacaactatgtttattattttgccttgcaaattaatgtctaaatttgtacaagcacctatctacagatttttccaggtaaaccatcatgttttatgtgtaaaggtagattgatgtgcatttactttatactttggtacttaggccattacacatctttgcactggaattggtgcagatatataagtgatcctaatgttgatgctgcccagaccccaggaatgcagaggtgagcatgacacacacagtccctgccctgatggagctcatagactagtgaaggaatagggctctatgaccattccccttgtcctgctacaaaatcagaacaaatcacccaggctgggcacggtagctcacgcttgtaatcctagcactttgggaggccaaggcaggcagatcacctgaggtcaggagtttgagaccagtctggccaacatggtgaaacagtcttctactaaaaatacaaaaaattagccgtgcatagtggcacgcacctgtagtcccagctactcaggagactgaggcaggagaatagcttgaaccccagagagggaggttgcagtaagccgagatagcaacactgcacttcagcctgggcaatagagcaatctctgcctcaaaaaa

SEQ ID NO: 549873 - DNA, 933 bp, Homo sapiens
  misc_feature (466)..(467): n is a, c, g, or t
  misc_feature (471)..(471): n is a, c, g, or t
  misc_feature (477)..(477): n is a, c, g, or t
  misc_feature (485)..(486): n is a, c, g, or t
ctcgcaggtcaatactgtagagtcctccacattgggctgccacattgctatctcctgaggtctatgattccatgaatctgtttggtccaaaagagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacnnaccnatcatnaccaggtnnctggctaccctgggtcacagggaatcacagtccatggtctggcagcatctatccagggcaggcatcgctcttggaacaacagattcagggaagtcatagacctcaggtagatacactgtggcagcccaatgtggaggactactaccagtattgaacatgcaagaggactcggggcacgcggtggccaccccacggactcacgaaccgcagcaccccgcacagccccacgaaactgcgacgacaaaatacagggccgggatggcaacacagcgacagcacgtcacgaaacccaggaaatgtgcgaccacacgacaagaaaacaacacacggagccgcatgacgtgccaccggcaacaacctagtgacaaaacacgaacagaaccccgcggtgagctccccgcgatccgcaggaccagcatacgaagaagagaaccaagacaccagcaa

SEQ ID NO: 549874 - DNA, 889 bp, Homo sapiens
  misc_feature (422)..(423): n is a, c, g, or t
  misc_feature (427)..(427): n is a, c, g, or t
  misc_feature (433)..(433): n is a, c, g, or t
  misc_feature (441)..(442): n is a, c, g, or t
ctgtcttgttcttacctatgtccgtgctttaaatgtacttgcccatttggaccaaggctattctagaatcatttcgtggagagttagaaacctgatccgtctgtccccggtgtataggatcctttattgttattatctactgttagccaactggtgttccttagataactcagggtgggttctaatgtgtgctaactctgggttgtcagctcccctaagacaatgtgttgtctctctagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacnnaccnatcatnaccaggtnnctggctaccctgggtcacagggaatcacagtccatggtctggcagcatctatccagggcaggcatcgctcttggaacaacagattcagggaagtcatagacctcaggtagatacactgtggcagcccaatgtggaggactactaccagtattgaacatgcaagaggactcggggcacgcggtggccaccccacggactcacgaaccgcagcaccccgcacagccccacgaaactgcgacgacaaaatacagggccgggatggcaacacagcgacagcacgtcacgaaacccaggaaatgtgcgaccacacgacaagaaaacaacacacggagccgcatgacgtgccaccggcaacaacctagtgacaaaacacgaacagaaccccgcggtgagctccccgcgatccgcaggaccagcatacgaagaagagaaccaagacaccagcaa

SEQ ID NO: 549875 - DNA, 927 bp, Homo sapiens
  misc_feature (131)..(131): n is a, c, g, or t
  misc_feature (135)..(135): n is a, c, g, or t
  misc_feature (140)..(140): n is a, c, g, or t
  misc_feature (143)..(143): n is a, c, g, or t
  misc_feature (156)..(156): n is a, c, g, or t
  misc_feature (161)..(162): n is a, c, g, or t
  misc_feature (175)..(175): n is a, c, g, or t
  misc_feature (186)..(186): n is a, c, g, or t
  misc_feature (387)..(387): n is a, c, g, or t
  misc_feature (413)..(413): n is a, c, g, or t
  misc_feature (430)..(430): n is a, c, g, or t
  misc_feature (469)..(470): n is a, c, g, or t
  misc_feature (475)..(475): n is a, c, g, or t
  misc_feature (521)..(521): n is a, c, g, or t
  misc_feature (530)..(531): n is a, c, g, or t
  misc_feature (544)..(544): n is a, c, g, or t
  misc_feature (927)..(927): n is a, c, g, or t
gggaaaggccggggccaagcctctaatgctttttgctcacccattttccgaaagcgaagctgaggcaagagaattgcttgaacccccgaagtggagggtgccctaaacccagatcacacccccgcactccnaccnggacnacngagcgagactccntctcnnaaaaaaaaaaaantgtgttgcctnatacgaaatgtatttggttttgttggagagtgtcagactgatctggaagtgaaacacagtttatgtacagggaaaaggattttattatccttaggaatgtcatccaagacgtagagcttgaatgtgacgttatttaaaaacaacaacaaagaaggcagagccaggatataactagaaaaaggatgtctttttttttttttnactccccctctaaacactgctgctgnccttaattttagaagcngcttactagtttacccttgtggtataaagtattcataanntggtngtgaatttggaagaatccgtctactgtattattggctaaatatttngtttatacnnaaggggacaattnattttaaggaccaaaaaaaagaaaaaaaaaaaaaaaaaaaaatatttgtgtggggcgcgcgtttggggccttggaaaaaggtttttaaacaccactctcgtgtgtggggggggggggcgcccaagagaggtgataaggcgaacagatggggcaaagggtgtgttcccaagagggaacacgcggggaccaagacaagaggggggggaggtgttttccaccacatatataaaagacgcggccggggggggagaaacccgagaggtgttctcgtagaaaaaacttcccagaagggggagtcctcgaggggggcgcaacataaggggggcctcaatacagacggggaggccccaaggagaggcgccgaattatcaaaatttacgccn

SEQ ID NO: 549876 - DNA, 849 bp, Homo sapiens
  misc_feature (382)..(383): n is a, c, g, or t
  misc_feature (387)..(387): n is a, c, g, or t
  misc_feature (393)..(393): n is a, c, g, or t
  misc_feature (401)..(402): n is a, c, g, or t
ataggacgagggtttcaaactgtctgctgagccctggggaatctgcgtggaatgggaaactagccaagtctcgctttggctgcactctgaggggtttatgtgatggcaaacagccaagatgaagaagctgcctagcagtcgctgcagcggctgcagcgttatgtgggacttcagatagcttctgagtagtcaagcagtgcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacnnaccnatcatnaccaggtnnctggctaccctgggtcacagggaatcacagtccatggtctggcagcatctatccagggcaggcatcgctcttggaacaacagattcagggaagtcatagacctcaggtagatacactgtggcagcccaatgtggaggactactaccagtattgaacatgcaagaggactcggggcacgcggtggccaccccacggactcacgaaccgcagcaccccgcacagccccacgaaactgcgacgacaaaatacagggccgggatggcaacacagcgacagcacgtcacgaaacccaggaaatgtgcgaccacacgacaagaaaacaacacacggagccgcatgacgtgccaccggcaacaacctagtgacaaaacacgaacagaaccccgcggtgagctccccgcgatccgcaggaccagcatacgaagaagagaaccaagacaccagcaa

SEQ ID NO: 549877 - DNA, 2169 bp, Homo sapiens
  misc_feature (1702)..(1703): n is a, c, g, or t
  misc_feature (1707)..(1707): n is a, c, g, or t
  misc_feature (1713)..(1713): n is a, c, g, or t
  misc_feature (1721)..(1722): n is a, c, g, or t
atgaggaacgtcacttacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacnnaccnatcatnaccaggtnnctggctaccctgggtcacagggaatcacagtccatggtctggcagcatctatccagggcaggcatcgctcttggaacaacagattcagggaagtcatagacctcaggtagatacactgtggcagcccaatgtggaggactactaccagtattgaacatgcaagaggactcggggcacgcggtggccaccccacggactcacgaaccgcagcaccccgcacagccccacgaaactgcgacgacaaaatacagggccgggatggcaacacagcgacagcacgtcacgaaacccaggaaatgtgcgaccacacgacaagaaaacaacacacggagccgcatgacgtgccaccggcaacaacctagtgacaaaacacgaacagaaccccgcggtgagctccccgcgatccgcaggaccagcatacgaagaagagaaccaagacaccagcaa

SEQ ID NO: 549878 - DNA, 1724 bp, Homo sapiens
atgaggaacgtcacttacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcaggtaggagttggcgggagagagggcctgggggtgggggcagattatgctgcttctcctccttgcagtaatagcattttaaggtcattatatcagtatgtctaaggcgaactatttttcgttcaaatgcaattacttttaaaattgatttgcatttctttgtaccttgctagagtcttaagtaaattatatctttaaaattttaata

SEQ ID NO: 549879 - DNA, 1632 bp, Homo sapiens
atgaggaacgtcacttacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagcctgtaagtgtctagaaatttctgtggaactccattgactttctatctgtgaaatccaaactgtctctgaagaaataagaaaaatagtgttttgacttttaggagacaactatgtttattattttgccttgcaaattaatgtctaaatttgtacaagcacctatctacagatttttccaggtaaaccatcatgttttatgtgtaaaggtagattgatgtgcatttactttatactttggtacttaggccattacacatctttgcactggaattggtgcagatatataagtgatcctaatgttgatgctgcccagaccccaggaatgcagaggtgagcatgacacacacagtccctgccctgatggagctcatagactagtgaaggaatagggctctatgaccattccccttgtcctgctacaaaatcagaacaaatcacccaggctgggcacggtagctcacgcttgtaatcctagcactttgggaggccaaggcaggcagatcacctgaggtcaggagtttgagaccagtctggccaacatggtgaaacagtcttctactaaaaatacaaaaaattagccgtgcatagtggcacgcacctgtagtcccagctactcaggagactgaggcaggagaatagcttgaaccccagagagggaggttgcagtaagccgagatagcaacactgcacttcagcctgggcaatagagcaatctctgcctcaaaaaa

SEQ ID NO: 549880 - DNA, 1643 bp, Homo sapiens
  misc_feature (1176)..(1177): n is a, c, g, or t
  misc_feature (1181)..(1181): n is a, c, g, or t
  misc_feature (1187)..(1187): n is a, c, g, or t
  misc_feature (1195)..(1196): n is a, c, g, or t
agcggtgggagtaatagtgtagaagaatatccagcgtagtagaggatttaagcagatcgctttgcctactttaattatatgaaataccaggaggtcagatgtttaacctctttcaacatatctgtgctcttgtcctgcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacnnaccnatcatnaccaggtnnctggctaccctgggtcacagggaatcacagtccatggtctggcagcatctatccagggcaggcatcgctcttggaacaacagattcagggaagtcatagacctcaggtagatacactgtggcagcccaatgtggaggactactaccagtattgaacatgcaagaggactcggggcacgcggtggccaccccacggactcacgaaccgcagcaccccgcacagccccacgaaactgcgacgacaaaatacagggccgggatggcaacacagcgacagcacgtcacgaaacccaggaaatgtgcgaccacacgacaagaaaacaacacacggagccgcatgacgtgccaccggcaacaacctagtgacaaaacacgaacagaaccccgcggtgagctccccgcgatccgcaggaccagcatacgaagaagagaaccaagacaccagcaa

SEQ ID NO: 549881 - DNA, 989 bp, Homo sapiens
  misc_feature (959)..(959): n is a, c, g, or t
cacgaggctccctggtgtttggcaccatagcgttgtcacttacaaccattgccttgggacacacagagtgaactgtttgagtgataagtaatttaggtagaaactttacccttaatttcaaatgataccaaacagctcattactaccccaagggacgctctccgtagcttctggattccccagtttccttctagaaacaaggactccaatagcactataaccctaaacaggccctaacccagaagaatacaccacaaaatgcgattgattttctcaaaatatcacagtcttagacactatacaaataattcaagaaaattctttctaccctgcagtggatatagtattctattatattctccagcaaaacttttaggacttttcaaactcatttctaagccaaatagtttagataaatatttacccttatatttggggggaattcaggctcaccatttgccgaggcaagcccatcaacagtctagaggcatattctgtgtcattccttcccgtctccttcatagaatactactttttccttttgtctcctggccattctccatcatctgctgattattgctaaccacaggatgctggcaaagcttacagtgataggcacatgtgttcagtgatgtccaatacactcttatcacagtggttattgcttcttactcttttcaaatgcattattctacccctcaacctacatccaatcattagaactatacctgattggagcccagaacttggggaccaatacttaattcaaataggcagggggcttgctcacaaatcatttaagcccaacaggaagcacagcactttgaaaagtcaaatagggctttggtagctctgtacatttgcaattttacatttgttagtagtttatagcactaataacacttcagtcgtgaatctacagtctcaatatgataagtcttagaacatgttctagaaanagtggtacttgctgctattatacttggtac

SEQ ID NO: 549882 - DNA, 140 bp, Homo sapiens
ttcccccgtccagttaccgatgtgaaatgaagcctgatgacggacagcgattcacgatcgatgtcctgaccgcatctactctctgcggtaaacggagagtctgagcctgcaattaggaactgtgtatattgtacggtgac

SEQ ID NO: 549883 - DNA, 112 bp, Homo sapiens
tcctgcatctagtagtgcgatctctgcgctcctgacggtgctcgctttatccatttttccaggtcctccacgtcctcctcttcttcctcccatctgtgccatcaaaggtcca

SEQ ID NO: 549884 - DNA, 888 bp, Homo sapiens
  misc_feature (7)..(7): n is a, c, g, or t
  misc_feature (73)..(73): n is a, c, g, or t
  misc_feature (91)..(93): n is a, c, g, or t
  misc_feature (95)..(95): n is a, c, g, or t
  misc_feature (97)..(97): n is a, c, g, or t
  misc_feature (99)..(99): n is a, c, g, or t
  misc_feature (101)..(101): n is a, c, g, or t
  misc_feature (113)..(113): n is a, c, g, or t
  misc_feature (115)..(115): n is a, c, g, or t
  misc_feature (117)..(118): n is a, c, g, or t
  misc_feature (121)..(121): n is a, c, g, or t
  misc_feature (140)..(140): n is a, c, g, or t
  misc_feature (143)..(143): n is a, c, g, or t
  misc_feature (146)..(146): n is a, c, g, or t
  misc_feature (151)..(151): n is a, c, g, or t
  misc_feature (156)..(156): n is a, c, g, or t
  misc_feature (166)..(166): n is a, c, g, or t
  misc_feature (175)..(176): n is a, c, g, or t
  misc_feature (178)..(178): n is a, c, g, or t
  misc_feature (181)..(181): n is a, c, g, or t
  misc_feature (189)..(189): n is a, c, g, or t
  misc_feature (196)..(196): n is a, c, g, or t
  misc_feature (289)..(289): n is a, c, g, or t
  misc_feature (297)..(297): n is a, c, g, or t
  misc_feature (329)..(329): n is a, c, g, or t
  misc_feature (332)..(332): n is a, c, g, or t
  misc_feature (380)..(380): n is a, c, g, or t
  misc_feature (383)..(383): n is a, c, g, or t
  misc_feature (398)..(398): n is a, c, g, or t
  misc_feature (482)..(482): n is a, c, g, or t
  misc_feature (514)..(514): n is a, c, g, or t
  misc_feature (559)..(559): n is a, c, g, or t
  misc_feature (590)..(590): n is a, c, g, or t
  misc_feature (884)..(884): n is a, c, g, or t
cttccgncagacacaagccttcttctcctagtctcctgagaattgtgtaaaaaaaaaaaaaaaaaatcatacntcccccgccacgcgcgcnnngngncncnctgggggtgggngngnnggngggtggggtgggggggggnggnccntcccnggggngggggggggnggtctgggnngnggnggggtgtnggggggnggcccggctgggcgggtgccccagctatccccgggggggttattccgtccttaagacttcatttccaagggcggccccagaaaagccctgacnggcagggngggccagtgatccccgatatcccattgggggnggnccccggaaacaaaatgcctggggcttctgggcggctgcggcctggggntgnggctgggcccggggngtggttgcgggggaacggctgtctccgggggggggcaaatggcgggccggccagccctgggtacgtggccacggggggggcccnggcccccggtttcaggctggccctcttgggcnggggctccctgggcttgcggtggggggggtcggggttcaaattcngggtgccaatttccgtggcacccggacccgnagacggtgaggccacgcgtggggagtgggggagtgcttgtatgtgggatgcatggagggaggctgcagtatgtggaggagaaagagaggctgttgtgggctggttcttaagacactcaaggggactcaaagggtcggctccagccatggacactatctaaggctgctcagaggagaatgctggaggagaggaagaggaagtgaaatggtgtgagaacattcttacccctataaataaactatttacacactttaagaaaaggagagccggctctcagtgaagaaccatgcccancgcg

SEQ ID NO: 549885 - DNA, 172 bp, Homo sapiens
tccctccgcttcaaggcagtgatgaagattgggcttattattaagagctgctataaaaacagcttgcttaaatgttaagagaagcccaggggtacttcaatgcattccttcggatgcttcactccatgaaagagggagttgaggcaagtcctcattactaataaaaatcagg

SEQ ID NO: 549886 - DNA, 294 bp, Homo sapiens
gaatatacaatggattaagaaagagtctataaccactgtccgttaaaatgtgaaacaacttgtcactgtactgatgaaacagattttaataccgctaacatacacagtaatgattcattcttgtttcaaacaagaggtgatttcgacttgggattgggatttttattttttgagatggagttttgttcttgttgcccaggctggagtgcaatggcacaatcctggctcactgcaacctccgcctcctgggttcaagcaattctcctgcctcagcctcctgagtagatgatggga

SEQ ID NO: 549887 - DNA, 633 bp, Homo sapiens
  misc_feature (86)..(86): n is a, c, g, or t
agaggacccccgaatcgcggttctcagcggtgcgtgttatgtacacaacatatggtcacttgtgaagtcatcaagtcaccgcagancaacgggaccacggtgtggagcagatctgtgtggatatccgacaatacggtatcattccttggaatggtttccccgggaaaaatatgttgctctgccctggagaacatcttgaaaacaaacgagttctacatgtcctatcacctgttcattgtgggctgtgcaggagctggtgccaccgtcatttgcctggtgatctacatgatggctactacatataactatgcgggtttgaagtttaagagtcgggaagattgctgcactaaattctaaattgcataaggagttaaagagagctatgctctgtagcatgaaatatcactgacactccagactaaaggagagtctaggtttctgcaattttgttacagtaatttgtaaatagcttaagtaaactcaccttgcatggtagattaataagatgacttactgtacctgaattacacaataatgagatctggtggctatttccacattttgaaaggatcagttattactgacagtggtgagcatccttttaacatatgtctatactaacctagagagcga

SEQ ID NO: 549888 - DNA, 677 bp, Homo sapiens
gcggtatagccttctctgactcagttacttgagatcaatcatggtcccaaaatattagatgaaaaattctagaaatatacaattcataagttttaaattgtgcactcgtctgagtagcctaatgaaatctcacaccatcaggaaggctcggtccttcctgagtcgtgaatcatccctttctccaggtattctgctgtaaactctactcgttcattagtcacttagtagcaggcttggttgtaggattgactgttgaggtattgtagtgcttgtgctcaagtaacctttgttttacttaataattaccccagagtacaaaaatagtgatgctggcaatttatatatgacagagagaagctgtaaagtgcttcctttaagtgaaatgtgaaagttctcaacttaataagaaaaggagagaaatcatatcctgagattgctaaaatctgtggtaagaatgaatcttttatctctaaaattctgatgaaagaaaaagaaatctgcacatactatacataaggttcggtactatccgtagtttcagacatccacttggggtcttggaatgtatcccctgaggataagggagaaccactatattcctaaatattctgagttaaagatttcttaagcagagattttatagattattttagccttttcggactcttatcatcgtg

SEQ ID NO: 549889 - DNA, 187 bp, Homo sapiens
  misc_feature (17)..(17): n is a, c, g, or t
  misc_feature (132)..(132): n is a, c, g, or t
  misc_feature (168)..(168): n is a, c, g, or t
tggcgctggccaccacntctgcggccttctggatggtggagaggaaattcgcctgccgagcccgtgcggccgtgttccttgctgtagccgaaacctggagggtgctgtgcggcctggcctgggagccccatnctgtggcaggcggggtccccagaggctgggagggancagcggcaacacggtgtcc

SEQ ID NO: 549890 - DNA, 829 bp, Homo sapiens
aataacctttagggcagtcaggtccactggagctgagagtagaagtggaggccacatgagggatatatggggacagaaaggatagtttttttaaaatcatggttctgataggaaaaacatgagcaacgcacaatatctattacatttgcctagaagcagaattttttgaggaactttaaaaaatgtacagatacctaggtcccaactttgtagactgattcaagagtgtttgggatttggtataggaacttaatagacctcacagggtgttctgatgcataatcagagctgagatcaactggagttgatgatagtgacttggattacttagtctttgctgattagtgcaacaacaacatgttctaactctgactcttgaccttttcttgaccagcccaagtactgtcacggcgtgcgttttctggttctccttgaactgttacacaaactaacactactttctaactttactacactactgcttctaacaccgttagacctagcttaacagatttcccaactattttttccacctatcccttttttaaaagcaaaaattacttacaagaatgaataaatgagatcctaaaagtgttgtcatcgcaagacagtgagccattgtcgctgtggatctctgcttttgtctttgtacctagtaattatattgcagtgtcattgaagaccacataatcttcactgaacattaaactgtgttcatctcaaagccaatctcttagtacatcaatctggctgcattctcacattagagcaaaatcattgctctcatccaacagaatccatccacctcagtgtcctataacaactcata

SEQ ID NO: 549891 - DNA, 171 bp, Homo sapiens
acggctccaaattctgcccagatgtataattttactagttttgcaatggtttgaatgaagtagacaagacatggagagtgtgattcccaagacagactgcaggttacgcctgacatcagagcatggaaatgagagatagatcagctagtgagaaaaacgacttgaggaaac

SEQ ID NO: 549892 - DNA, 316 bp, Homo sapiens
ggacttccataccacgatgtatcatactttaaaacaagtcgtaaacaatatatacaagtattatttgccaattgaaaatacatacatttaaaaatattttagatatttgtccattttggtttcaagtttacgtgcaggtcattttattgttcaagaaatactaggttgttttcggctgggcacagtggttcatgcctgtaatctcagcactttgggagcctgacgtgggtggatcacctgaggtcaggagttcaagaccagcctgaccaacatggtgaaaccccatctctactaaaaatacataaaattagctgtg

SEQ ID NO: 549893 - DNA, 417 bp, Homo sapiens
ttgtccacatcgtgctgcagagactcagtgggctttgaaccatgcctgctatctaggcaagacgcaatcaagcgaagtgcaaatgcggtgagatccacaaacaaatggcagaaactggaggctgtgacccaaacctcctggaggcggtctgcaggaggagacgacagaagaggactagggcagggaaagtccctgggaagggtcacagcccacagggtcagtgcttccagctcagcatgtgtatcatatgtaaatatgcaactgtgaaggcagactttttaaaaattcagttaaaaaaatgtaaaggttagaaaaggggtaaaatcagaaacaaagtaggacaagcatggagtggctggggctcagaggaggacaccccagaacggaggctcaggagcaaagtccctctcagatctg

SEQ ID NO: 549894 - DNA, 160 bp, Homo sapiens
ccccgggctcccgttaatgggtccataaaacccccccccccaagggggctccccttgttaaaacacccagttccaaaaagcagggggcccaacccctggcccgctgtaaaaaagggccggggcccctattgttgttgtaaaaaaaaaaattttttgttta

SEQ ID NO: 549895 - DNA, 249 bp, Homo sapiens
cgctgctgtggtcagaactccgagcttctctcctggacacagtcagttcccgtgggtgctagcttcaaactcgtacaagacttgcagttatcagagcgggcgggggcaggttgggggctggagggcctggagtcggggtccccaggctgagggtcatggttgtgtgtcgtctcctgaggaaagtgtgaggtgctccctaacctatgacttccccgccgaagggaaacagggtcctggtatcctaagggt

SEQ ID NO: 549896 - DNA, 132 bp, Homo sapiens
  misc_feature (55)..(55): n is a, c, g, or t
gacacactgccccctagcgggccaagcggggggcatccatatagtcactccaggnttacggagggttcttctactattaggactgggggcttttaagcgaaaagtcctaatcgccgaagaaccctccataaa

SEQ ID NO: 549897 - DNA, 904 bp, Homo sapiens
tattgccttgttggcggtgctgagaactgtcgggagcttcttgagaccgaggaccgtcatcccggctccaggcctctgtggactgcgtgactgttgggagcgctggccggatagcgagggactgacggggcctggcccccgggactccctgtgccttggcttggaagcttgacgccgacggctttattgcagggaactgactagatcacctttttgacgaagaagttggaaatgaattcccacatgtgtgattgaacttgaatattcttggattgaggacacgatcttgtgtgggacgatgacttgtaaggattgaacttgagtccatttaagtccccagtgacgggtggcaaagctaggcgtaggtaggagttggcaagccgatggttgtgggaaagcttgcttgcttggaggatacccaggtcccttgcagggcttgttgtttctttttccaggacaagattgcgatcagcctccaaaaatacagacctttcttagcatgcttcacctatacaactgataaacagtcgagcaaagaaaatacaagaacagtggaaaagctctataacatgttcagttgacattaggaaaattcgtacgattaaacaggatgggtacttttagaggatgaaacctatgttgaagaaattgcgaatattttacaagaactaggtgccgatgagactgctgtagccagtattttggaacgctgcccggaagcaattgtctgtagtccaaccgctgttacacccagagaaaactctggcagttggtctgcgaaacactgacgactgagttacatcacagttaagtagagcagtttccagaactctttctttactacttaaagaccaagagaaccaggacagctgaatgttcagttctttcaaggagcttgggaact

SEQ ID NO: 549898 - DNA, 370 bp, Homo sapiens
cagtatagacggggttcgccatgttggcatggctcgtctcacactcctgacctcaggtgatctgcccacctcggcttcccaaagtgttggggttacaggtgtgagccaccgcgcctggcctgtaaacagaacttttttacgtgagttgttgcccagacccctcaattaagtccagatttttaagagattttttctttaaagctctgcaagtgattccagcacacagtctggggactaaccgctgatatacggtctggaaaatctaagaaaccactctaccccaccctctggtgaccagaagcttatgtctaccagacccagggccttcccttgctgaaacatgctgggtaaactcttggtttcttcccag

SEQ ID NO: 549899 - DNA, 783 bp, Homo sapiens
tggaaaaagtcatggaggccatggggttggcttgaaaccagcttgggggggttcgatcccttcccttttttggtctaaatttatattgttatacgggttcttcgaatgttgtggtagggtggggggcactccatatagtccactccaggtttatggagggttcttctactattaggacttttcgcttcgaagcgaaggcttctcaaatcatgaaaatttaattaatattactgctgttagagaaatgaatgagcctcacagatgataggatgtccatgtggtgtatgctatcggggtagcccgagtaacgtcggggctatcccggataggccgagaacagtgttgtggggaagaaatgttacgatttacggccgatgatatatgatcagtgaaatgggatttgggcgtaggttgggtctagggttgtagcctgagaatcaggggacattccgtgaatgaagcctccttatgatggcaaatacgctccttatggatcggcacttagtgggaagtgagctacaacgtatctacgtgtcgtgtacgtacgatgtctcagtgatgagtctggctaataacaatgcccgtcctggccccctacgggtgaagaagccaggtcctgcggggcgccggatatccctggaacctcttctttgtttgtgccgccccagtgtttccccggaagttccgagcgaacgactcttcaacgtgccttggccgggggtggctctgctgttgagactagttgtccctcactcgtatcggccggcgggcgcgggaggagcg

SEQ ID NO: 549900 - DNA, 691 bp, Homo sapiens
agcctgtcgtgcttcacctggtctacctcgctagcatgtcgggccgcggcaagactggcggcaatggccctgcgccaatggccaatgtcgctgctcgtcgctgcgccggcctccagttcccagtgggcctgtgtacaccgtgctgctgcggaagggccactactgcctgagcgcgttggctgcctgtgctgctgccagtgtacctggctgtgcagtgctggagtacctcacctgctgagatcctggagctggctgggcaatgctggccctgcgacaacaagaatgacgctgaatcatcccccgccacctgcagctggccatcctgcaactgactgaggagctcaacaatgctgctgggctggctgtgactgatcgcccagggatggcgtcctgcccaacatccaggccgtgctgctgcccaagaagaccagcgccacctgtggggcctgaaggcgccctcgggctggcaatgaagtgccacccatggcctccccagtgagtactaagagttgccctgctgccgcgagccggcctgcagtgcctcccaatgccaccacaaatggcgctttttaagggtgccaccaaccgcaccctcattggaaagagcttgagccgttcagactgcggggcaatgcgggctgctgtttcgcttcaatacactaaaagaaaagcaaaagacaaaaaatagaac

SEQ ID NO: 549901 - DNA, 285 bp, Homo sapiens
ggtttgtcagggttggaaagtcccacccgtagggccccgtttccttttttagctgatgtttttggccagaaccccggggggtgttacttgctttgagttggaaacggtttgcatttacccccggaaagggattcatttttaatttaaggaagggtttttttggacgcaatttttgatttttttaaaagatggcaacaaaatttggttttttcctgttatgggggaacattaggccccaccaacccgtctttgtgtaaggaaaaataaaagggctcccggacccca

SEQ ID NO: 549902 - DNA, 154 bp, Homo sapiens
gaaatgaggaacgtcactttcattgaagactcaggtcgctgttctttgagagccatgagcagagcgtgttgtttggacaccaccactgagccaggactctggcccagggaagggattgtgttaagggtattcaccaaatttgggcacttcattg

SEQ ID NO: 549903 - DNA, 319 bp, Homo sapiens
caaaggtcagtgggtggggaagtgggagatgtagagagataggagaagaagaaggagaagcagtagcatgggaacctacaaaaatgtgtctgtaagtcaattactgatttccacatgtagttcctcctagaggagaaaaaaattagtctttcttaggatatgcagaaagacatgctagttctgccagatattaacaagtgttactagaaaaaaaaatgggacctataatcctagcactttgggaggccaaagtgggcagttgcttgagcccaggagtttgaaacagcctgagcaatgtggccaaaccccatctccacaa

SEQ ID NO: 549904 - DNA, 477 bp, Homo sapiens
tcatcttgggcctgtgttatcccactgccgctcagcccgcggtatctcaggtatccctggggttcgcccggctatcgcccgctgtcgacttcaatggacctgacggcccggccgacctcatctttatgatcgcggcctccgaagacggcggcgcggaccatatgaaacttctgaccaagctggctcgcgccctcgtcaatcctgagttcgtcgagcagttgcgtcaggcccccgacgcgcaaaccgtcgtcgacctcatcggtggggtcgtcgagccgaaggaagaagcctcgacctcatctgcaacggccctccccgctcctgggcacgccgcggtgaccaatgccgcctccgatacgccccgcatcgtcgccattacggcctgtcccaccggcatcgcccacacttacatggcagccgactatttgagggctgctgggaagaactgggtgttgagataacacaggcccaagatga

SEQ ID NO: 549905 - DNA, 848 bp, Homo sapiens
gagggcgccgggcgggcggctgagtcgccgagcgggcacatgcgctgctggccgacgtggacacgctgctgttcgatgcgacgggtgctggtggcgcggggagactgccgtgcctggcgctgcccgaggccctgcgggccgcatgcgatgccctgtgtaaagttgcctgggcttcatcaccaacaacagcagcaagacccaggctgactacgccgagaagcttgcggcgcctggcctttcgggggccccgagggggcccgtagccagcttggagggtttacgggactggcctaattgaacacggggattctaattgcgcacaagtgcttgcccggaggcccccggtcacagaggtccatacgtttgctgggaaggcacaagccatgtgcagggaacatgaaggccaggggggcttcagcaagcgttgtgctttgagtccgacccacttgctggccagagggccgctggaaaatgcagtgcaagagcgagatgagacccgaaagctggcaccggatgatagctggactatgacccgtgagagaaagaaagatgagcaaagcagggccgtggagacctgcagaacgccgacgcgggacagagggcacaagatgacaaccggaatccggtgaaaaaggcgaacaagagagacaccgaggcaggaccgaccgggagaggcgcagaggcgccggatatggaacccaggccaacgactgggccggaacgaataccgggcactacaggggacgcgtgaaaccgcaggcgcgtgcaaccacgcgccgggtcaccgggccgcaccagtgggcaaacagttgctgcgaccatgccagtgggtaggaaccaagaagcgt

SEQ ID NO: 549906 - DNA, 201 bp, Homo sapiens
cgttgcctctactattattcctcctcttggagcaattaagacctgggctaatttgctccactccaggcatatggctgacgccgtcctagcttctctagactgcctcttttatcaagattggattaaggtacctgcaatggtcagaactgtagagattttcacaagagtctagtataacccaggagaagatgagctagtagg

SEQ ID NO: 549907 - DNA, 475 bp, Homo sapiens
tacgcgggcccggcattcgtacacagtataaagtccacaatagaccagtccagggatagcgaagagtctcaggttggcgtagggatttctcaatgagactcttaatgtgtatacgctgctctacagtgttacagtgcctttggttgcatattacatcatcttcaccataatccaaggaaaccagtctcctttgtcggggttacgtcatcactgtctccagcctcaaatttgttaaagacactatctacaggtagtttctttctcttcacagaattaggctgaccaggactatgggaagcacccagtttaagacttagtcctatttttggcctatgctcctcaggttgctgttgatctggtgagttttcatgaggaataataataccacagggagactcatccccaggagtgttaggtgttgcattgccactggcagaggaaacagatggagcagagctgatgggagcaagatgcg

SEQ ID NO: 549908 - DNA, 130 bp, Homo sapiens
  misc_feature (43)..(43): n is a, c, g, or t
  misc_feature (109)..(109): n is a, c, g, or t
tcaaagaataaccacagctcagaagacgatgacgtggtcatgntgatcgccatccccttcctgctgcacacctgaccacggccatggggaggctgctcctggggcaagntctctggcagaggttattaat

SEQ ID NO: 549909 - DNA, 291 bp, Homo sapiens
  misc_feature (12)..(12): n is a, c, g, or t
  misc_feature (70)..(70): n is a, c, g, or t
  misc_feature (94)..(94): n is a, c, g, or t
  misc_feature (97)..(97): n is a, c, g, or t
  misc_feature (154)..(154): n is a, c, g, or t
  misc_feature (204)..(204): n is a, c, g, or t
  misc_feature (238)..(238): n is a, c, g, or t
  misc_feature (277)..(277): n is a, c, g, or t
attcggcacagnggcgctgacttctatggaaaccagatcaagcccaagatgttctgtgctggctaccccnagggtggcattgatgctgccaggngancacggtggtccctttgtgtgtgaggacagcatctctcggacgccacgttggccttgntgtggcattgtgagttggggcactggctgtgcttgggcccagaagccagncgttctacaccaaagtcagtgacttccgggagtngatcttccaggccataaagactcactccgaagccagcgnatgtgtgacccagc

SEQ ID NO: 549910 - DNA, 246 bp, Homo sapiens
accccttttttttttttaaaggggttccgggaattttttgcccaatttgggagggccccggttcccctggggggggggcccggtttgggtttttgttttcaaaacaaagcccggtttggggggggaatacggtttttggtttttttagttgccccgggggggttttttttttaaggggggcccccaaaaaccggttttttggttttcccggggggattggccccccgtttaaggttttttttttta

SEQ ID NO: 549911 - DNA, 203 bp, Homo sapiens
tcgggtgtctaccggacgccaacctctccctgtaagcacgatgttaccggctcccggaccccaagcaggggggagggagatacccgcaagtgtagcaagatctgtgcgcctggatacagcccgacctacaaacaggacgagcactacggatacaattcctaccagcgtctccaatagcgcgaaggacatcagggccccgagag

SEQ ID NO: 549912 - DNA, 112 bp, Homo sapiens
agcaggaagaaggaggggaaaattaaccgggcttccaacttttgtctgcctcattctaaaatttacacagtaaccatttgtcatccatgctgatcaccacaaatagttattt

SEQ ID NO: 549913 - DNA, 107 bp, Homo sapiens
acctgttccggggagcagtacagcttcagaattcatcaggaccagaaaggataaggatatttggctcacctcgttcccacagctccaccttcatcttctcatcaaag

SEQ ID NO: 549914 - DNA, 793 bp, Homo sapiens
tactcatcgcattgttcatcattttagatgtgttctacaccgttgtcgttggaccacgttcgtactgtacatgtgcggacatcgtagcaggcactcatttcatgcttggtggtacttgtgtttcattgggtggtctaaggacgacagtggtgtctcaaggaatagagcaatctctcctttcctgtgtaattgtctatgtgtgagccctgaggaggggcagagatgagttcttatatttgcaaatgtcatcattaatttataaatgagaaaatgagtcacagtgattttcagcattggtcaatattcattccttcaagatgaaaatagtgcagtttttgttttaatcattagatatgttgttcttgtaaattattattactttagagagagtgtctcactctgtcgtccatcctggaatgcagtggcatgaccgtagctcactgcagcctccagttccagctccggcgcaagcaattctcccacctcaaactcctgagtagctgggactacagatacatgccaagttaagaaaattctttttcaaatttttttgttagagacgagttctcactatattttcccaggctggtctcaaactaagcctcaagtgatcctttctcctcagtctttcaaagtgctagaattatagggggtgagccacctccactcaagcctttgtgtgcttttattaaggcaaactcatatgattgatatgggaggaatccatctaattttttataccaaaattggattttaattaattggttcctttttacccaggttattattggag

SEQ ID NO: 549915 - DNA, 463 bp, Homo sapiens
  misc_feature (31)..(31): n is a, c, g, or t
  misc_feature (79)..(79): n is a, c, g, or t
  misc_feature (120)..(120): n is a, c, g, or t
  misc_feature (128)..(128): n is a, c, g, or t
  misc_feature (211)..(211): n is a, c, g, or t
  misc_feature (435)..(435): n is a, c, g, or t
ggtaaacaaccctgtgcaagtcctctttttncagaaagcaggtggataatccttgtaaatccctcctgccttaaaaganccctcctcacagtatgtaccccctccttccagagagcaganaagggganccctttgttcccgtccttaatccttgtttccttcctaaaggctttgagcagcactgaacaaacggctaaagctgatgtttaanagtgttctgtttgggaggccgaggcgggtggatcatgaggtcaggagttcaagatcagcctggccaacatagcgaaaccccatgtctactaaaaatacaaaaattagccaggcatggtggcgggcacctgtaatcccagctactcaggaggctgaggtgggagaattgcttgaacccaggaggcggaggttgcagtgagctgagattgcaccattgcactccancctggctgacaagtgaaacaacatcaaa

SEQ ID NO: 549916 - DNA, 613 bp, Homo sapiens
ccacgcgtcggctgaatctccttaggcactctctaatcagatgtctaggtcctcccaattcttagaccttttatacctgtttttctccttctgttattccatttagtttcttagttcatccaaaacggtatccaggccatcaccaatcattctatacgacaaatgtttcttctaacaaccccacaatatcaccccttaccacaagacctcccttcagcttaatctctcccactctaggttcccacgccgcccctaatcccgcttgaagcagccctgagaaacatcgcccattctctctccataccaccccccaaaattttcgccgccccaacacttcaacactattttgttttatttttcttattaatataagaaggcaggaatgtcaggcctctgagcccaagccaagccatcgcatcccctgtgacttgcatgtatacgctcagatggcctgaagtaactgaagaatcacaaaagaagtgaaaaggccctgccccgccttaactgatgacattccaccattgtgatttgttcctgccccaccttaactgagtgattaaccctgtgaatttccttctcctggctcagaagctccccatgagcacctgtgacc

SEQ ID NO: 549917 - DNA, 98 bp, Homo sapiens
cgtattggggagtgagagggagagaacgcggtctgagtggttttcggtgctctacacgttcagagaaacttctctagtaacacactatagaaatggtc

SEQ ID NO: 549918 - DNA, 1053 bp, Homo sapiens
gcaagtgtagcctctgtgcctcgtggtcccctggcgctagccggacatctctcagggatggcggcacatgaagatctgggacttcggagtcagcgtctttgagccacccgtgggaaactagttacaagagctgcggaatgcagaaatacccaaatcctatgaacgccaagtgtggttggagttgatgtgttgtgacagagatatagatccctctggaaacggtcgcacagtcacagacttctcagcacagaggggggactgccttccattgtgaagtctcttattggtgcagcaagaacgaaaactatatgtgcacagaacgattctcgtagttgatcctgtatgagaaaacaatggacacttatactctactaatatttctactttacaagacatggtttcacgtagatgagagacttatatacaaaccaatcctcaggatccagaaaaaactgttttgacacaagaagccataattaccgtgaaaggagttagcctcagcagttaccttgaaggactgatggcaagtacgatatcctcaaatgctagtaaaggccgagaagcaatggaatgggtaatacataaattaaatgctgagattgaagaactgacagctcagcaagaggaaccataaggactccaatggcagcagcagcgtttgcagagaagtgatcgtgacagttggtagacaacatcgggtactccaggtctctccaaactgactatatatttatttgttattttaaaaatacaactatatttgcgtagttctcatgactgtagcctgtgcgaataagctgggcggtaaagggctatgtggtgacgtggattcaacaacagagtgcaggggcctcttagaattaaaggggactcactcgtgaacattaaggtggttggaaatcactatctggatttaggagggtcccagctatttctggtgaaaattcaccaagaactcctgggaaacgggtatggatatacagtctccttaagggtacgattttccaagctttgcatacattgggaactccacctgacttgggaccaacccca

SEQ ID NO: 549919 - DNA, 846 bp, Homo sapiens
ggccgaggaacaccgtgtactattagccatggtcaaccccaccgtgttcttcgacattgccgtcgactgcgtgagcccttggtccgcgtctcctttgagctgtttgcagactaggtccctaatacagcagaaaattttcgtgctctgagcactggagagaaaggcatttggttattagggttacctgctttcacagaattattaccagggttcatgtgtcatggctggtgacttcactacgcctataatgcgcgactggtggcaattgtccatctactgtgggagaacatctctgaatgatgagaacttcatcctaaagcactaactgtgtcctagtcatcgttggtccactggcaacactgcatgagatccaaatcaacaaaatgtgttcccaaggtgttatctcatctcttagcgcctgaccatagtagctgatcgcttggattggattgcgctagacgtcattgtgggtgtaatgtgcagaaagtgagagatgattactgcatgaactagtttgtgcgaagcgcccataggcagtcgcctcttgcgtggtcctatgagcacctggtcgaagtactcaaggccaccaaagggacaccatgaaatttcaggcccagtgtgggctgtgaaccttgtagagaagcgaattctcccgaacattgaaagggtctatcgcaccttttgcatggcttccatgtacttcctgtttaatttacttcaaaaacggccgaaaggggaaaaatttctcccagggtttttcccccctttgtgtgccttggttaacgacgtcccaacgtggaaagcaaggtccaaaccccgcccccttttccccctaatggcggccta

SEQ ID NO: 549920 - DNA, 902 bp, Homo sapiens
  misc_feature (32)..(32): n is a, c, g, or t
  misc_feature (850)..(850): n is a, c, g, or t
  misc_feature (852)..(852): n is a, c, g, or t
  misc_feature (854)..(854): n is a, c, g, or t
  misc_feature (860)..(860): n is a, c, g, or t
  misc_feature (873)..(874): n is a, c, g, or t
  misc_feature (881)..(881): n is a, c, g, or t
ttcccgggcagtataaagttgctgtctccttngttcgccctcgttgcgcagtagtgctagcggcttcgcggttcggtcctcgcacccggcagccgccactggtgctgagctgctaggaagcccctatcgccgagctcgttggagcttgaacccattgtcacccctccgactcaccggcccaaaaaaaaaaaaaattgggttgaagcagatcgcccaggaaagctcttcatgggggggcttaatacggaaacaaatgagaaagctcttgaagcagtattgggcaaattatggacgaatagtgggaagtactcttgatgaaagaccgtgaaaccaacaaatcaagaggattggctttggtcaccttttgaaagcccagcagacgctaaggatgcagccagagacttgaatgggaaagtcatttagatgggaaaagccatcaaggggggaacaagccaccaaaccatcatttggaaagtggtagacgttggaccgcctccacctccaagaaagtagaggccctccaagaaggtcttagaaggtgggaagaggaggacagtggaggaaccaggggacctccctcacggggaggacacttggatgacggggggatattccatgaattttaacatgagttcttccaggggaccactcccagtaaaaagaggaccaccaccaagaagtgggggtcctcctcctaagagatctgcccttcaggaccagttcgcagtagcaggggaatggggaggaagagctcctgtatcacgtgggaagagatagtaatggaggtccacctcgaagggaaccggtggcctctcgtagagaatgtaattggtcccaagagatgacgggnancnactaangacggtattcagnnggaatanccagttctggcacacaagata

SEQ ID NO: 549921 - DNA, 881 bp, Homo sapiens
  misc_feature (41)..(41): n is a, c, g, or t
  misc_feature (829)..(829): n is a, c, g, or t
  misc_feature (831)..(831): n is a, c, g, or t
  misc_feature (833)..(833): n is a, c, g, or t
  misc_feature (839)..(839): n is a, c, g, or t
  misc_feature (852)..(853): n is a, c, g, or t
  misc_feature (860)..(860): n is a, c, g, or t
aacacgaatgcaaattgacaccttgaaacgccaaacaacanctggaaccccttcgataccccggccattatggccggggctcgaagagcaatagtgctagcggcttcgcggttcggtcctcgcacccggcagccgccactggtgctgagctgctaggaagcccctatcgccgagctcgttggagcttgaacccattgtcacccctccgactcaccggcccaaaaagaaacaaatgagaaagctcttgaagcagtattgggcaaattatggacgaatagtgggaagtactcttgatgaaagaccgtgaaaccaacaaatcaagaggattggctttggtcaccttttgaaagcccagcagacgctaaggatgcagccagagacttgaatgggaaagtcatttagatgggaaaagccatcaaggggggaacaagccaccaaaccatcatttggaaagtggtagacgttggaccgcctccacctccaagaaagtagaggccctccaagaaggtcttagaaggtgggaagaggaggacagtggaggaaccaggggacctccctcacggggaggacacttggatgacggggggatattccatgaattttaacatgagttcttccaggggaccactcccagtaaaaagaggaccaccaccaagaagtgggggtcctcctcctaagagatctgcccttcaggaccagttcgcagtagcaggggaatggggaggaagagctcctgtatcacgtgggaagagatagtaatggaggtccacctcgaagggaaccggtggcctctcgtagagaatgtaattggtcccaagagatgacgggnancnactaangacggtattcagnnggaatanccagttctggcacacaagata

SEQ ID NO: 549922 - DNA, 1204 bp, Homo sapiens
tctccaaaactgtaggaacttgacttgcgttagagtgtactcttgaaaccaagctcgtctctggccggcagggagttctatatgttgtgtcgtaatcttcattcaagaaagttttcacataacggcaagacataaaactagcaagactaaactcgatatcgaaacggggtgatagcaatgggtttcctacatgagcgacatacagtcctgggaaggaggaagtcactcatgactcgcatggacgtgtggaattggtcttgccacccgggacacagggcatctgctgagtcgggctgcaatgggaaaggaacacgtaaaaacgctagtgccataccaaagagcaaaagttgctgtgataagagccaaacacgggtaacggggggaacataaggcctgccatccattggggatttttcatactgctgattgttccgcaaagcaagtattgcgtgacatttagcgaatgtggctctacacgataggtagcgtttcatgaaaactgagggttgcgttctccgaagtgaatacgcgacaagctttgttgatgtacccaagtatcctttacataatgtcagctgaggaaaatctgcattagggctcaaataggcgagttgaggtactcatacaagtccccggtgttggagaattgcttacagtcatgctggggggagagcccttaccccaggcttggagtacgtgggaaagtcgtgtcaataggggcctaggtattaggtccttcttaactataatctgggtgagattcgcgctgtggagtcggttccacccctcggcgactctgttcgcacgacagtcattttcaactagtcctaattactacatccatcttagtgtaaccgcatatagcgaaacaattaaggctctagggttacccgaaaatcttaaaggagggtcctacaagaggggcgcacacaattgggtgccggcgggtaaaggtaaaggtttgacgtttcaaaggtgtatacagaaaaagggcagcagtgccacaaggtatagggacatttcatattacaagggacaaaacaagtccagatgagtccgtttgatcagaaacagaagagcgacccggagccgatattgttgtgggaaaacagaaacgataaagtatgtataacgtgtgtaaacaacagtttacaagaattttgatcaaggggagacctagaactcctgtacacacgggtgtgga

SEQ ID NO: 549923 - DNA, 769 bp, Homo sapiens
gatcgggcctcactggcttcagggagctgaataccctcccaggcagcacgacagggtgggacacaaataagggtttcggaaccagctatttgactcatcacggacagcaagcttaaagatgcctgggaagatggtcgtgatccttggagcctcaaagtatactttggataatgtttgcagcttctcaagcttttaaagatcgagaccaccccagaatctagatatcttgctcagattggtgactccgtctcattgacttgcagcaccacaggctgtgagtccccatttgtctcttggagaacccagatagcatagtccactgaatgggaaggtgacgaatgaggggaccacatctacgctgagcaatgaatcctgttacgtcacgggaacgaacgactctgtacctgtgcagcagcaactgtgtgacatctaggaagattggacaaaccggaatccaggtggcagatctactcttttcctaaggatccagagattcatggagagtggccctctgcgacgctgggaagccgatcacagtcaagctgtccagttgcctgatgtatacccatatgacaggctggcagatagacttactgaaaggagatcatctcatgaagagtccaggcaatctctgccagcgatgcagaacaggaagtccctggcaaacccaagaactctggacaggtaccccttaacaccgggtccattgaggaatcttgggaaaaaggtccaggtcgggccgagcctcactacaccatggataacatgg

SEQ ID NO: 549924 - DNA, 807 bp, Homo sapiens
tttgaaattactcatatgatggtcttgcttctgaggcttatggtcccaggtacttagtgtggtgaataactatggtgccactgacgacgatttcggggtgcggtggggaagaacaagcataatggtatgggggaggcttgagcctgaaactaaccactgagtgaattgcactgccggtttaagcttaacgggaattccttatttggcatgtcgagcagggtagctgccaacgtgaataaacaactccagtaacatgtacttcgttttagtgtacttgtagcaggcaatataactatctacagtaagtagctttgacagtcctgcacatttgttgcactagagactatatttgctagaagatgattagctcttgcctttacttttacagatgcgttagctgtgataaacttctagtcatgtttccgtatccaagagaccagttcctataattgtacataaaccacagaaatagtataacacactatttttaaaattatccgtttagcctacttaaattttgtttagcttaagacttcttaggacatttgtcaaacgcaggttaacatttaataaggtttctgatttccgttttgtaaccggagatagttttgtacaagtgaaataaccatttccagctaagataaaacatcgctaaataagttgatattgatgaggatctgctttgtataatttctgtaaattatccttgtctgaaaaaggtgttatgccctaatatttttaaatccttatcctttgatttttttaaaaactgtacctaattgataaacactataaatttcattttca

SEQ ID NO: 549925 - DNA, 288 bp, Homo sapiens
  misc_feature (56)..(56): n is a, c, g, or t
ctccatctcaaaaaaaaaaaaaaatgggaccagaattaaataatgcccatgtagtnaaatctttcaaccctggcaaggaagatgtataataatcatctgagtgctttgggaggctggggcaggaggattgcctgaggccaggagtttgagaacagcctgggcagcatagcaagaccccatctccgcaaaaaaaaaagttaaagaaaattagctgggcttggtggcacgtgcctgtagtcccagctactcgggaggctgaggtaggaagattgcttgagcccaggagtt

SEQ ID NO: 549926 - DNA, 1088 bp, Homo sapiens
taagtaaaaacaggttttcacctttgtgggccaggcgggtctcaaactcttgacctcaggtgatccgcccacccgggttctcccaaagtgtgcgtgggatttacaggcgtgtgagccactgtgggcctgggcccccttccgtggactttaaggagtggtgacttccttcccattccagcctttcgtgtcgtgagcacatacccacccagctagaaacgtgacttgggtaactgggatctaaaaagggaggcgcgagatattggcgtggtttccagagggtcagatgggcgccagggcgcctggggctaagggcatttatgacaatgcccttgccttggcccacctggtgtcaccaccatttcaacgaggtgatcactacattcgtggggccacagagaggtgtgggccaggcggaggaaagccgtgactagaagaatacgcgtggagtgtattaactttgtggggaaggttttacacaaaagcggaatacgggggccatgtgggctctcaaagaattgggatatggaaacacttggagccccagggcacccgggacgcaggggtaattttcctggagggccctaagttacccttctacaggcgccttttcctggaccaaaaagccatgtccacattctgtgggggacgccagtgtcctcaagactccgtggcgctgggggtctaccaggcagccgcacggggctcccaaaaagggcccccttgtatataccaagtggtcggattccctaaaaccacataatcccctcttgggggccctacataatggtggcctttatcacccatttacaccgtgtttaaccaagcatggttccctcccattgtgtggcgcgagcggcaaaaaattctccgttagagtatgtacggccccccctttttaagaaaaggccccacagcgtgaacgggttcattcaacacacgaagaaacctattcgctcccaaaaaacaatgttggcttgtagcaaggtctattcgcagggacatcatccctgacatttcactgttctacacgagcggcatattttgtggccgcatgtatggcataccacgtggtgacccgacgaagacat

SEQ ID NO: 549927 - DNA, 357 bp, Homo sapiens
ccgcgtctcgcggcgcgtgtccgcggcgtatcgctgtgacccccgcacacctgtgaacatgtcgctgtgagtgtggcgcagcgtgcgggccctgttctgtaccctgcgcgcgcgcccgttacccgccgcgccctgtccgccgagagccctggcagctgggggtgggcgccgtccgtacgctgcgcactggacccgctctggtcttggtgcgtaaattcacagagcaccaatgggtaacaaccgtggcattggaacagtgggaatcagcaattttgcacaggaagcgttgggagagagtgtggtattggaggctccctgagagttgggacgtgagactctattctcctttatcaaggg

SEQ ID NO: 549928 - DNA, 385 bp, Homo sapiens
  misc_feature (248)..(248): n is a, c, g, or t
  misc_feature (287)..(287): n is a, c, g, or t
  misc_feature (312)..(312): n is a, c, g, or t
  misc_feature (319)..(319): n is a, c, g, or t
ataacgtacggcacgcgtcgacgggaagggagcggtggtcggccatcgggtctggtgtaaagtctcgatgggagtctgaccaccgctgggatgggggtaggggggatgagctggccaggagtgggataggttccagggatatggacgggtgggtgagggatggatgggccggagaggcgggcggcgggcccgctctgggttcggtggtatgaggaacgggggggagttacgcgtcccccgggaccggncatcggattcctcgggcactcctcacagacgagaccaancatacccgccagttcctcccccctncccgggngacgcgtaactccccccctcccgactcagctcagcagatcgatttgcagtgatgggtcatgcagca

SEQ ID NO: 549929 - DNA, 844 bp, Homo sapiens
ctggtcaagggctgtcattgcacataagcttccatttaattataaagtgcaaaagggcgccagcgtggctctaaaaggtaatgtgtggattgcctctgcaaaagtgtgtatatattattgtgtgaaattgcatacttggtattttgattatttttttttacttcttgggatattgggatttccagaaccacatccttgcaaacctttgtttatacgttgttaggtatttgcatgaaaataccattaagtgaagaattaccagatcgaaagtagagaaataatgctatcggaatttgtaaccaggggagggaagggaaagtttcattgtctgcatgtgatattgtgtgttataccaacttttgtatgttaaagagaatgagtccttgtatatcaaagttctgtggtacttaagtggtactaagcactggtaaacttctgcaacaagcagtgcagctttgcaaacccattaaggggaacaatgacagtctgtacctgggtcctagtaagaagacaaactggttcccttacttggctgagggtttgaataaagcctaggacttccgagctatgtcagtactattcaggttaacacctaagggccttggaaattcctgtactgtggtctcatggattgtggcactagccaaagcgaggcacccttattggcttacctccgtcagtggaggctactctccttgagtgtatgagtagccaggttaaggggtaaaaggatagtaagcatagaaagcatagaaagtgggcttaatggagttcttgtggctcagttcaatgcagttagtgaagaacttgaaaagttttcgtgggagacgtttataaagcagaa

SEQ ID NO: 549930 - DNA, 452 bp, Homo sapiens
tagttcagctacttggaggctagaggaggagaattgcttgaacccaggaggtggaggttgcagtgagcccagtatcacgccactgtactccagcctgggtgacagagtgagacactgtctcaaaaaaagaaaaaaaaaaaaaggaagaatgccggtatcatggcaggatagagggagcagatccaggttatgtccgagactgaaaagattaaaaggagtcaggggagatggggagaggtgaagcagtcattccagatacagaggcaaatagaacggaccagaatgccccctaagtagaaggaagccaaaaggcggcactgtgctgaggaccagctgggggcgcagggttcccccgatcttcaggctcaccagagttggctttagctgacagtctggctgtctatttctgccctatttcccattttattttgcctaccaaagtcgtctcaggt

SEQ ID NO: 549931 - DNA, 288 bp, Homo sapiens
ataacgtacggcacgcgtcgacgggaagggagcggtggtcggccatcgggtctggtgtaaagtctcgatgggagtctgaccaccgctgggatgggggtaggggggatgagctggccaggagtgggataggttccagggatatggacgggtgggtgagggatggatgggccggagaggcgggcggcgggcccgctctgggttcggtggtatgaggaacgggggggagttacgcgtcccccctcccgactcagctcagcagatcgatttgcagtgatgggtcatgcagca

SEQ ID NO: 549932 - DNA, 890 bp, Homo sapiens
gtacgctgtctcgccatgcctggagtgagttgtgggggacggaggcgtgtagagggcttaaggtgcttctactgggcgttggaatatttgaagcgcttcaaaggaccgatagccaagaagaaagagaaatccacatctcatacgcggctgacgatgtagcagccagaggatccatgttcgcttcgcataggattgtttcttgggggtcattttatacttcaatgtaagatagaatcaggatatctggtactcactgggccaagttaaggtacagaccgtcttcgatgttgagatgtattggccgtcagaaaattcgaactgctggaggattcgtatgcggttcatgctccttgtatttgtgattcacaaatacaatgagattcaattattgcgctaagtcttatcggggacatggtgatagagaagtgcctcaggcgcaagatgagtttcaggaaaccaattaaaatttataaagaagtggatactgctgtgtgcacgagaaattagttccaaggaatggggtgggtggcaaggtgggatgatgctgtgggggaggaattggaatgatgggggtgacctgtaaaatggggcgagatctaggaatgatcgtggagttccagatagtttagacaaataacaaaataatttctggtaggtgaagtggtgagctagaatgcgagatggctacggtggtgcaatatttcttgacatatgacaggaaaagtaaatacttcattatatggtgggctctgtgtgtggttgggacaatgtttcctttgggttgacgaagttgttggtagtaaattgcaaatcggagaaaaagggtgcggatttgggagcgtgggcagtcggaaatcaaagggggaggggtccagattggaagcgaaaga

SEQ ID NO: 549933 - DNA, 892 bp, Homo sapiens
tccaggttcagtcggacgggcgcgagaacgcttctggaatgaacgccgcgatggcttgcgcaggtagagccccaggtccagttcaacacttgtatctggttggtgatggtggtacttggaaaaacgaccttcgtgagacgtcatttgactggtgaatttgagaagacgtatgtagccaccttgggttgtagaggttcatcccctagtgttccacaacaacaagaggacctattaatgttcacatgtatgggacacacgacggccatcgagaaattcggtggactgagagatggcttattatatccaatgcccagtgtgccatcataatgtatgatgtaacatcgacgaggttacgttacaaggacttgtgcctacagctggcatacgagatctggtacgaggtgtgtgacaaaccactccccgattgatgtcgatgatggcaagcaaacgtggactaatctaagggaccgcgagacagtgagcggcgaaaagtccagcttgatcatccccaaccggaacaaggacggacacatcactatgagggtagcataacggaccagttacgagccggtggggcagagaatcggtagatacagtaagccacgagcctttgtcgggacacctcaggcacccgtatgctcagtgcttggtagtctttgtgtcgataagtagaacgatgcgctaacagcgtagtggggagagagacagcgatgacagaggatctggggatagcagatttaggcgaactgccaaaagttgatgcgacgactatctatcgggcagacccgacgcgagagaacgaggggtcgacaccgcagtatcagcgcccaggaccatttatagggagtacgtaaagcgtaggtaatagagacagccgagaccattacaagaa

SEQ ID NO: 549934 - DNA, 417 bp, Homo sapiens
ccatgatactatcatttagctgctgccagtcactgaccagttcgcctgaatgtgcggtgcgttcaccagtgggttgtcttccagcggccattcacctttcgccacccgatcaatctcaccacggatagccagcatcgcatcgataaagcgatccagttctaccttgctttccgactcggtaggttcaaccatcagtgtacccgcgaccgggaacgacatggtcggcgcatggaaaccgtagtcgatcagacgtttggcgatatccatttcgctgatgccggtctcttctttcaacggacgaatgtcgagaatacattcatgcgccacgcggtgatcgcgaccggtatacagcaccgggtaagcgtctttcagacgggtttagtttgtagtagtggcgttcaggtctaaatgcaatca

SEQ ID NO: 549935 - DNA, 940 bp, Homo sapiens
gagggaacgacatggcggttctctggaggctgagtgccgtttgcggtgccctaagacgccgagctctgtggcttcgaagctccagtggtcagcacctgcgtcatatctcaattcagttctctctcagtggaccgatcgtaatccccagcaaactgcgtgtgttatgtgcacgcaacatacacgttgtctccagatcccgccatccttggctcccaaggctgtatcgtctctctcttggactaagccgagaggggtttccctaggagttttggcttccttgggtggtcttgctctccgggtgccttatttgatactctctgtgctcttgccgatggcactattctccccctgtgcctggtgcccctctactctttccatggtcacctggcgcccttggacaagtccgctcgactgactactcgttcatgggtgatgccttgccgagaaagctgccatggcgagggcgtttggggcactttcagctttatcctttgctgtcctttgctatggctactatcacgatgtgcgcatctgcaaagctgtcggccatgctgtgggagctctgacccttctgacttcatacttcgaggaattgatgcttgcctctgtgccgctgctttgtcatgccgttacgctcccattagggagagacttcctcctaggtccatttggtggtgcagtcttggcttctctttcatcaccagattatcccccagaattcatctctggggcacaccgttgcgcggccttctctcctccgtgcggcgaccgagtcatattactgggacgttaagggggtgcccccgcgtctgttccggcccggcttctacgggtagttcggttggccccattgcccctctcgagacccttgcgcgcctgtcaaccctttccgtgaacgggggcccttctcgggaacgccgccggtttcccccctcacccg

SEQ ID NO: 549936 - DNA, 2058 bp, Homo sapiens
aacaagagcagtgccgtcccctcctcctccccccatcgtgaagaagccattgaagcaaggtggggccaaagctccaaaagaggctgaggctgagccagccaaggagacagcggccaagggccatggccaagggccagcccaaggcagggggactgtggtgcgcagctcagactccaagcccaagcggccacaacccagcagggaaattggcaacatcatccgcatgtaccagagccgcccgggccccgtgcctgtgcccgtgcagccatccaggcctcccaaagctttcctgaggaaaatcgaccccaaggacgaggctctggccaagctgggtatcaacggtgcccactcgtccccgccgatgctgtcccccagcccaggaaagggccccccgccagctgtggctcctcgacccaaggccccgctacagcttgggccctctagctccatcaaggaaaagcaggggccccttctggacctgtttggccagaagctgcctattgcccacacacccccacctccaccagcgccaccactgcctctgcccgaggacccagggaccctttcagcagagcgtcgttgcttgacacagcccgtggatcctgcagagcagaggcctggaggcgcctccccggggctggtctgtgtcactgcactccagggacgcatggcaggacttggctggctgcgactttgtgctggacctgatcagccagactgaggacctgggggacccagctcgcccccgcagctaccccatcactcctcttggctcagccgaggccattccccttgcccctggcattcaggccccctcactgcccccaggaccccctccaggtccagccccaacgctgcccagcagggaccacacaggggaggtccagaggtcagggagcctggacggcttcctggaccagatcttccagccagtgatatcctccggcctcagcgatctggaagttgttcctacgcaaggaggtgttctacccacgggagaacttcagccatccctactacctgaggctcctctgtgagcagatcctacgggacaccttctccgagtcctgtatccggatttcccagaatgagcggcggaaaatgaaagacctgctgggaggcttggaggtggacctggattctctcaccaccaccgaagacagcgtcaagaagcgcatcgtggtggccgctcgggacaactgggccaattacttctcccgcttctttcctgtctcgggcgagagtggcagcgacgtgcagctgttagccgtgtcccaccgtgggctgcgactgctcaaggtgacccaaggccccggcctccgccccgaccagctgaagattctctgctcatacagctttgcggaggtgctgggtgtggagtgccggggcggctccaccctggagctgtcactgaagagcgagcagctggtgctgcacacagcccgggcaagggccatcgaggcgctggttgagctattcctgaatgagtttaagaaggactccggctatgtcatcgccctgcgcagctacatcactgacaactgcagcctcctcagcttccaccgtggggacctcatcaagctgctgccggtggccaccctggagccaggctggcagtttggctctgccgggggccgttccggactctttcctgccgacatagtgcagccggctgccgctcccgacttttccttctctctgagcagaggagtggctggcacaagggtcagctgtccaacggggaaccagggctggctcggtgggacagggcctcagaggtgaggaagatgggagagggacaagcagaggcaaggcctgcctgagactgaggaaggaaaggggtttgaccactcccgaggctgccatgcggtgggaccaccctgctgtccgtctcctgtggctgcccctctgcccgctcctgatggctcgccttgtctctccagcaagactgtgcactccttgcaggcaggggctgggctggatgctgctcttgtgtcccacgtggtacttagttcaaggctgccccagcagatgcttaataaacagctctccactttc

SEQ ID NO: 549937 - DNA, 367 bp, Homo sapiens
tgcagtcatcagtcagaatttcagaaaagtttccttcaagtcccaaggctttggaatctgtcactaatgaaaacgcaattattcctttaccaacaatcaaatggaaacccttaattcattctccttccagaactcctgtcttggtaggatctgatgaatttgacaaatgtctcagtaatgataagttttctcatgaagaatatagtaatggtgcactttcaatcttgcagtatccatgtctggaatacaccgaaattcaaagtggccaacactgaaattccacttctcattccatgcgaggtccgacagctctacagtttttttggtacactgtagaagcagatgtctcctctgtccatcctatcac

SEQ ID NO: 549938 - DNA, 3156 bp, Homo sapiens
  misc_feature (554)..(554): n is a, c, g, or t
  misc_feature (624)..(624): n is a, c, g, or t
  misc_feature (633)..(634): n is a, c, g, or t
  misc_feature (1435)..(1435): n is a, c, g, or t
tgcagtcatcagtcagaatttcagaaaagtttccttcaagtcccaaggctttggaatctgtcactaatgaaaacgcaattattcctttaccaacaatcaaatggaaacccttaattcattctccttccagaactcctgtcttggtaggatctgatgaatttgacaaatgtctcagtaatgataagttttctcatgaagaatatagtaatggtgcactttcaatcttgcagtatccatatgataatggttattatctaccatactacaagagggagaggaacaaacgaagcacacagattacagtcagattcctcgacaacccacattacaacaagaatatccgcaaaaaggatcctgttcttcttttacactggtggaaagaaatagttgcaacgattttgttttgtatcatagcaacaacgtttattgtgcgcaggcttttccatcctcatcctcacaggcaaaggaaggagtctgaaactcagtgtcaaactgaaaataaatatgattctgtaagtggtgaagccaatgacagtagctggaatgacataaanaaactctggatatatatcacgatatctaactgattttgagccaattcaatgcctgggacgtggtggcttnggagttgtnnttgaagctaaaaacaagtagatgactgcaattatgctatcaagaggatccgtctccccaatagggaattggctcgggaaaaggtaatgcgagaagttaaagccttagccaagcttgaacacccgggcattgttagatatttcaatgcctggctcgaagcaccaccagagaagtggcaagaaaagatggatgaaatttggctgaaagatgaaagcacagactggccactcagctctcctagcccaatggatgcaccatcagttaaaatacgcagaatggatcctttctctacaaaagaacatattgaaatcatagctccttcaccacaaagaagcaggtctttttcagtagggatttcctgtgaccagacaagttcatctgagagccagttctcaccactggaattctcaggaatggaccatgaggacatcagtgagtcagtggatgcagcatacaacctccaggacagttgccttacagactgtgatgtggaagatgggactatggatggcaatgatgaggggcactcctttgaactttgtccttctgaagcttctccttatgtaaggtcaagggagagaacctcctcttcaatagtatttgaagattctggctgtgataatgcttccagtaaagaagagccgaaaactaatcgattgcatattggcaaccattgtgctaataaactaactgctttcaagcccaccagtagcaaatcttcttctgaagctacattgtctatttctcctccaagaccaaccactttaagtttagatctcactaaaaacaccacagaaaaacnccagcccagttcaccaaaggtgtatctttacattcaaatgcagctgtgcagaaaagaaaacctcaaagactggatgaatggacgatgtaccatagaggagagagagaggagcgtgtgtctgcacatcttcctgcagatcgcagaggcagtggagtttcttcacagtaaaggactgatgcacagggacctcaagccatccaacatattctttacaatggatgatgtggtcaaggttggagactttgggttagtgactgcaatggaccaggatgaggaagagcagacggttctgaccccaatgccagcttatgccagacacacaggacaagtagggaccaaactgtatatgagcccagagcagattcatggaaacagctattctcataaagtggacatcttttctttaggcctgattctatttgaattgctgtatccattcagcactcagatggagagagtcaggaccttaactgatgtaagaaatctcaaatttccaccattatttactcagaaatatccttgtgagtacgtgatggttcaagacatgctctctccatcccccatggaacgacctgaagctataaacatcattgaaaatgctgtatttgaggacttggactttccaggaaaaacagtgctcagacagaggtctcgctccttgagttcatcgggaacaaaacattcaagacagtccaacaactcccatagccctttgccaagcaattagccttaagttgtgctagcaaccctaataggtgatgcagataatagcctacttcttagaatatgcctgtccaaaattgcagacttgaaaagtttgttcttcgctcaatttttttgtggactactttttttatatcaaatttaagctggatttgggggcataacctaatttgagccaactcctgagttttgctatacttaaggaaagggctatctttgttctttgttagtctcttgaaactggctgctggccaagctttatagccctcaccatttgcctaaggaggtagcagcaatccctaatatatatatatagtgagaactaaaatggatatatttttataatgcagaagaaggaaagtccccctgtgtggtaactgtattgttctagaaatatgctttctagagatatgatgattttgaaactgatttctagaaaaagctgactccatttttgtccctggcgggtaaattaggaatctgcactattttggaggacaagtagcacaaactgtataacggtttatgtccgtagttttatagtcctatttgtagcattcaatagctttattccttagatggttctagggtgggtttacagctttttgtacttttacctccaataaagggaaaatgaagctttttatgtaaattggttgaaaggtctagttttgggaggaaaaaagccgtagtaagaaatggatcatatatattacaactaacttcttcaactatggactttttaagcctaatgaaatcttaagtgtcttatatgtaatcctgtaggttggtacttcccccaaactgattataggtaacagtttaatcatctcacttgctaacatgtttttatttttcactgtaaatatgtttatgttttatttataaaaattctgaaatcaatccatttgggttggtggtgtacagaacacacttaagtgtgttaacttgtgacttctttcaagtctaaatgatttaataaaactttttttaaatta

SEQ ID NO: 549939 - DNA, 2503 bp, Homo sapiens
  misc_feature (782)..(782): n is a, c, g, or t
ttttttagaaggaatgaatggaatgtgatgttctgtatctcacattgcatgtttttatttaatttgtatgttgttttgttgtcatttggtaagtggccttattacagttgaagctttttaaacaaagggtgcagttcaggtacttgaatcaatatatattcactcttacccctttgtatttctcccacttttagcacagactggccactcagctctcctagcccaatggatgcaccatcagttaaaatacgcagaatggatcctttctctacaaaagaacatattgaaatcatagctccttcaccacaaagaagcaggtctttttcagtagggatttcctgtgaccagacaagttcatctgagagccagttctcaccactggaattctcaggaatggaccatgaggacatcagtgagtcagtggatgcagcatacaacctccaggacagttgccttacagactgtgatgtggaagatgggactatggatggcaatgatgaggggcactcctttgaactttgtccttctgaagcttctccttatgtaaggtcaagggagagaacctcctcttcaatagtatttgaagattctggctgtgataatgcttccagtaaagaagagccgaaaactaatcgattgcatattggcaaccattgtgctaataaactaactgctttcaagcccaccagtagcaaatcttcttctgaagctacattgtctatttctcctccaagaccaaccactttaagtttagatctcactaaaaacaccacagaaaaacnccagcccagttcaccaaaggtgtatctttacattcaaatgcagctgtgcagaaaagaaaacctcaaagactggatgaatggacgatgtaccatagaggagagagagaggagcgtgtgtctgcacatcttcctgcagatcgcagaggcagtggagtttcttcacagtaaaggactgatgcacagggacctcaagccatccaacatattctttacaatggatgatgtggtcaaggttggagactttgggttagtgactgcaatggaccaggatgaggaagagcagacggttctgaccccaatgccagcttatgccagacacacaggacaagtagggaccaaactgtatatgagcccagagcagattcatggaaacagctattctcataaagtggacatcttttctttaggcctgattctatttgaattgctgtatccattcagcactcagatggagagagtcaggaccttaactgatgtaagaaatctcaaatttccaccattatttactcagaaatatccttgtgagtacgtgatggttcaagacatgctctctccatcccccatggaacgacctgaagctataaacatcattgaaaatgctgtatttgaggacttggactttccaggaaaaacagtgctcagacagaggtctcgctccttgagttcatcgggaacaaaacattcaagacagtccaacaactcccatagccctttgccaagcaattagccttaagttgtgctagcaaccctaataggtgatgcagataatagcctacttcttagaatatgcctgtccaaaattgcagacttgaaaagtttgttcttcgctcaatttttttgtggactactttttttatatcaaatttaagctggatttgggggcataacctaatttgagccaactcctgagttttgctatacttaaggaaagggctatctttgttctttgttagtctcttgaaactggctgctggccaagctttatagccctcaccatttgcctaaggaggtagcagcaatccctaatatatatatatagtgagaactaaaatggatatatttttataatgcagaagaaggaaagtccccctgtgtggtaactgtattgttctagaaatatgctttctagagatatgatgattttgaaactgatttctagaaaaagctgactccatttttgtccctggcgggtaaattaggaatctgcactattttggaggacaagtagcacaaactgtataacggtttatgtccgtagttttatagtcctatttgtagcattcaatagctttattccttagatggttctagggtgggtttacagctttttgtacttttacctccaataaagggaaaatgaagctttttatgtaaattggttgaaaggtctagttttgggaggaaaaaagccgtagtaagaaatggatcatatatattacaactaacttcttcaactatggactttttaagcctaatgaaatcttaagtgtcttatatgtaatcctgtaggttggtacttcccccaaactgattataggtaacagtttaatcatctcacttgctaacatgtttttatttttcactgtaaatatgtttatgttttatttataaaaattctgaaatcaatccatttgggttggtggtgtacagaacacacttaagtgtgttaacttgtgacttctttcaagtctaaatgatttaataaaactttttttaaatta

SEQ ID NO: 549940 - DNA, 273 bp, Homo sapiens
  misc_feature (177)..(177): n is a, c, g, or t
cgccacatctgtgttatatactgtgttcttataataaagtaagatagagaaagggaaatgttatcaaaaaagtcggaagggggagaaaatctacacactattcattaggtgggagtggggcacgatcaaggtctccatcctcgtcgtcttcacgtcaagtgggctgaggaggagcanaaggaggaggaactggtcttgctgtctcaagaacggccgtggggggggaaatccaagtattactggaggaacatgggttcacttggaaacatggaa

SEQ ID NO: 549941 - DNA, 677 bp, Homo sapiens
actctgcaagattgcaaatcattactgcactatgtctcagggacccatatgcggccgttcaacctcacgcgacttgtagagcacctggtcctagccaacttactgcctgtatagaatcagcatggacagcacatggaacatgcactgcacacacgctgcgtttgtgtcatgctaggtacctgcgcaactgaaatagatagtacacatatgtggtgtggcgtgatggactacctgtcatttgagggaagacccacctgtagggaggattacgagagactcgaaactgagaagatcattagtgtttacttttcatgtcactgagaggtacaacagagggcgccgcactatgtgactgaaccgctgtcatgagcacagtgtcaaagacacatcctttatattggtgacattgagacatgcccttaagagccaagggcagccacgtatggggtccatacgctgctatctgctgtatctaatggctgctatgctgacaggccttttgggcctactctagggcagacactgacgcagatcgccttatctcagtgccttgacatgtcacagggcgcctgacccctatggggagactggagagaatcctcccaggctcaaagataattgtcttttgttcctatcacactttaccagaacttttggtcttttggggcccgccctgt

SEQ ID NO: 549942 - DNA, 1886 bp, Homo sapiens
  misc_feature (165)..(165): n is a, c, g, or t
tttgctactggtgggcttgaaagcagttagtttattagcacaatggttgccaatatgcaatcgattagttttcggctcttctttactggaagctacattgtctatttctcctccaagaccaaccactttaagtttagatctcactaaaaacaccacagaaaaacnccagcccagttcaccaaaggtgtatctttacattcaaatgcagctgtgcagaaaagaaaacctcaaagactggatgaatggacgatgtaccatagaggagagagagaggagcgtgtgtctgcacatcttcctgcagatcgcagaggcagtggagtttcttcacagtaaaggactgatgcacagggacctcaagccatccaacatattctttacaatggatgatgtggtcaaggttggagactttgggttagtgactgcaatggaccaggatgaggaagagcagacggttctgaccccaatgccagcttatgccagacacacaggacaagtagggaccaaactgtatatgagcccagagcagattcatggaaacagctattctcataaagtggacatcttttctttaggcctgattctatttgaattgctgtatccattcagcactcagatggagagagtcaggaccttaactgatgtaagaaatctcaaatttccaccattatttactcagaaatatccttgtgagtacgtgatggttcaagacatgctctctccatcccccatggaacgacctgaagctataaacatcattgaaaatgctgtatttgaggacttggactttccaggaaaaacagtgctcagacagaggtctcgctccttgagttcatcgggaacaaaacattcaagacagtccaacaactcccatagccctttgccaagcaattagccttaagttgtgctagcaaccctaataggtgatgcagataatagcctacttcttagaatatgcctgtccaaaattgcagacttgaaaagtttgttcttcgctcaatttttttgtggactactttttttatatcaaatttaagctggatttgggggcataacctaatttgagccaactcctgagttttgctatacttaaggaaagggctatctttgttctttgttagtctcttgaaactggctgctggccaagctttatagccctcaccatttgcctaaggaggtagcagcaatccctaatatatatatatagtgagaactaaaatggatatatttttataatgcagaagaaggaaagtccccctgtgtggtaactgtattgttctagaaatatgctttctagagatatgatgattttgaaactgatttctagaaaaagctgactccatttttgtccctggcgggtaaattaggaatctgcactattttggaggacaagtagcacaaactgtataacggtttatgtccgtagttttatagtcctatttgtagcattcaatagctttattccttagatggttctagggtgggtttacagctttttgtacttttacctccaataaagggaaaatgaagctttttatgtaaattggttgaaaggtctagttttgggaggaaaaaagccgtagtaagaaatggatcatatatattacaactaacttcttcaactatggactttttaagcctaatgaaatcttaagtgtcttatatgtaatcctgtaggttggtacttcccccaaactgattataggtaacagtttaatcatctcacttgctaacatgtttttatttttcactgtaaatatgtttatgttttatttataaaaattctgaaatcaatccatttgggttggtggtgtacagaacacacttaagtgtgttaacttgtgacttctttcaagtctaaatgatttaataaaactttttttaaatta

SEQ ID NO: 549943 - DNA, 3349 bp, Homo sapiens
  misc_feature (554)..(554): n is a, c, g, or t
  misc_feature (624)..(624): n is a, c, g, or t
  misc_feature (633)..(634): n is a, c, g, or t
  misc_feature (1435)..(1435): n is a, c, g, or t
tgcagtcatcagtcagaatttcagaaaagtttccttcaagtcccaaggctttggaatctgtcactaatgaaaacgcaattattcctttaccaacaatcaaatggaaacccttaattcattctccttccagaactcctgtcttggtaggatctgatgaatttgacaaatgtctcagtaatgataagttttctcatgaagaatatagtaatggtgcactttcaatcttgcagtatccatatgataatggttattatctaccatactacaagagggagaggaacaaacgaagcacacagattacagtcagattcctcgacaacccacattacaacaagaatatccgcaaaaaggatcctgttcttcttttacactggtggaaagaaatagttgcaacgattttgttttgtatcatagcaacaacgtttattgtgcgcaggcttttccatcctcatcctcacaggcaaaggaaggagtctgaaactcagtgtcaaactgaaaataaatatgattctgtaagtggtgaagccaatgacagtagctggaatgacataaanaaactctggatatatatcacgatatctaactgattttgagccaattcaatgcctgggacgtggtggcttnggagttgtnnttgaagctaaaaacaagtagatgactgcaattatgctatcaagaggatccgtctccccaatagggaattggctcgggaaaaggtaatgcgagaagttaaagccttagccaagcttgaacacccgggcattgttagatatttcaatgcctggctcgaagcaccaccagagaagtggcaagaaaagatggatgaaatttggctgaaagatgaaagcacagactggccactcagctctcctagcccaatggatgcaccatcagttaaaatacgcagaatggatcctttctctacaaaagaacatattgaaatcatagctccttcaccacaaagaagcaggtctttttcagtagggatttcctgtgaccagacaagttcatctgagagccagttctcaccactggaattctcaggaatggaccatgaggacatcagtgagtcagtggatgcagcatacaacctccaggacagttgccttacagactgtgatgtggaagatgggactatggatggcaatgatgaggggcactcctttgaactttgtccttctgaagcttctccttatgtaaggtcaagggagagaacctcctcttcaatagtatttgaagattctggctgtgataatgcttccagtaaagaagagccgaaaactaatcgattgcatattggcaaccattgtgctaataaactaactgctttcaagcccaccagtagcaaatcttcttctgaagctacattgtctatttctcctccaagaccaaccactttaagtttagatctcactaaaaacaccacagaaaaacnccagcccagttcaccaaaggtgtatctttacattcaaatgcagctgtgcagaaaagaaaacctcaaagactggatgaatggacgatgtaccatagaggagagagagaggagcgtgtgtctgcacatcttcctgcagatcgcagaggcagtggagtttcttcacagtaaaggactgatgcacagggacctcaagccatccaacatattctttacaatggatgatgtggtcaaggttggagactttgggttagtgactgcaatggaccaggatgaggaagagcagacggttctgaccccaatgccagcttatgccagacacacaggacaagtagggaccaaactgtatatgagcccagagcagattcatggaaacagctattctcataaagtggacatcttttctttaggcctgattctatttgaattgctgtatccattcagcactcagatggagagagtcaggaccttaactgatgtaagaaatctcaaatttccaccattatttactcagaaatatccttgtgagtacgtgatggttcaagacatgctctctccatcccccatggaacgacctgaagctataaacatcattgaaaatgctgtatttgaggacttggactttccaggaaaaacagtgctcagacagaggtctcgctccttgagttcatcgggaacaaaacattcaagacagtccaacaactcccatagccctttgccaagcaattagccttaagttgtgctagcaaccctaataggtgatgcagataatagcctacttcttagaatatgcctgtccaaaattgcagacttgaaaagtttgttcttcgctcaatttttttgtggactactttttttatatcaaatttaagctggatttgggggcataacctaatttgagccaactcctgagttttgctatacttaaggaaagggctatctttgttctttgttagtctcttgaaactggctgctggccaagctttatagccctcaccatttgcctaaggaggtagcagcaatccctaatatatatatatagtgagaactaaaatggatatatttttataatgcagaagaaggaaagtccccctgtgtggtaactgtattgttctagaaatatgctttctagagatatgatgattttgaaactgatttctagaaaaagctgactccatttttgtccctggcgggtaaattaggaatctgcactattttggaggacaagtagcacaaactgtataacggtttatgtccgtagttttatagtcctatttgtagcattcaatagctttattccttagatggttctagggtgggtttacagctttttgtacttttacctccaataaagggaaaatgaagctttttatgtaaattggttgaaaggtctagttttgggaggaaaaaagccgtagtaagaaatggatcatatatattacaactaacttcttcaactatggactttttaagcctaatgaaatcttaagtgtcttatatgtaatcctgtaggttggtacttcccccaaactgattataggtaacagtttaatcatctcacttgctaacatgtttttatttttcactgtaaatatgtttatgttttatttataaaaattctgaaatcaatccatttgggttggtggtgtacagaacacacttaagtgtgttaacttgtgacttctttcaagtctaaatgatttaataaaactttttttaaattaaaaaaaaaaaaaaaaaaaaaaaaaaattttggggcgcctgggcccctgggaaaggtttttaacccctccggttgggcggcggggccatgggtattggtgaacctgtgccaaggggtcccaagagaaacctgggcggacattggttggtccccccaataaaaagccccggggaccggggggttggaacaatccg

SEQ ID NO: 549944 - DNA, 1692 bp, Homo sapiens
ctcacctcaggggtagtcgagcagatttgctggctcccacaaacttttttagcatggcaagtctccaggtttccgaggggcctgttttactgatgcatatctcagagctatacctgggctttccttctgtaatgctgagtagtttaattactcttggtgtagtagtgaagaaaagagacttgggagattaactctttgctaacatttttacacatgtacttgcatttaaaccaagaagtgactaagtaaactttgggattcaataatgctgtaatatcaactgtactgtctctgtgttaatttcttaaacttttctttatgtgggatttcagattcatggaaacagctattctcataaagtggacatcttttctttaggcctgattctatttgaattgctgtatccattcagcactcagatggagagagtcaggaccttaactgatgtaagaaatctcaaatttccaccattatttactcagaaatatccttgtgagtacgtgatggttcaagacatgctctctccatcccccatggaacgacctgaagctataaacatcattgaaaatgctgtatttgaggacttggactttccaggaaaaacagtgctcagacagaggtctcgctccttgagttcatcgggaacaaaacattcaagacagtccaacaactcccatagccctttgccaagcaattagccttaagttgtgctagcaaccctaataggtgatgcagataatagcctacttcttagaatatgcctgtccaaaattgcagacttgaaaagtttgttcttcgctcaatttttttgtggactactttttttatatcaaatttaagctggatttgggggcataacctaatttgagccaactcctgagttttgctatacttaaggaaagggctatctttgttctttgttagtctcttgaaactggctgctggccaagctttatagccctcaccatttgcctaaggaggtagcagcaatccctaatatatatatatagtgagaactaaaatggatatatttttataatgcagaagaaggaaagtccccctgtgtggtaactgtattgttctagaaatatgctttctagagatatgatgattttgaaactgatttctagaaaaagctgactccatttttgtccctggcgggtaaattaggaatctgcactattttggaggacaagtagcacaaactgtataacggtttatgtccgtagttttatagtcctatttgtagcattcaatagctttattccttagatggttctagggtgggtttacagctttttgtacttttacctccaataaagggaaaatgaagctttttatgtaaattggttgaaaggtctagttttgggaggaaaaaagccgtagtaagaaatggatcatatatattacaactaacttcttcaactatggactttttaagcctaatgaaatcttaagtgtcttatatgtaatcctgtaggttggtacttcccccaaactgattataggtaacagtttaatcatctcacttgctaacatgtttttatttttcactgtaaatatgtttatgttttatttataaaaattctgaaatcaatccatttgggttggtggtgtacagaacacacttaagtgtgttaacttgtgacttctttcaagtctaaatgatttaataaaactttttttaaatta

SEQ ID NO: 549945 - DNA, 140 bp, Homo sapiens
ccatgatcagggtcgaatctgggggtcctggtccgctccccttggactaggtgtcaagcctcaaggttaagatttcgaaaggaaattcttacgtgaaaaaaatattgctgagactttttcttctgggcccgctttaattt

SEQ ID NO: 549946 - DNA, 83 bp, Homo sapiens
gctcgacagagaagaaggtctttgggatcgtgctcccatgcaggtcctggccaacgtggctacatcatcatcgagtcccgcga

SEQ ID NO: 549947 - DNA, 1376 bp, Homo sapiens
tataaattttccatttgatagatgtacaacctcttagtcattttgttagagtatcaaaaaatattttcatgttgtatgtcaaaataaacttaataagtgatactttttttctttttagaccttaactgatgtaagaaatctcaaatttccaccattatttactcagaaatatccttgtgagtacgtgatggttcaagacatgctctctccatcccccatggaacgacctgaagctataaacatcattgaaaatgctgtatttgaggacttggactttccaggaaaaacagtgctcagacagaggtctcgctccttgagttcatcgggaacaaaacattcaagacagtccaacaactcccatagccctttgccaagcaattagccttaagttgtgctagcaaccctaataggtgatgcagataatagcctacttcttagaatatgcctgtccaaaattgcagacttgaaaagtttgttcttcgctcaatttttttgtggactactttttttatatcaaatttaagctggatttgggggcataacctaatttgagccaactcctgagttttgctatacttaaggaaagggctatctttgttctttgttagtctcttgaaactggctgctggccaagctttatagccctcaccatttgcctaaggaggtagcagcaatccctaatatatatatatagtgagaactaaaatggatatatttttataatgcagaagaaggaaagtccccctgtgtggtaactgtattgttctagaaatatgctttctagagatatgatgattttgaaactgatttctagaaaaagctgactccatttttgtccctggcgggtaaattaggaatctgcactattttggaggacaagtagcacaaactgtataacggtttatgtccgtagttttatagtcctatttgtagcattcaatagctttattccttagatggttctagggtgggtttacagctttttgtacttttacctccaataaagggaaaatgaagctttttatgtaaattggttgaaaggtctagttttgggaggaaaaaagccgtagtaagaaatggatcatatatattacaactaacttcttcaactatggactttttaagcctaatgaaatcttaagtgtcttatatgtaatcctgtaggttggtacttcccccaaactgattataggtaacagtttaatcatctcacttgctaacatgtttttatttttcactgtaaatatgtttatgttttatttataaaaattctgaaatcaatccatttgggttggtggtgtacagaacacacttaagtgtgttaacttgtgacttctttcaagtctaaatgatttaataaaactttttttaaatta

SEQ ID NO: 549948 - DNA, 1944 bp, Homo sapiens
  misc_feature (554)..(554): n is a, c, g, or t
  misc_feature (624)..(624): n is a, c, g, or t
  misc_feature (633)..(634): n is a, c, g, or t
tgcagtcatcagtcagaatttcagaaaagtttccttcaagtcccaaggctttggaatctgtcactaatgaaaacgcaattattcctttaccaacaatcaaatggaaacccttaattcattctccttccagaactcctgtcttggtaggatctgatgaatttgacaaatgtctcagtaatgataagttttctcatgaagaatatagtaatggtgcactttcaatcttgcagtatccatatgataatggttattatctaccatactacaagagggagaggaacaaacgaagcacacagattacagtcagattcctcgacaacccacattacaacaagaatatccgcaaaaaggatcctgttcttcttttacactggtggaaagaaatagttgcaacgattttgttttgtatcatagcaacaacgtttattgtgcgcaggcttttccatcctcatcctcacaggcaaaggaaggagtctgaaactcagtgtcaaactgaaaataaatatgattctgtaagtggtgaagccaatgacagtagctggaatgacataaanaaactctggatatatatcacgatatctaactgattttgagccaattcaatgcctgggacgtggtggcttnggagttgtnnttgaagctaaaaacaagtagatgactgcaattatgctatcaagaggatccgtctccccaatagggaattggctcgggaaaaggtaatgcgagaagttaaagccttagccaagcttgaacacccgggcattgttagatatttcaatgcctggctcgaagcaccaccagagaagtggcaagaaaagatggatgaaatttggctgaaagatgaaagcacagactggccactcagctctcctagcccaatggatgcaccatcagttaaaatacgcagaatggatcctttctctacaaaagaacatattgaaatcatagctccttcaccacaaagaagcaggtctttttcagtagggatttcctgtgaccagacaagttcatctgagagccagttctcaccactggaattctcaggaatggaccatgaggacatcagtgagtcagtggatgcagcatacaacctccaggacagttgccttacagactgtgatgtggaagatgggactatggatggcaatgatgaggggcactcctttgaactttgtccttctgaagcttctccttatgtaaggtcaagggagagaacctcctcttcaatagtatttgaagattctggctgtgataatgcttccagtaaagaagagccgaaaactaatcgattgcatattggcaaccattgtgctaataaactaactgtattgttctagaaatatgctttctagagatatgatgattttgaaactgatttctagaaaaagctgactccatttttgtccctggcgggtaaattaggaatctgcactattttggaggacaagtagcacaaactgtataacggtttatgtccgtagttttatagtcctatttgtagcattcaatagctttattccttagatggttctagggtgggtttacagctttttgtacttttacctccaataaagggaaaatgaagctttttatgtaaattggttgaaaggtctagttttgggaggaaaaaagccgtagtaagaaatggatcatatatattacaactaacttcttcaactatggactttttaagcctaatgaaatcttaagtgtcttatatgtaatcctgtaggttggtacttcccccaaactgattataggtaacagtttaatcatctcacttgctaacatgtttttatttttcactgtaaatatgtttatgttttatttataaaaattctgaaatcaatccatttgggttggtggtgtacagaacacacttaagtgtgttaacttgtgacttctttcaagtctaaatgatttaataaaactttttttaaatta

SEQ ID NO: 549949 - DNA, 2064 bp, Homo sapiens
  misc_feature (554)..(554): n is a, c, g, or t
  misc_feature (624)..(624): n is a, c, g, or t
  misc_feature (633)..(634): n is a, c, g, or t
  misc_feature (1435)..(1435): n is a, c, g, or t
  misc_feature (1894)..(1894): n is a, c, g, or t
  misc_feature (1976)..(1976): n is a, c, g, or t
  misc_feature (2003)..(2003): n is a, c, g, or t
  misc_feature (2013)..(2013): n is a, c, g, or t
  misc_feature (2017)..(2017): n is a, c, g, or t
  misc_feature (2020)..(2020): n is a, c, g, or t
  misc_feature (2030)..(2030): n is a, c, g, or t
  misc_feature (2033)..(2033): n is a, c, g, or t
tgcagtcatcagtcagaatttcagaaaagtttccttcaagtcccaaggctttggaatctgtcactaatgaaaacgcaattattcctttaccaacaatcaaatggaaacccttaattcattctccttccagaactcctgtcttggtaggatctgatgaatttgacaaatgtctcagtaatgataagttttctcatgaagaatatagtaatggtgcactttcaatcttgcagtatccatatgataatggttattatctaccatactacaagagggagaggaacaaacgaagcacacagattacagtcagattcctcgacaacccacattacaacaagaatatccgcaaaaaggatcctgttcttcttttacactggtggaaagaaatagttgcaacgattttgttttgtatcatagcaacaacgtttattgtgcgcaggcttttccatcctcatcctcacaggcaaaggaaggagtctgaaactcagtgtcaaactgaaaataaatatgattctgtaagtggtgaagccaatgacagtagctggaatgacataaanaaactctggatatatatcacgatatctaactgattttgagccaattcaatgcctgggacgtggtggcttnggagttgtnnttgaagctaaaaacaagtagatgactgcaattatgctatcaagaggatccgtctccccaatagggaattggctcgggaaaaggtaatgcgagaagttaaagccttagccaagcttgaacacccgggcattgttagatatttcaatgcctggctcgaagcaccaccagagaagtggcaagaaaagatggatgaaatttggctgaaagatgaaagcacagactggccactcagctctcctagcccaatggatgcaccatcagttaaaatacgcagaatggatcctttctctacaaaagaacatattgaaatcatagctccttcaccacaaagaagcaggtctttttcagtagggatttcctgtgaccagacaagttcatctgagagccagttctcaccactggaattctcaggaatggaccatgaggacatcagtgagtcagtggatgcagcatacaacctccaggacagttgccttacagactgtgatgtggaagatgggactatggatggcaatgatgaggggcactcctttgaactttgtccttctgaagcttctccttatgtaaggtcaagggagagaacctcctcttcaatagtatttgaagattctggctgtgataatgcttccagtaaagaagagccgaaaactaatcgattgcatattggcaaccattgtgctaataaactaactgctttcaagcccaccagtagcaaatcttcttctgaagctacattgtctatttctcctccaagaccaaccactttaagtttagatctcactaaaaacaccacagaaaaacnccagcccagttcaccaaaggtgtatctttacattcaaatgcagctgtgcagaaaagaaaacctcaaagactggatgaatggacgatgtaccatagaggagagagagaggagcgtgtgtctgcacatcttcctgcagatcgcagaggcagtggagtttcttcacagtaaaggactgatgcacagggacctcaagccatccaacatattctttacaatggatgatgtggtcaaggttggagactttgggttagtgactgcaatggaccaggatgaggaagagcagacggttctgaccccaatgccagcttatgccagacacacaggacaagtagggaccaaactgtatatgagcccagagcaggtgagtttttcagacctttacttactagcacagcagcagatgtacctgatgaatctcttctcatgttttcattaaaatacccagtaatctaaaacccngtaagtctgaaaattatgaaaactggcagtagtgttccagtagtggaatagtgacacagctaagatgtagtttctacaaccngaattggggctggattaagaaaatacnacacataaantgcnctnaccccctgancangcacctgacagcaaccaggaatttggaaaga

SEQ ID NO: 549950 - DNA, 419 bp, Homo sapiens
  misc_feature (308)..(308): n is a, c, g, or t
  misc_feature (335)..(335): n is a, c, g, or t
  misc_feature (349)..(349): n is a, c, g, or t
  misc_feature (384)..(384): n is a, c, g, or t
  misc_feature (398)..(398): n is a, c, g, or t
ggaggctgaggctggagtgcagtggtgtgatctcggctcactgcaacctctgcctcccaggttccagcaattctcctgcctcagcctccctagtggctgggatgacaggcgcctgccatcatgcctgactagtttttgtatttttagtagagacggcgtttcaccatgttggccaggctggtctcaaactcctgacctcaggtgatccgcctacctcagcctcccaaagtgctgggattacaggcgtgatccaccacacctggcccttgcaatcttctactttaaggtttgcagagataaaccaatanatccacaccgtacatctgcaatatganttcaagaaaggaantagtaccttcaatacttaaaaatagtcttccacanaaaatactttattnctgatctatacaaattttcag

SEQ ID NO: 549951 - DNA, 837 bp, Homo sapiens
gccctgcactcgtcgctggagctcacgggagaggatccggacagtgcatagtggggctggaccgcgaggtggtcagcggtgtacaatctgaccctgcaaggtggcggacatgtctggagacggcctcacagccactgcctcagccatcatcacccgttgatgacatcaatgacaatgcacccacgagttcagcagggatgagtacattcatggaggccatagaggccgtcagctggagtggatgtgggacgcctggaagtggaggacaagggacctgccatggctccccaaactggtgtggccaggttcaccatcctggaaggcgaccccgatgggcagttcacacataccgcacgggacccctaagaacaacgagggtgttctcgtccattgtgaaggccctggacatatgagagctgtgcaacacataacagaacatccaacacgtagtcgagtagcacgaacatgacgggccccgctagacaaggccggaattgcccataagcgggctgaagacggaggaccagggccaaagggtccgacagtagcatagatgcaaaggacaagcaaacgaaggcacccccaggataccacggaagaaaaccacaaatttcaggaaccaagaacttagcacgacaaggaggaacacccccaagaggaacatcattgggataggccaaactattctccttgaacccgggaaccccatgaaacacaagaagccaacgatggcagaagagcatcaggctaacatcacaagggaccataacgaacaccggaaaaaactggcttgcaaagatggacaccaagccaactggcccgcgatcaagaaccaag

SEQ ID NO: 549952 - DNA, 353 bp, Homo sapiens
  misc_feature (49)..(49): n is a, c, g, or t
  misc_feature (51)..(52): n is a, c, g, or t
tactctaagcagaagtaactcagaaatgacacatgtatgtctcactcgntnnaagtgagagtagctatgaggacgcaaaggcataaaaataatacaatggactttggggacttaggggaaagggtgggaggtaggtgaggggtaaaagactgcacattgggtgccatgtactctatttaggtgatgagtgctgcggcaaaatctcagaaatcaccactcactaaagaacttattcatgtaaccaaacaccacctgttccccaaaaacctattaaaattaaaaaataaaataacgtaaagtccaggtgcagtggcccatgcctgtaatcccagcactttggaaggctgaggcgg

SEQ ID NO: 549953 - DNA, 126 bp, Homo sapiens
gcactgaacttcctcttcatgtgaacctgggtattggttctctcagcactcgcatgtcgcctgctcttcatgtgaaatggtggcgtcagtggaacccccccccgcactgggaaccccccccggact

SEQ ID NO: 549954 - DNA, 715 bp, Homo sapiens
taaggtttggagggggaatgctgggagatggtaaggggtatggaaacatatcatataagtaaggtctagggtgaggggtaggaagttttttcataggagggtggttatggaagttgggtccgtaagcggaatcgggggtatgctggtgtccgaattcataaaaaaccacgggaggttaaaatgtagggttctgggtgagacaaaattattgttggtggtgaaatgttcatgggagaaatgtgtgcgtctcacatatgtgtgtgtggtctccataggaaagaatgtgtggtaggtgggtagagaggtgtgtgttatatatatatatatatataatgtgtgtgtgtggtgtgtatatctcgcgctatatgttgaaaaacatatagaggcggacacaaggggggaccgctgtgcgtgcgcgataatatctctcgcaaagatttgtgttgtgaaagcaccccggctgagagaaaactataagatgtaatcgcggggaacctcctctccccccttttctgctgcggcggcccagaaggtgcggcatctcccacaaagagggggggcggcgtcatccgaggtgtaggtgggggtctacttctcctgctggagcccacttacgtgctgcggtgacggaagacatattaaaacacatcattcccatataatattatcatggtgggggcccccacaaggggggggacctcccataatgacaacg

SEQ ID NO: 549955 - DNA, 381 bp, Homo sapiens
gaaccccctggggttaaatttaatctctccccgaatatgggaagttttttagttgcatatgaaacacccaaggaagccccggctcctatggagggacccaatggccaggatttgatggggcaccccctcagcgttgattggtgtttttttcggggtcccccaaaaggcaaaaggaaagggggccgaaaaccccccaaaagtccagaccggagaggttgctgccaggtcctttgttgtccaggggtttttttcaagattccatttggccacccacccttgggcaaaaagggctggggtggaacctgcgggggttatatttaatctctccccggaaaagggtagtatttgagttgcgaataaatgttccctttttgtttttta

SEQ ID NO: 549956 - DNA, 322 bp, Homo sapiens
gacacagaatctcactctgttgcccaggctggagtgcagtggcacgatcctttagcctcgatctgctggactcaacgatcctcccacctcagcctctcaagtagctgggaccacaggcatgcgctactgtgctgggctgattttttaattttttagagatgttatcccactatgttgcttaagttggtcttgaattcctggactcaagtgttcctactgcctcagcctcccaaagtgttggaattacagatgtaagccaccgtgcccagctctgatttacgtgtatttctgtccccttctgtcgtcttctcaaagccgtata

SEQ ID NO: 549957 - DNA, 209 bp, Homo sapiens
atggatccgtctagttttcggccgcctactagctacgtatactggcgtgcgggagaagacagacatgaaggggggttcttgggacctttagttgtgcctctccttctggatgccccgtcactgtggtcgtgcactcatgtttcccctcactaatagcatatggcgtgtgtttccaccctcgataatattaacactgagtcttgggcaat

SEQ ID NO: 549958 - DNA, 397 bp, Homo sapiens
gcagcatgaacaaggtggacactcactgacctgtcacaaggttgccccacaaaactttggggcccatgtctgaatggattgccagagccgactgatctctcccttcgcccagatgccggcatcctaagactggaatgccgcacaggacctggagaaatacatggtgtgaacagcttgtctgaggatgagaagcctgactgcctcatgcatgacgatgagtccacagtccactgcaccaacatcctcccgggcctaaatgaccagcggtaaaaagatattctatgtgacatgactttgattggcggaaggaaggattcccggtcaaacggctgtgcatgccccaagcatgaaaaattttggccggccactgtggcccgcctaaatggatgggtcgccc

SEQ ID NO: 549959 - DNA, 1034 bp, Homo sapiens
agtgccctctgtccactgctctgggccattccccaatcccccatcccattgagcccctaactcagaatctgtgcgaccaggggcccttccctacccacagctaacactcttctggaccaggagagccaacaagatacccactacctaccatgagtgctacacgacaggatggggcccagagcttgtgcacgggcactgcgcgatggcactgctgtatgctgcatggctgcctaggagaacaccacaaagtaaaggggcgtaccaggggccagcgaccgagcgctgggaacctacccctgagctaacgcatggtcgtagcacccggggtgactacaactggtaccaattggccaaagaacataacaaaggacactagtcgcaacacagggacagtaacagaagcagacgctggcaactccatctaacccagtgacacccccacgcgcaggcaaagacaaaggcctacacaaaggacaactacgcgacattgcgcgcagcctggactcccaggcgcagctaacacagccccaagaacactacagacgagacaagggcgtgacaggctacggggctgggacagactacggacgcagggccgccgctgtgcgccacgaacccaacggccaactgcagtggacaagcccaggaatgaactaccaagggcaagactgacaccatgacaaacagaagagaagaactgccgaacccaacgctagaaacagaagaaagccaaaaaggcccgaggaaagcacaagcgacacaacaccagcgcgcacactagcacacacaacaccaggctctcatacacaccacacacaacacccaaacgaagaaacccaccattccacccaacataaactaccgatataaacgcattctccacacactatcttattattctttatcactctttctactaaccaaacacaaacaaccaacacacccaactcaccacctaaccataaccaccacacacacacacacccacctcacatacgaacacaaccacataacacatcacatccacaccaacc

SEQ ID NO: 549960 - DNA, 1423 bp, Homo sapiens
  misc_feature (334)..(334): n is a, c, g, or t
tctccatttaattttttaaagggggtctcaaaatttcgtggtggacaaatttttggggccaaggtgggtgtcccattataaaaaggtacgtggatgtttaaaaaacataattaactataaaactggcgcacacgcgcaacaaaaagaaaaccaaagggggtccacaaaaacattcctccttctcctatctctgtgagagagggtcttacacgaagtgcctgtggggtatactcgattatacaccgagtctcttttatactcatactataaacacttatagagatgtggccaaaagtgtgaaaaacaagagagagtgttctgtggagacacgcgngttcttctcaccaaccaagtgtagattataagagaggtggtggggggggcgcgagggatatatataggggagatataaatatattctacattatatagcgcctctctctgtagagcgctttctcgtgggcagacgagagacactgtgtggggagcacctgtgtgtcgacagggctctcacaaagacacagcgcctctctcctgtgtgtgctcacccagcgggagtatgtgtgagagtgacaacacacccagacacgcgcgcaacagtgtgggtgctgtggtctctcaaatactatcgcacagcaacacagaggcacacagaggggacacctcacagagagtggtggggcaatgagctctgtgagagaaagagctgctctctcacacacaacacacacgaggtgggctgtgtcgcacagggagagaccacagaatatctcagacacacaatggtggacagagacatctcacgcacaagagaagctgtctcaaagagcacatgtgtgtagggcgggcccatctctgtctcccaggcgtgtctgtttaaacccccagaggcagccgggggagataatcaaaatcttgtatcccgctttttcgagcgctctcaaagcaccacaaaacttgctgcccatagtagccaaacggggtggaaaacccccagggggtgtgggcacacaactcctccaagaatacaccggagggggggagacaaaatatcaccgcgggagacgcccataaaatatggggccccgtggaaagtggtgcctccacgggaagataaatccacccctggaaaacccgagggagaaaaccccacagagtggattccccaacggggggggggggcacaccaacgataggggcggtgggaccaccacgaggaaatgctgttgcgcccagcgagcaggagaacaaactccctgagagaaccagagaagccagatctcctggtgagaacttggtgaagccacacaatagtgtgtccccacgggaaaaaaaacactagctacaagaggcccaggggggcgcatttagaaacgcaattaaacatcccagcagtgaacctatgagggggtcacaagggtgc

SEQ ID NO: 549961 - DNA, 352 bp, Homo sapiens
gggggggtttttttgggccccccaaaaagggggttttccccccccctttccccccccccccctttggggggtggggggggggggtttttcgggggggtttttttttccccgcccttttttttggccccccccccccggggttttcccccccccttttttttccccccctttcccccccggggccttttccccttcgggggtttgggttggcccttgggcgggggacccttttttccccgggggcccctttttcctttggccttttttggggtttttttttaacccggttttgggcccgggccgggttgtcccgggtttgtttttccccgggttttttgccccccggggtcca

SEQ ID NO: 549962 - DNA, 564 bp, Homo sapiens
ctcgcgatctagaactagtcgtggcacacgcccatagttccagctactcaggaggctgaggcaggaaaatcgcttgaacccaggaggcggaagctgcggtgagccaagatcaagccactacactgcagcctgggcaacagagccagactccatctcaaaaaaaaaaaaaaaaaaaagggttgggcaccgggggttcaggccttgtattcttagcactttgggagaggccaagggccagcggggtcacgaagggtcagggtggtccggagaccagccttgggccacgcttgttggaaacccttgtctctactaaaatatacaaaatttacgccagggcttgggtggcgcaccttggccttggtggatatcccaagttacactccaggaaggctggaggcgaggagaatatcccctggaaatccggggaaggcggaagtgttgcgcacgcgaagtctggagtatcttggccaatctggccctccaagcctgggcgcacacagagcaagagacttcccggtcctcacaaacaatataaaaacaacaaaatatcaaacaagaggcggg

SEQ ID NO: 549963 - DNA, 86 bp, Homo sapiens
  misc_feature (8)..(8): n is a, c, g, or t
gcccacgngaacagcctgcggggcattgtcaagcacctggaagtgatgtcagaccaggcgatcatggagctgaacctgcccacggg

SEQ ID NO: 549964 - DNA, 950 bp, Homo sapiens
  misc_feature (941)..(941): n is a, c, g, or t
tctccctgccatgtggttgacgctaagctctgcctcgtctgctacatgctagttgcgtgctgcacgctgctgggcccgtctacttggtcattgtgctcgtgctggcctatgctcgggctgtacacggcttacgaacgaatcttatagtacacatgatgtatgtacccgtgcatgccccttgtgaactccctcgtgagtgacacttcgatgcaaccgcttgtctctcatgtgttcattgtaccgttggtggcacgcagatctggcgtacaccaggggcttcggatattgcccgtctgtgtcttaatcatatggggagggttagatagagtagaagcatatgatgtcgcgtcccaggctgctattgaccgtacaatcgatcgtgactgcgaatgttctagcatatgtgtcagaaggaaggatggcgcaaataaaggtggaatccatgcttagtatcattactaccatatagtgggagtgatctatgtgggggagagctcttagaagaacacaacagaagacttggtccagttaggtggcatgctaaaaggcaccaaatgagggatctatgcagcaggatctgtacaagagtagctggggaattttgatcgggacgttctaaaaaaggagtcgttaatttttaaaaatgtttccacatcttgcttgtgggcggcctgtttggcaattgtatactcgcataacgattgaactggattcgttattagttaaaataatgatacccgtctgtggcagcttgaatttggccagctatgaaccgcaaaaaggcagaagagggtaaaaatgagcggtacaaccgcagggtatgtttgtaacattgggcaactggggtggaacggtcactaaaatttgcgacaaacgggtttgaggacatgtatgcagggaggctagataaatttgtggaaaaaacccgtatataggagctnggagttaaa

SEQ ID NO: 549965 - DNA, 140 bp, Homo sapiens
acgatagaggaacgatatgtagggggaggggacgccctaccgggcttagcgataaagggggaggcaaggaaacaggttcagagcaacctgagtgtgccgaaggacccactgacccattgggaaaatgacagtcctcagaa

SEQ ID NO: 549966 - DNA, 1268 bp, Homo sapiens
gctactcacccatattgacccctcgttccggctgaaagactgtctcgatcaagtaattattcgtcaccggccagagcgaacaccgcagtccactaactcctggcttagataggctagtcgcgtcttcatagcaaatatagcgtactccggaacaagttgaaccagtaaccacaaataggtaggacagatcacatatcgtcagtcagttaactacttcagtagactggctagtatgcatattacacctgctaggaagtagcctcactgtgccacttctgtaggtcgccagtgaggatctaacctgagaaggtcacacacctcatgtttaccatcctgaggcattgcattccattcttcgacaatgtacgaacaatatgtagcaccttcaatcctcaaatctcatataccgagacatctctccctctactcaaaaagtatagtcctaccgtccgtcaacatcctttctcagaattctatagtccacttcgaataagacaggcgccagtatgaccgcgtgggaatgtgatgacgcaatagtctccgaagctacggaccaaaaagtaccgtataagtccttactacttctcaagttaccccagccataggtagtggactagatagctagtgtcctactccgttaacataccatacacaataaatcgaagttcctttatatcttacacagttaatcaagtgagtttaattccctgaaagcataacttgacggctgtagttcctttacatacattcgagacctttttaatcctctcaagcaacactacggatgctctaaataattgattcttcaagcaacccttgaaaatctaaagcttagaccagttgaattaacaaccgctttaaattccaatccaaaccttccttctccccttaagagagagccttgacccccccgcataaaccgggctttttttgccccaaaaagtggggccattattccgaaaagaattttcaccaagaagaaccaataagccttcattcattccccagccaatcattaagccaccattcaacccttccctctaagactttctaacttttctaagcttaagccccttaattcctaattccaaccttcaattcacacgttactcccccattattttatccaacggttaacaactaaatgtacagtgtggaacattttgaaaaaacctacacccattcttccccaaagtcattgccccttaacagctatcccctacgtgttttttcccctttatatttaaaacaacagaaaacaaaacacc

SEQ ID NO: 549967 - DNA, 437 bp, Homo sapiens
gagggagccggggctgggagttctcctgagggaagaggagctggagtaacgggggacgcggcgtgcggcgtggacaaatgagtatacttggacggctttatcggtccaagtattgtgagatcgatattgtacttaatgatggggaaaccaggaaaatggcagaaatgaaaactgaagatggccaagtagaaaaacactatctcttctatgacggagaatctgtttcaggaaaggtcaacctagcctttaagcaacctggaaagaggctagaacaccaaggaattagaatcgaatacgtaggtcaaatagaacttttcaatgacaagagtaatactcatgaattagtaaacctagtgaaagaactagccttacctggagaactgactcagagcagaagttatgatttcgaatttatgcaagttgaaaagccatatgaa

SEQ ID NO: 549968 - DNA, 210 bp, Homo sapiens
tttgctcagaaactaggcttggtcgatggactgccctccagttcaggcgacaggccatgcctttcaagtgcatgcagctcactgactttcatcctcctagtttccgctactgtgcccacctagaagtatgtccgacaacgcctggcagcaaggccgtacttcaagaactccatgtcctgctccggggctaccgagtctcgtacacttcgt

SEQ ID NO: 549969 - DNA, 542 bp, Homo sapiens
  misc_feature (484)..(484): n is a, c, g, or t
  misc_feature (488)..(488): n is a, c, g, or t
cagaaatttaccttttaataaattaaaaaatctaaattttaacctacttgtatgttcggagagtgtttttgtactatattgactacttaaaatagagaatgagactaagaagggaacatttctgttgatacatgttttttaaaagtaattttaagagcattattaggttaatttaatccaattaatgacccaaatgccaaggtaattttaaatttacatttttaataaaagcaacatgttgaaacaagagagggtgagattaacctttttgctaaagtaatttacaagtcaaagacaggaagagatcagagtgaatgtgccttcttaaccagagctacagaatttagtgaataattaaagtaccaactgctttgacctccttgaacttttccaagcaatttctctgtacttctatatatgaatgtcttagccaattttctgctactataacagaatacgacagactgggtaatttaaaaagaanaganatttattttcttcctagttctggaggctgcgaaggcgaaggcatggcactgaca

SEQ ID NO: 549970 - DNA, 867 bp, Homo sapiens
tgtggtggctcatgcctgtaatcccagcactttgggaggccgaggcagacggatcacgaggtcaggagatcgagaccatcctggctaacacggtgaaaccccatctccactaaaaatacaaaatcttagccgggtgtggtggcaggcacctgcagtcccagctactcgggaggaaaatggcatgaacccaggaggcggagcttgcagttgagccgagatcatgccactgcactccagcctgggtgacagagcgagactccatctcaaaacaaaatatttataatgataataataatggttcttctttcacacattatcagaacctaagtctgagagatccaaaaatgtacacagcgttgtataaatctctttattaactgtgggaaatgacacacctagttgtaaagcaaacgggatcaccatacttacacgaaacatattaaccccaccagcttaacagtgctgagtacctatgtaactgagagtcctcaagaccgcaacatactcacaatgctaaaaacttttacaccctaaatacatacccatttacgtgggatctttcgataagcacctatttgaaggcacgcaaccctttaagccagtccatatcgaatacaatggccagactgagggtcgtgtcctcgggggggcacaaacgactagaaacatggcccgccggacagtctggctttaacaagctgacttcaggtgactggttccttagtcggtataacttttagccctcacattgctacctttccatctttggcaacgaatgttactgcatcaattcttaacccgcatctgcacattcgtcactagtaaaggttaagacgcatgggtacagcacacctggtgcttatcacg

SEQ ID NO: 549971 - DNA, 226 bp, Homo sapiens
  misc_feature (20)..(20): n is a, c, g, or t
  misc_feature (23)..(23): n is a, c, g, or t
agaagacagccgcacaacgntcnccggcccaaaaacaaaggcggtgcaagaaatcaagaggcttccttggggatgaagacccccgaggccccggccattctgaattacacaactgcatcattgacaaagaagtttcattaatggcagaaatggataaagttaaagaagaagccatggaaatcctgactgctcgtcagaagaaagcagaagaactaaagaagactcc

SEQ ID NO: 549972 - DNA, 138 bp, Homo sapiens
acacctgcacgggcatgagcctggagggaacactcaccgtgccgggcacgggagctggggggacactcaccgtgccgggcaccttgagctggggggacactcaccacgccgggcaccgggagctgggggttacgagct

SEQ ID NO: 549973 - DNA, 384 bp, Homo sapiens
cataatctatatattattttagtgtttattcaatttaacaatgcaacattagcagacattccatagatatagaaaatacataccacatgcacatatatgtatatatgtatgtatgtgtatttacaaaacttccctctcaagaagataaatattgattcaaaaaggccctttactagctttgggagtgcagacttaagggaaggtagaagccacatgcttcatgatgcaacacactctatgagtcatcaaaactcatttactgtttaatcagaggtacatgttgaatttttaaaacatcttcccagtgttatttttgtttccttttaacaatatggtggattacattaacatctcctaataataaataattgtttcaaccctaaa

SEQ ID NO: 549974 - DNA, 210 bp, Homo sapiens
ttgctaggactacaatgtgtgtgccatcacgcttggctaatttttgtatttttacgtagacgatgaggcatcctcccctatctttctcttccttctgcctcccccgtgcccccagctgctattgtcactgtctctaatgggaatacgcctgggtttgttgcttctctatctgtatttagctgcagtgatcctttacctggtggaagggag

SEQ ID NO: 549975 - DNA, 340 bp, Homo sapiens
atggctagttctgactactaagaaatgttaagaaataggccaagtgcggctgcacgcctataatcctatcactttgggaggcctaggcaggcagatcacctgaggtcaggagttcaagaccagcctggccaacatgaggaaaccccatctctactaaaaagacaaaaaattagctgggcatggtggcatatacctgtaaccccaactacttgggtggctgaggcaggagaattgtttgaacctgggaggcggaggctgcagtgagctgggattacaccattgcattccagcctgggcaacagagcaagactgtctcaaaaaacaaaacgaaacaaaaaaa

SEQ ID NO: 549976 - DNA, 499 bp, Homo sapiens
gtaaccaccactgtactcacaattccgccctgccagcaggttccctcgttaccccctttatgatcaatctcctcgctgacccctctgcaactggcaactgctgattggtttcctatttatagttctgctttttctagaatgttctataggtagaattatatggcctttcacaacagacttctgttacttacaaaaaagtttttgaggctggatgtggtggctcacgcctgtaatcccagcactttgggaggctgaggcaggcagattgctcgagtctgggagttcgagaccagcctgggcaacatggcgaaaccctgtctccaaaaaaatatgaaaaagattagctggggcatggtggtgcacacctgtggtcttcagcttcttcagggagactgaggtgggaggattgcttgagcccaggagacagaggttacatcaaactgagattgcaccactgtactccagcctgggtgacagagtgagatcatgtctcaaaaaa

SEQ ID NO: 549977 - DNA, 252 bp, Homo sapiens
ctgcgttgtcgtgagcagctggaggttgcagtgagccatgatcgtgccactgcactccaacctggtgacagaacaagactccgtctcaaaaaaaaaaaaaaaaaaaagggtaaattggtggctaaaaacccatttccccatttgtccccgggtcccgaaaaaattaattttccccaaaacctcccagggaaattatggtgggcatagggtgctttagaactaagctcttcaccattttttttcctccatgga

SEQ ID NO: 549978 - DNA, 295 bp, Homo sapiens
ccccctagcagtgggataaggcgtcgcgatgccctctatattcagtgcaaaaacgtgctgaagatccgccggcgtgagtgatgaaccaccacaagtaccggaagctggtgaagaacgacgcggttcctgcggaggacggtccaggagggacgcctgagatgcacgccagatcaaggatcgagaaagacctgaggcgcatctggctgaaggcgggccttaaggaagcccccgaaggctggcagaccccccaagatctacctgcgggggcaaatgagtctggcgccgccctttccgg

SEQ ID NO: 549979 - DNA, 819 bp, Homo sapiens
  misc_feature (388)..(388): n is a, c, g, or t
atcgaggaggctgaagaggacgatgaatgaataagaagaagagatgatggtgccaggcatggaaggcaatgaggagcctggactctgacagtggtacaacagcggtggtggccctgatacgagggaagcagttgattgtagccaacgcatgatgattctcgctgtgtggtatcgtcgaggcttggcgaaagctttgatgacagtgtcctatgatcacatagacctagaggatgacagtacgagactagcacgacacgagaatgctggtgcgcgaggctcactcgtggagtgggcgagatcagacgggggtctcaagcctctccaggagccattggggaccacattttatcacgagaagacaagaaccgtgccgagcgtgaggaacagnatgatttgcagtccttccgtgactagtcaatggtgcttgactctcgactgagcagaggcatgcaattcaatggatcattagccctgtgtagtggcgactctggaatgtgactcgagcagccaggagagtggtatgatttcgattcaattcgagagatcagcgcagtcgtgatgataaatggggagcttcgggtagtgtcatccattgtggacgagctgctggatcagtgcctggtgccagacagttctggggatggtacaggctgtgacaacattgagctgcactcatcatggtgcttcaagcccctaaacagagtagagtctccaggcagagagtgggaagcgaaaactacgaggaggtgctcgtctactgagggggctgatgaagatggtgacaggacctaaaatatgaggcacgaatagagtatcgac

SEQ ID NO: 549980 - DNA, 277 bp, Homo sapiens
cgcagcagacacagcacagtagaagtgataatagaaagaagagcattttgatacactaaaaaacagatgctcagtagagacatttaaccttctatttatattattaaacatttaatcatacagtaccttcctacaggatcactggctaatcctgtggtggggtatatactattagaggtattactccccattataactatttccctatatatgcgaaggatcagagctgttcattttctggagaggaaaactgattttgcaagttagagcagctact

SEQ ID NO: 549981 - DNA, 514 bp, Homo sapiens
ttgtgtgtcctaaagcagttgtaaactcttaacactcaatttgagaaagtacaattaattaagaaaaggactagtctaaaagtaggaggttctttgtatatgtaaaaacttgagaagtttaaaaacactttttttatccgaaaattttattagctggtattagataatatccttcatcattttcaaacttatgtattttaatggcttaactaattatctattttttaatttttgtgggtacataggtgcacatatttatggggtatatattttgatacaggcatgcaatgtgaagtaagtacatcatgaaaaatggggtacccatcccctccagcatttatcctttgagttacaaacaaaaatactctaagttatttaaaaatgcacaattaggccaggtgtagtggctcatgcctgtaatcccagcgctctgggaggctgaggcgggcagatcacctgagattgggagtttgagaccaccctggccaacatggagaaaccccgtctctactaa

SEQ ID NO: 549982 - DNA, 437 bp, Homo sapiens
  misc_feature (26)..(26): n is a, c, g, or t
  misc_feature (360)..(360): n is a, c, g, or t
  misc_feature (389)..(389): n is a, c, g, or t
aaattcggccacgagggctggatttnagggagagccataagaaaggataggttatccatggacttggaaaatgggagttttttaactgatcccatgtgtgggtaaaagacccaagttgtggccgggtgcagtggctcacacctgtaatccccagcatgtcagaaggctgaagcaggcagatggcttgagtcccaggagtttaagaccagcctgaccaacatggtgaaacctcatctctaccaaaaatacaaaaacttagctgaccgtggtggcgcgtccctgtagtcccagctacttgggagtctgaggcaagaggatggcttgaaccccggaggtggaggttgcagtgagccgagattngccactgcactccagcctgggcaacagangtgagaccctgtctcaaaaataaagtagttgaaaaaaatattgtccaa

SEQ ID NO: 549983 - DNA, 124 bp, Homo sapiens
atcacgctgactcttcctcttcgtcctcctcttcatcatcctccggaccctccggcatcggtaccagatcctcctcctcttcagaatcggtggcctcctcctggtcttcttcctcctccttaag

SEQ ID NO: 549984 - DNA, 150 bp, Homo sapiens
ccggtcgttctagaggatcccacccacctgctgcagggtgctggcccactctggcagccagatacagctagattgtaatatttaaggtcgaatttcgacctgtggtacacaggctgtgttgtggcttcagtcagcaacctcagcaatctg

SEQ ID NO: 549985 - DNA, 166 bp, Homo sapiens
ttttttttagatggagttttgctgtcgtcacccaggctggagggcatggatgcaatctcagttaacaacaagctccgcctggaaggttcaagtgattctcctgcctcagcctcctgagtagctgggattacaggcaaccacacccagcggaagtatgtagacggcc

SEQ ID NO: 549986 - DNA, 1094 bp, Homo sapiens
gccttcaggcatctcaatcgctgactcattacacgtgatgctctagtgttcagtgtgctctccgctccaaccacactttcaaattttaggttgcaacaccaaccgttacccctgcagatttctctcgaaaatttccttgcctggatagtgtcctcagctatatgagtggtgatgatggattctgtgtggttcgacgacgcaatcgctcactatgtgctacctattgattgagcaaatgaggacgtctgcgcgtgcgtaaatgatactcacatatggcatgacagaactccatggctgtgatgtcaagtaggcgatgacgacttggcatgagttcctgaattctatgatgcccctctgctcacgttacgcatgggctagttctctcactaccccttggcgtctagtcatgtcactcacaacgaaagcaaggccacctggagcaagtagccgccgtgaggagaccgatggacgagcagaactttcctgtggaggtgccttgacctaggcacttgacgttagcgttgaacacgatcgacgcgtaacttctaattctggatgtgagactgaacgagttgacaattaggcctgagggatcacattattggtcttgctacctcatgttaggtgcgtctctgtcacgacaggggttcattaaaagccctttcttatccgacaggctcttattactcaataccatatacacgcttggattccttcaacttggtaattaaatcacgtcctcagtgtgcagttgccctgttatgagtgcgaatgtgagaactgtgttgagaagatggtccgagttggatgctagataatgtgttgagaagaatcttaactaataagaggggttatcgtgtgataagagcatcggttctcgggtctagagaacgctgaaggccccaagttgagtggacgttgttgaaaagtggttgtccgggtactggatgacggagattggtttgtgtggggcaagggggggtagaaaaggccatgggaaaggatcctttggtcatttgcctgagtcttgggggttgttgaataaaacgacggagataaggggggcatcttttggagggggcgagggtttgggg

SEQ ID NO: 549987 - DNA, 255 bp, Homo sapiens
ggcaggttcagaaaggagcatacagaacgaatcctgaagacatctaccccagcaagcctactgatagatgacgtgagcagcggctcctccagtagaaaggagcagcacttcagtgaggttacatcttattacacctatttctactgtcacaccccatcccagaacgaagacagtccctgtgatcaccgcactgcacagacagtaatcccttgctaccagtacaggagcataaatcacttgtgcttcccaataaac

SEQ ID NO: 549988 - DNA, 180 bp, Homo sapiens
  misc_feature (2)..(2): n is a, c, g, or t
  misc_feature (96)..(96): n is a, c, g, or t
  misc_feature (115)..(115): n is a, c, g, or t
tntggtacccatgtatgtctcccactaacacatctactaggacaacaggcagctgaagaacatctggtgtgaccatcacttggacagaattagganctggttctggaccaagtgngtaaggatgcggaaggattgcaatgcccgcagcacagtggcggcaacattgaaccggatagcttg

SEQ ID NO: 549989 - DNA, 784 bp, Homo sapiens
gcggaggcggaggagcaggcgcgtggacgcggccgaggcctcgatggtctcgggcgggggcgcagcgttccggggtgcgcgcggtgctgtgggtccgttggtctgcgacggtcggattcttgagtctttcgtcatttacgggggcccatcgtgggttacggcgttagccccgtggtgttcgttgatgcctggggctggtccgctattacgtgaggtcgctactgtgtaaggctagggcgacgtggacgggtggggttgtacagatgattcggtgacgatgaggaatagatatggggtacgactttggagaagtctcttagatggattggactactcgtttgatgtttcatggtggttggttgtaccatgatgtttgggtaacagagtttagccgtagtggcagaaatcttgaagcgtcttcatagagtggtgactgaatttttggtgactattgcctaatgatttgtacctacagtgtgcttacaatcgatagaggcgtgccatgtagtagctattgcttggcgtttgaagaaggttatggcggttacctggaagtactgacgtgttaaagttggaaaggacagggttatttttaattagcaacccaggggggaaaggcctaggttggactaaacggttggaacgagatatgtatttgtactataatgcatatgagaacgttccaaagaaaaaaaaatactaatccgtagcagtaaaataaagaaacaacggaatgagaacagacaataagtattatacagaggagaaagaacatacagaacga

SEQ ID NO: 549990 - DNA, 277 bp, Homo sapiens
taaaccagatagttgatcaccctccctgagagtttgggattctatgaggactcctgtctagagtgcagcgccactgcgagggtggtcctttattgtcagaaacctcattcccagaaggagacatgcagtggaaactgagcgtcctctgccctgcggtgcccagctccattcaagaaagcacacctgtggatgagaggcgcaattaacgttatcagtcgtgaagggtcagaaggaaaacccagtggccgttgggaatttagagatggtgtttcgccat

SEQ ID NO: 549991 - DNA, 216 bp, Homo sapiens
gacgggacacagatcgcactcagtgtccgctttatgtgagcaagactcatcctttaacagaatgacacgagcagttctcaataacgactaataacaaattcccactgaatgccaaacatgtttcaatcaacattacctcaggacggaaacatcgcatgctctcaagtcaggagtgttgtgagagacgttgtgggggtacccgcagcctcggaaatt

SEQ ID NO: 549992 - DNA, 313 bp, Homo sapiens
ctctaccggatctttactgcatccgaacaggaggtgtaggttcagtgagctgaaaactcaccactgcatatccagcctgggcaagaagagtgaaatccatcttggctgggcacggtggttcacgcctgtaatcccagcactttgggaggccgaggtgggcagatcatgaggtcaggagatcgagaccatcctggctaacatgatgaaaccccgtctctactaaaaatacaaaaattagctgggggtggtggtgggcgcctgtagtcccagccgctcgggaggctgaggcaggagaatggcgtggacccgggag

SEQ ID NO: 549993 - DNA, 386 bp, Homo sapiens
tgtgtgtcaaagttctcaccttcctggtgtctggcgcttccgcagcttcttcttcttagagtaagcctcagtaaaatgttttggaatttttacattgctgatatcgatttgggttaatgtgccaatgcacaaatttctggtgtgttcttcgtagaggacctcgattaaggcccagaggtccattcccaagtattaagccactagccagttgcttcaggaaacccacctctcttgcccctgtggcgtccagtgagaatgatcagaatggtcccgggggtaatgctggctcacagttttctcacgtgctgactaaagggtttttccccgtggctcaaccgctttcgaggcacatcctcagtagtataatctctcgtgccgtctcctac

SEQ ID NO: 549994 - DNA, 459 bp, Homo sapiens
ggttctttgaggacatctgacttcaaagggaaaaaattcataattcagacaggctctcggggcttcaccatacaacgcctttcttgtatttggttagttttatgggcctggagtgttgaccatgtattaattttctctataaaaatcagaaccgctctgggcagacccagaatttatagtatctgtggcagtctggcagagagtagggaccctcagccatgagtcctcgcctcacttgtaacgagtaccccataagtgatcccaggtgtctggggatgctttaacgcacccagatcccaccttgctcttggcgcctcctaattacacaccatgagcggcggcggcagaggagaactgctgggaggaccgaggaggatccgcctctcgtgtagaagaacagactgtattaaacagtgattatggccatgcaggcacaggaagacctgacctcatggaatc

SEQ ID NO: 549995 - DNA, 477 bp, Homo sapiens
agtcttgttgcccaggctggagtgcagtggcgttatctcagctcactgcatcctctacctcctgcagttcaagtgattctcctgcctcagcctcccgagtatctgggattacaggtgcccgccaccacgcccaactaatttttgtatttttagtagggatgggggttcaccatgttggccaggctggtctcgaactcctgacctcaggtgatccacccacctcagcctcctaaagtgttgggattacaggcgtgagccaccatgcccggccaccagaagagctcttacagaaattattccaacacccttagttcttccagaaaaggaatctggtctagaaaatttaaatgacttacccaagatcacatggcaatgctaggaccagatgtgagacagccttttctgacaccatacttcctgtcttagttctcaactgcagtaccatcagttatcttttgacattaccttaagaatccc

SEQ ID NO: 549996 - DNA, 968 bp, Homo sapiens
  misc_feature (40)..(42): n is a, c, g, or t
  misc_feature (79)..(79): n is a, c, g, or t
  misc_feature (115)..(115): n is a, c, g, or t
  misc_feature (138)..(138): n is a, c, g, or t
ggaggaggggccgctaggggcagaaagatttagttttggnnngccttcgcgatctgaaccctcatctggggcacattgnaaactacaagccaccagggaaggttcccaccttggnaccacacaaaatcgccaacctgnaaacttaacaccagtggacacttccgttgttggaacagaagatagtattggctgaacctacaggaaaggtcaaaaaacttcatcagaaattcaaaaaaagaaactatgtataaagtacattaaaaatgctaacaatgtaattttatcttcagttatactttgatacaggaaagtgtcaaaaaacatcacacattcagaaaaagaaactaggtataaagtacattaaaaatgctaacaatgtaattttatctttcattatactttgatacaggaaagggtcaaaaagcatcagaaattcccaaaagcaaactagatataaacgtcattaacaatgctaacaaggtaattttatcttcaattatactttgatccaggaaagggccaaaaaaacatcaccaactctctaatcacaacctatgcgttacagtccctgtacccggggccccccttggccaccctctttacccctccataccccacatggatctcgccgccctccccgcgcgccgctcttcagagccgtcacctttcctgcggggcacattattcgccccccgccagttccctccgccaagccgcggggcgacggcccggcccgaaaaggcacgagcccgccctcgggcgggcgccccgcagttccctacgcacctcgcgcctactcgcgacgcgtacaccgatactctcgcccgagaagacgagcgatggacccagttgccacgtattggcgtcgggagttccggcgctggcacagagccggttcacctgccactgcctcttttttcccgatgtatccgttcccccgccctctacttgtcaattaccaccgacaa

SEQ ID NO: 549997 - DNA, 159 bp, Homo sapiens
ccaggctctctacctcggtgtatcagattgggttagtgctcaataaagtttttagaaaaaatttaaaaagggccagggtgcagtgactcaggccggtaatcccagcacttggggaggccgagaggggtggatcatctgaggtcaggagtttgagaccag

SEQ ID NO: 549998 - DNA, 210 bp, Homo sapiens
atacaatcctgaggtgtaaggggatccatgcccaggtagtcagctcaaatgatctctgcatcatcttgaggtgggaggccggaaaaggagcgccaataaggttccctgcaacccccgccctccagcccaccgcccaaccttatacaaatggcatttacttaattgcaaatccgggaagcaggtgcgggaaatgggaactgcaggtgcaat

SEQ ID NO: 549999 - DNA, 130 bp, Homo sapiens
ccgatggcgaagtttccgatggcgaggaccaaactcaggacaccgagcttgtggagaccagaccagcaggagatagaaccgtccagaagtgggcagctgtggtggtgccttctggagaagagcagagata

SEQ ID NO: 550000 - DNA, 327 bp, Homo sapiens
  misc_feature (34)..(34): n is a, c, g, or t
  misc_feature (51)..(51): n is a, c, g, or t
  misc_feature (175)..(175): n is a, c, g, or t
  misc_feature (234)..(234): n is a, c, g, or t
  misc_feature (269)..(271): n is a, c, g, or t
gccgcggcgaaacaaggcaaatgtcccgtggttnctgcgcgcccagcattnattacccccggaagcccgtgaagtggcggatctactgggttttacccatcaccgaatgtgatgaatcgatcccggtaacggcgtccgtgcccgccagcgtgccagccgacaaaaccgaaagccnagcatccgcgaaaccatcattgcccagctgccggaaggccagtttaccgaaagcctggntccacagctgatggaaaaagtgatgaaggaaaaannntcgctggagcagggcgcaatgcagccgagcttcaaatcggtgaccggcaaaggcgg

SEQ ID NO: 550001 - DNA, 190 bp, Homo sapiens
gtttaaactgagaaaatggcctatgcttaaaaggaaaatgaaagtgttcctggggtgctgtttttgaaaaaacagagtttcattacctgtattgtagccccaatgtcattatgtaattattacccagaattgtttttccataaaggttgggcctttgtccaagctaaacaataaaatttttaagtagtgc

SEQ ID NO: 550002 - DNA, 514 bp, Homo sapiens
  misc_feature (1)..(1): n is a, c, g, or t
ntggtgctgaaaaaattatattctgttgattggggtggagagttctgtagatgtctattaggtccgcttggtgcagagctgagttcaattcctgggtatccttgttgactttctgtccgttgatctgtctaatgttgacaggggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacataatggggtatcctaataccccattatgtggaaaaagcaaatcacagtaaattttaaatagggta

SEQ ID NO: 550003 - DNA, 246 bp, Homo sapiens
atatatttggggggacaagtgcaggtttctaaacatgcatatattgcatgcatagaggtgaagtatgggctttttttagtgtgcgcatcgcccaaatagtgaacatcatacccaataggtagtttttcaaccctcaccctcctcccaccttctcacctttcatagtctccgatgttttttattccactctatatgtccatgtatacccattatttagctcccacttataaatgagaatatgccata

SEQ ID NO: 550004 - DNA, 139 bp, Homo sapiens
tctaggacagtggaacgactaagtgactctggaaatgcagtcatgcactggcctcattgtggtcatggcatttaaggtgcaaatagccacggttgtgtcatttttctcgcagtgcaccattccagctgcaccaggtact

SEQ ID NO: 550005 - DNA, 749 bp, Homo sapiens
gtggctgatttgcgttcagttgatgcagagtggggttttgcagttcttatcaaaaaaaaaaaaaaaaaaaaaaaaaaaaaaatgtgtgtgcgcgcgcgcgcgcccgcgcggcccctcgcgaaagaagctttctacaagaacacacaccgcgcggtggggcgcgcgcgcgcgggccaccaggagggaaaaggggaaacagtgggcgccaaagacgcgtgtttctccataagagagaacaccgcgggcgccgagagaacaagagggcgcggaggaatctctcctcaccccaaatataaaaagagcgccgcgcggggggacaacacgcagagaggtgtctctcggagacacacaaacacactcccgagagagagaggagagtctctcgagagagagcgctccatatatacgagggggggagcactctatatacacacacaagagggggagagtcccccaaggaggagagacgcgccgtcgagaaaatatcacactacagaatatattattaccgcgcgcccccgcgtacacagccgggggggggggggacccacccaacaaacacaaaaccacaagaccaagaaacaacaaaaatccaccacacaacccacctactactccaccaaaacaaaaaacacaaacaacagaccaaaccaccacacacacaacagcgatcccacaacaagccaaaaacacaaccaacaaaacaaaccaaaaaaaaaccatacaccaccggccccacccgccccccc

SEQ ID NO: 550006 - DNA, 946 bp, Homo sapiens
  misc_feature (679)..(679): n is a, c, g, or t
ttgctgtaggtcgctgtgccccacacaaggttttgtgggggcacccccccagtgcgcggcgttcgccctctgagttccaaggggtttcccttcctggcttccgcccccctgggggtcaagatccttgtcccctcctgggcgcaaatacttccccgtggatttggcggctcactattggcctttcgcgggccacccttgtcgcgccagaatgtggatccccccccggggtttgcggattccggcccctccattggtccccccccaatgctttttgagcgcggctatggacctgagatggccgtaccccccttttgtgccccaaccttaacctttccccccaaccccaaatggaaattcgcccggcccttatattttttttttttttttttttttggtttttttttttttttggccttgacctccggaattttaaaactggcaccggtgaaggtgaccacgcccgtccggttggacgccgagccatcccccccaagttcccccaaagtgcgcccgaggacctttgattcgccaccatttgttgtttcttttaaatagtcactttcccaaatattgaagatgccgcttgttaccacggaaagttccctctgccactccttaaagcccacccccacctttcttcttctaaggaggaatgggcccacgttcctcctccccagtnccaccacccggggaggtgatagcccttgctctttcgctgtaaattatgtaaagcccaaatttttttaattcttcccctctaatacttttttattttgttttattttgaatgatgagccttcgtgcccccccttccccctttttttgtccccccaccttgagaatgtatgaaggcttttggtctccctgggaagtgggtggaaggcaggcccgggcttaacctgtaccctgacttgagacccagttgaataaaagtgcacccccttta

SEQ ID NO: 550007 - DNA, 131 bp, Homo sapiens
caaggttacgcactttagactcacaggctgtgctccgctgctccgcctcagcagcagcaactcctcgttggtggtcttcagtctgccctcccccttctccacctcctaacgcaggctcggatctgggcctg

SEQ ID NO: 550008 - DNA, 695 bp, Homo sapiens
taagatacccaagatatgaaggccaccagtgtccaacagaaggtcaatttctctgaagaaggagaaagtgaagaagatgatcaagacggctctcacacgcagtgtcactactgttaaggccagatccaggggattctgactgaatctggcacataagaagccgagccaggatcgatctagctcgaactagtatagaatcatttcgggagtcatcactagaagtcgaagaacgttcgacagctctatgagtaagcgaacgttcgagcgctaagctcgaggatatcagaaagaactccccaggagatgggccccacaaactgcaagaataaggaccaggatgcaagaatgacagcattctgagaatcagagcttggaaaccagtcaccatcagacctccagtcgcgagcaagtgagctggacgaccccaaaatgcatctgttgtcaagaggaaccggtggtggctacttcctctgatagcatagcgtcttgcctctgggagtttatgggtctttagatactcctgaggtagaaaccacgtgctgttcaagagttccagaaccagatgaatcaccttaagaagtaagtaccaaggtccagatgacgaagctgtggcaaaggagccaaacattcctggaaaaaacatcttaatagctcccatcctcggtctcagctgctatcttactgtcaatgttgcc

SEQ ID NO: 550009 - DNA, 728 bp, Homo sapiens
aagcagtggtatcaacccagagtgcccattacggccggggtaagatatcagactagggagaaggaggaagaaggagaagaaagaggagaagaaggaagaacgaacggacgaacggaccgaaccgaaaacacacgacggacacgaacggacgaaccgacggggaccgaaacgaacgaacggacgaacgaacgacgaaaccgaaggacgcgacgaggggaggaagacacgacggacacggacacgaacgaccccggacgaccgaccgacacacgacacgaccccccgcgacacgaaggaaggagaacgactgacaggacaacaggaccaagcgacggatacgacgaacctgaaaccgaagaacgaagacaggacgaacggaccgaccgacacaccgcgagaacctaagaagcgaacgacaggaaccggaaaccgcacaggagaagaagaaagaactaagaagacgaaggatcacgggacacgaagacgaaaaacggaaccgaagaacgcaacctacttaggaacaacagaccggaacagaggcaagaaagaaccgcgacacccgaaaggcaccgcaagcaaccagagggagggacaaacgaaccgacacacgacgacacgaacgaaacacgcgacacaccgaagcaaagaggaaaggaacgaaccaccccggaccgcacgagcgaacgcaaaggcaacgaacgcaacggcaacacgaaccgggccccgac

SEQ ID NO: 550010 - DNA, 316 bp, Homo sapiens
tagtaggtgtcaatattttacataaagatctaaatttccgacttctcttaaaaaaaaaatcagaagatcttagcatactggaccagaaagactacttggcaacatctggctgaagctgtggggtgggagtgttgaggggggtgtggatggtgcacttttcctagtcatctctggatcaaaactggctctagtttgccagtgttcccaccactccctatagttttatactcactcatatccattacctgctttgtcctcgtattacagtatttacattactgacctgcaagaagttactagcagtcagaaagcctga

SEQ ID NO: 550011 - DNA, 789 bp, Homo sapiens
ggaattcggaaattgctctagactcatggtaagtatatcgtaaaatacatatgtactaagaattgtcaataataggttggtgcagtgtggagtatattcagcagtatttttgacattctgcttgagaacaaggaagagctaaaggaatattataagtgtggtcagatgacaaggttgaaatattgaggtggttgaaagtgaactggctgtttgcgcatgatatgggtaaaggctaacaagatcgtacagagttgagtagtcattcaggtttctcctgttgagatattgtgtagtgccctggcacttgttctgaggtgagaattctttggcagtgtgacgaaatctggatacactcaattgatttacgagagctaacagttactttatgcccattgtgctataatttgttggagaacccacaaccaatattggaagtttccaatgccctttaaagaaaaaattactcgcttatataaaggagaaatcagtgggtgatcagcgaagatgctatggggtgcgtcttgtccaaaagttgatatataaacagctttgtctaccccgtcgatacgacaatgagtacgcatatggagtgcctgtgcattgtgaatctactggcagattcatcattcatttccagcatgttctagtgggaagaagcgacttccatttgagaagtaggtgctgtaacattattcctggcatatggaatacttgtgtacatgcttgtctcattccaagaattcggtaatcacgcatcgaaggccgagatttttgagggtggggtgtccc

SEQ ID NO: 550012 - DNA, 418 bp, Homo sapiens
gcggccgcctactactactaaattcgcggccgcgtcgacaagctgagaaagcctggcctagtgacatattgagccaaatatttactgtgggaagttgtccctgtgcattgtaggaaaagttcagcatgcactacttgcgttctacttaactatgagcgccagctagggaccacgttccacctatgatgtgactaaccaaataatattctacactattgcgcaaatgtcctcctggggaagagagggtacaaaaccatcccccagttgagaactactgcttcgggccacagctaaaaccaaatgtcaggtatgtgaaggttcccttgcctttcagggccatgctaacagtcagtgcctgactttaccctggaaggcagctgtggcctgataaaggcaaatgtgttctcattcaaaacaa

SEQ ID NO: 550013 - DNA, 291 bp, Homo sapiens
  misc_feature (103)..(103): n is a, c, g, or t
agtcgggtgactctgaggatcccagaagacactcgggtcaatcacagatcgttggttgcatggaagacctggagtttattctcagagcagtgagaagccactnggaaagttgtttttttgtttttctgtttttgagacagagtctagctctgtcacccaggcagactgcagtggtgcaatcttggctcactgcaaactctggctcccaggttcaagcgactctcctgccccagggcccccaggtagctggggactacagggcacacgccaaccaacacccaattcaaattt

SEQ ID NO: 550014 - DNA, 198 bp, Homo sapiens
cctttttgggtggggggttggccccccccccccccccgggggggcctttcccttttttcggggttttttttgggggggggggggggccccccccccccggggttttttggtggccggggggggtttggggggggccccgggttttttttttccggggggcccccctgggttttttgccccccccccccccctggggga

SEQ ID NO: 550015 - DNA, 790 bp, Homo sapiens
  misc_feature (1)..(1): n is a, c, g, or t
  misc_feature (9)..(9): n is a, c, g, or t
  misc_feature (790)..(790): n is a, c, g, or t
ntctactgntttgcggatgcgcgcctagtgttggtaccatacgattcggccctatggccggggggggggtgtttatgtacagggggggtgcccacctttcaaaatcactgttgcccatatgccacacatgtttcaacgcttctacgcggatgcacttaactcttattatcaccatctaagtcacctcccccggaagaggcagcatctgaccgtcagacatgcctaccttttatgttaaccagctcacactcagacctagcatccgcaatgctgatctccagccccttgacataaaccagtttctatctaccttagggcacaacccaaccttcctcatgtacatggtccgactataccagataaagccacctcctaccctgaatctattcactaactggaccacggcaacagattcctctatccataacaaggaccctctaaactagattccatatccacaccacgggcaacaaactctaggcccgatcagcctatccattttagccagcacctataaaaatttgaatgatcacctaaaaagtcctaatgaactaacttgacactgaaccaatcgccttatttttctatgtacttcaaactcctccttactctgatggacacactaacctaacctactgctaaatgatctcccaacgctatggaaacatctaactgaaaggtttgcctacacccaccgatttcaggatgagccttaaaaatacaggaatgtgagggtgtcctgtgggtcgactaaaacagcctgtatctgagttatcttgcagcccaattn

SEQ ID NO: 550016 - DNA, 1204 bp, Homo sapiens
  misc_feature (18)..(18): n is a, c, g, or t
  misc_feature (20)..(21): n is a, c, g, or t
  misc_feature (44)..(45): n is a, c, g, or t
  misc_feature (47)..(47): n is a, c, g, or t
  misc_feature (515)..(515): n is a, c, g, or t
  misc_feature (1059)..(1059): n is a, c, g, or t
  misc_feature (1070)..(1070): n is a, c, g, or t
  misc_feature (1072)..(1072): n is a, c, g, or t
  misc_feature (1078)..(1078): n is a, c, g, or t
  misc_feature (1084)..(1084): n is a, c, g, or t
  misc_feature (1108)..(1108): n is a, c, g, or t
  misc_feature (1122)..(1122): n is a, c, g, or t
  misc_feature (1147)..(1147): n is a, c, g, or t
  misc_feature (1159)..(1159): n is a, c, g, or t
  misc_feature (1204)..(1204): n is a, c, g, or t
tattttgggttagccttncnntgttcttttctctatttcgtctnntntctacacgaggtgaatctctgtgtcttatttaggtgcgggggcgtctaggtgttgttgtgagcagccacgggagaggaagcgatgaccgaacagaggacgagaagcagggaataacgcgacaaccacttaacaacacagtatagttcaaggtgcgacctagcgccaatgcgatagattaagaaataccaacctatttccatacacgatgatagaaatcccactctcttattgtatataaacatagatcgaggtgaaaatactgtagaggaagagtaggcgggcgccgcggtcccggaggatgcgcccgttcgatacgatacaacgtacccgaccctcgccgcccttatacatgtacgtagtattgttctctttcgttttgttataatatttattatttaaatttgattgttcattcatactgtatattatgtttccgttagatattaattaagagcgcagcagacacncacagcagcgaagagacacccagaagacaaagaaccataaccaagcacgcccatgagagagaaagagtcatccggtctcttattgctgccttcttcgattctctattcatattcatacgacaaactcataacatacttatacggctatcacttttatgtcatacattctctatatattcacctatcacctatattgtttagatctttacattccttttagttgctatgttcttatttatacagttaacttaaattatacctacatcaaatttataatatatttcaatttacaatacaatgacagtgatcatactatgatgtaggcacgggatgcagcgtgacagcgtctcgctgacttacttatcaataaccaataactacactatatagtagatttacagtacatcatagagaatcaatgtattccgttgctcatatcgaatatgatctttagttacagcgaagaagattatgtgagcactgagtgagagtgagagtagtaagaagttgtgtgcgatgcgtgtgtgggctgtagttgtacgtngcgttcacgtngngtgtgngtagtngcgttcgcgtgtgcacgtctcgantcgtatgcggaagnaacgatgcgtagagcgcgcatgaantgcttagagacngagcagctccgtcattgcatagtgagtgctcgtctcgtggattgn

SEQ ID NO: 550017 - DNA, 369 bp, Homo sapiens
  misc_feature (249)..(249): n is a, c, g, or t
  misc_feature (284)..(284): n is a, c, g, or t
  misc_feature (294)..(294): n is a, c, g, or t
  misc_feature (318)..(318): n is a, c, g, or t
  misc_feature (329)..(329): n is a, c, g, or t
  misc_feature (352)..(352): n is a, c, g, or t
ggaaatataagttgttttttattttaaaatgatacttatgctaacgtgttattgttattttaaaataaactaataaaatttttaaatttctaatacagtaaatactaataaatataacccacataagccaaagcttgctaggttctcaataattgtttttttttgcgggggacagagtctcactttgttgcccagtctgggagtgcagtagccaatctcaggctcactggcaacctccacctcccgggntcaagctatcctccccacctcaggcctcctggatnggctaggggnaatagggtggcatgccaccacggnccaggccattnttggtattttctttgtggggggntagggtttcggccatgg

SEQ ID NO: 550018 - DNA, 794 bp, Homo sapiens
  misc_feature (497)..(497): n is a, c, g, or t
tgggagtcatgtgcccctttattagctgagccattacttgaaagggatagaaccgggaggatgtggttggccccgatgccggggccggccatgcttaacggggcttgtaggtgatggagaactcgcccaggtagtggccgatcatctcgggcttgatctccaccgggttgagggtcttgccgtttgtagacgcccaccatgctgcccaccaatctcggggtaggatgatctatgtcccgcggggtgctgttttcaccaattctccgggcttctccaggggcgggggccctcctttctgggccttgcggcaaggcgccttcaagcaggggaagtgcgtgcttccggccggaaggccccggttctcagccgccgccgctgtggcgcgcactgtgtgtccgagctgtgcatctcaggcgtgcctcgtatgaggcacattgtctccgagcagtctgtggtctcagaggtctccccacgcccggggtataagtggtgcaccnttggcggaagggctccgctttcttctctctcgtgacctcatacttctcgtggggcccattcatagtgtctcggggggtgcgagagaacaagagaggcggtaaatgtgacacattgtgcgccacaatgtgtgctcatatacgcgtggtttcccctagaaccccccagagttttctctttttgttcacacacggggtgcggtaaagactctgtgccgggggttctccccataattgggagaggctccgtatttataactttcgagaataacgccaggggttacccccgtgctttatagc

SEQ ID NO: 550019 - DNA, 93 bp, Homo sapiens
ccttgtgctgaaaataaatgtcgactggtatctattttatgacttgagctttttaaaggtagtgtgtgtggtgagcccttctgtcgtcttctc

SEQ ID NO: 550020 - DNA, 621 bp, Homo sapiens
gatacaggcagaacattacaaaagccatacaagccattgtctctctatgggatatgataatatccctggtgaatgaagtaatcaacaacataagagaaggaaaagaacgatttcttttgtatactccctaaacacaacagagttggctgcgtcagatctagcgtgtgagcatatatatgcctacttccaggcatcgtccagctgatgtccactgctagtggtttctgttgtctgactcctcatattctgctttggaggttgttctccggggggagaacctactggagctgcgcgttctgcaagacgccattctttccgaagccttttctcctcatgtggtctgtcttcttgtgggattctttggcctcatcctctgtgagggggagggcctcctcatcattttcaggttattcctgccacacagatatccttataatatgctggtgcgtctgcttcttgagggggtgagaggacctcctcttcttccaattgagggggggcaacgacttgttgatgacctgcttcctcctcttttcctttgctgtggtgtgcgtctcctcctcatcttctagttgtgcagtcttattgcggagatgctccttccggtctcttcgagttgca

SEQ ID NO: 550021 - DNA, 945 bp, Homo sapiens
aaaaagaacatgagaataatagcgtactaacaagacggaattgaaaaggtacccataagatatcctctagtccctgctacttgggaaggtgaggagggaggattgcttgggcccccaagtatgttccagaccagcctgggcaactactacaacggaggcccttgtttttctactaaaaacggaacaaaagaaaagggaaaagaaaaaatatccacaggtctatagtgataccttaaaaaatatgcggggaggccttctcgcaaaaaccagaagaattggctaggttaataaacctgtaccgatgattaaacacgtgtagaacgttcagttactaaccaggattcagggcccatggatttctcaatgatgctaagatccactgttgtggccaaggctcgtgcggggactaggaacacttcattacaaattttcagcgataccaccttcgaggacttaacaaaatgcttgtgttggttgaccaccatacttttaaaccatgtggttggtgacctcaaaaacagggccaaagccgaaaatggtggtcttccagggaatgtggacttctccatacgggttaataccaaaaacgaagcaaccctaagttcttctttgcaaaaatatttcaaccttgcaaaactaattcttaagggcaaagcaaagcacgttacaagattggcagtctattaagagaacacgttgaccgtggggactctccacaaaaacttgcgagtggacttatacacacccagcggcgcgtcggccaacgtgtggaaattcctaccccttagattttcccccttaatctttgtgtggacgctgattttctcacgacaattctggcccaccggcggcaggggaaaataggagtcactctcctatgatggagaacacaactcctttcggccaccagcgtgtagggcgcacaaacactgggggtgggacacc

SEQ ID NO: 550022 - DNA, 335 bp, Homo sapiens
acacagacgacagcacagcgcacaaaaggcacggttggaggcccccagcgtgaggctgcgtctgttgttacacatcccggataatggtgcggtatttgtcctgctccgggcaagtcacccccacgtcctggataagcgcagccgcttgaattggacaacacattcagctgggcgggcgtcagcacatcagtgacattgaatggccttcgccacagggaccgcagcttcctctccagcaggtctagagccacgtgcaggtagtcagcggccctcaccgccgtcctggtgggtgccaccggctgcttgaagtaggataggagttccatggggctgga

SEQ ID NO: 550023 - DNA, 1071 bp, Homo sapiens
gggcgaggagaaggtaggacaggtgctacgtctaggtctcagtggctgcgtgcaaggggaggaggttggaggggcggccttcgtgcttgacgaaagaaaagggaatggggagggctgagcagagttcgccaaggcgttgcggcagagatggcacttgctccgcgcttcgttctggtcgtcctcggtatgagaccaaccacatctccaaccttgtgtgccagtaaccaccatcacgggacgatcccgatgcatgcgcagtccacatcattcgtccttttctggtggccgcttgaggcaggactgcaacctcgaaggctcctgcaggacaggctgtgaggcaactccgtgcactcacgtggaggcgcaagagtcgttccccagggggcgtgccaggaccaccctcagccggcctgtcgcgtctctggggccgcgcaggggatcttgggcgtagcgcgcgcgacgcacgactccggggagacgcggtgaccgcggggctgttagtctcgccccgaagtgtcggcctgcgtacgcatcgccgagggtctctccgggtttgcgcgcaattagccacacatgacggcgaaaaccagaccgacatccgtagcatcacgaggcggtctgttcatcttgctcacacttatctgcgcgactggcaggggtttgcacttttttttggcgggtccttttccaatccccgccgacgaggttaccgctttttctacccgggctgttctcaacttgtgactcagtgtccgcgtgagggaccacgtacggcggcttccaccttcttgggacacatggcgcacatcttcggcatctcagcgggggacagttgtgctttcactatgcgccattccgctggggcttggctatcgcttcccgtttgccgtacatctaatgtttgcttgccacaagtgtttggctaggagccggaatctgggttgttgcggcttggcaggcctcttccttccctacattgcccctagtcgcggtccgcggtccccgtccgaggctttcggacgacgaacccgacggggtgtgggttgttggtcgctgtcgaccccctttgtg

SEQ ID NO: 550024 - DNA, 442 bp, Homo sapiens
  misc_feature (252)..(252): n is a, c, g, or t
aatatataataaagtatatggcattctcccatatactttaaatcatctttagataacttacaacatctaacacaatgcctacatatcatttcattcatgtaaattcaacacagtactaggcatggcaagttcaagttttgccttttgaaactttatggaattttgttctgaatattttcaatctttggagggttgaattcacagatgcacacagatatggagggccaactatgtatttgagtatatacatantgtgtgtgtgcatatatctatatatatatatatatactaaagattatatgtaaccgtaatatcaaatataatagactgtaagtgaaaaagcactattagagattcggatggatgttacataatgaaaaagaaacaatctatcagacagatatctctaaatttgaatatacttaacagagcctcaaaatat

SEQ ID NO: 550025 - DNA, 365 bp, Homo sapiens
gagttaaacgagtcagtatatttcctttattgctcaaatcactttttgtgttgggtcctttttgaaaggtggccagatctgcccaatcatattatgctcctcaaggacacaccctgtgtgaggaataagcagggtttctaccaagtcaactgtcagagtgatttaccttccatgatatttctgaatgatggtagactcaagttaatgtgagttatgtgatgcctgtctgtcattggatgaagatctacactggacagtttcaggtttctttctaaaccatgactgaagccatagattacctgataaccaaccatggttctataaatgtctgtacgtgtctataaaagtcaatgcagaaaattaaa

SEQ ID NO: 550026 - DNA, 430 bp, Homo sapiens
  misc_feature (11)..(12): n is a, c, g, or t
  misc_feature (16)..(16): n is a, c, g, or t
  misc_feature (40)..(40): n is a, c, g, or t
  misc_feature (379)..(379): n is a, c, g, or t
  misc_feature (421)..(421): n is a, c, g, or t
gatttttttanncagncaccttcctaaccaggaatttgtntccttaaatttgttgttgttgttgttgttgtttgttgttatttttttgagaagagtcttgccctgtcgccaaggtgggaatgcattgacgtgatctcagttcactgtaacctctacctccccggtttaatcgattctcctccttcagcctcctgaatagctgggattacaggcaccacatttttagtggagatggggtttcaccatgttggccaggctggtctcaaactcttgacctcaagtgatctacctgcctcagcctcccaaagtgctgggattacaggtgtgagccactgcacccagcgttttttgttgttaagacagggtcttggctctgttngcccaggctggagtggcagtggtgtgatcccagctcactggnaacttttgg

SEQ ID NO: 550027 - DNA, 234 bp, Homo sapiens
gcacccgcaccacagcacccagctccgagatggcacctgcacccacagcgcccggctcccacccaatacggcacccgcacccatagcacccagctccgagatggcacctgcacccacagcgcccggttcccacccaatacggcacccgcacccacagcacccagctccgaggtggaacctgcacccacagcgcccggctcccacccaatacggcacccgcacccactgcatcca

SEQ ID NO: 550028 - DNA, 627 bp, Homo sapiens
acaggctccggacgtcctgctccggcttttggctgtctgctgcctggcttcaagagggagtgcttccaacattccttatcaggcttttgaaacgtatgtccgcgccatcgctggacagctggctttgagactacaggagttgaagaagctataaccaaaggacagaagattaatactggtgaaccccagactccctctgttctcagagttattcgacacctccaacaggagggacacacagaaatcaactaagctgtccgcatctcctgctggcatcagtcgtggtggaggccgtgcagtctcagagtgtatttgcacagctgggtttgggcctctacagaaagttattactcctaaagactagatgaggcgtcatacgctatggtggaggtgtggatggagtcccggactgtgcgatctttatcaagctacagaagtcgatacaactcaccaacgatgagcctactcagaactacgggtggtcactggttccgaagacgttgtcaggtgtgaaatcctgcgctcttggcggtctttggaggcagtgtggtttacttgccgggggttcctgtacctccagtgcttctgcctgagtgcatcatgcacagctgctaataatatgtttcc

SEQ ID NO: 550029 - DNA, 872 bp, Homo sapiens
agcggactgggtgacagagcaagaccatcctgtctcaaaaaaaaaaaaaaaaaaaaaaaaaaaaaaaaaaaaaaaaaaaaaaaaaaaattgaacgcaccacaaacgagaagacaagagaggcaaacgacaggcaggggagagacgacaccgaaaccacaccaacaccgagaagaaagacagagagagagaggagaaaaaaaaaggaagaaagaagaggagaagagaagggggagcgacaacacgacagcaaggggacaagaaaggaagagagcgcgaaggaacagacagcgagagcagtcgcaaggaacagaggaacaccaacacgcgagaaaaaagaccggacagagcaggagcgcagcacgaccggcggaggagaaacagcagagggacgcaggggaaacagcaagacaaaagaacaacggagacgagaggacgaaagaagagcagagagaacgagagggaggacaaggagaggagaggaagacaggcgaagggagaaaaaacagaaaagaaacaggtaagaacaaggcgaggagggaagcaggcgaagcaaagcaccgacgacgaggaaacggacagagaaagagaaagacgaggcaagaggagcaagtcgggacgcaaagagagcgggggagggagacgcgggcgggagagacccggagggcaggaaggggtggacgggagaaggggagagagagagaccaacaggccagggagaaagaagggagcagcgagggcaagcagcagcgagggggggaagaagagagacagaaggggagagaggagagcaaaagaagaggcgagaagacagaagacgggaggcagaggggcagaagagggcagagcagaggaggagatggggaaggagaac

SEQ ID NO: 550030 - DNA, 119 bp, Homo sapiens
  misc_feature (78)..(78): n is a, c, g, or t
ctttctgcggtcgactctagcaggctcccctctgtcagcggcgcccccaggggggcatgcgcccatgcagcagcattntgggtcccgcagctcgcacattcgtccatccatggtccatc

SEQ ID NO: 550031 - DNA, 220 bp, Homo sapiens
aatgctacgtaggagtatggtgagccagtggccattagataatacctttcaagtgtgagcttagacgtcaaccctaaggtgtgtaaccgtaatgctaattgtgatcatggatgaatcccttcagtcacattacggcgaaagtagtatggctataagttacgtcattacttagtccacgtcagtcgtctaaaaacatcttagggttacccaactctgatcc

SEQ ID NO: 550032 - DNA, 277 bp, Homo sapiens
aacgtccttatccatcctcttctcttcagtgaactgggatggaatatttccgcagtttcagaaactggaaaagcttgtgtttggtcctcttcttcaaggccatcagggcacgcgttttctcctccagatcttgatctatggcaaaaatgatctgggctctctcctctgctttctggtctccagagtttctgaagagcctttctagtgattctgggtctgtgtttccaaagatgtggcccacggttttcttacgagaggctgtgtcgaagtggtagcc

SEQ ID NO: 550033 - DNA, 457 bp, Homo sapiens
  misc_feature (41)..(41): n is a, c, g, or t
  misc_feature (109)..(109): n is a, c, g, or t
cacatcacatgtctttcgtgctccgagcaccagattctctngtgtcagtatgatctcatatacacacctctctctcttctcttttcttctatacacaaatactcaagangagagtatatgtgcacctctcctccctcatatgtgtctcttctcacaatactcactcatctagatgtgctcgagacactttgcgacagtgtgtcatcgtgattctacactcctatctcagaccgctctttagacgctctctctcatgtgtgtatctctctcccacgatgtcactcactctctctctctctactctcacatgtgatagtgtgagagagaggtatatatattctctattgtgtgtgtgtgtgtgtgtgtgtgtgtgtgtgtctcatctgtctgatatacgagagcccattttctccgtgctctgtcgccctctgtgtttctcttctctttctctctctct

SEQ ID NO: 550034 - DNA, 718 bp, Homo sapiens
  misc_feature (718)..(718): n is a, c, g, or t
catcgattccacggtctcatttggcgcatccacaagggcatacactctgcgcgagaagcctcatacatgccatcggctgtgtaaaggagatgagaagatgggtggagaggatgatgaactcaagggcttacgtgggggttccagaggaggaaattgagctgtgataagcctgacagagttcaacagtgcccacaatgaagcggatttctacctctgtaccattgaggagggaaatctgggacattcaaagaccaaagaggaagaggaagagctcacttgggtgacatccagtgaggatgatgagatcatcaaaccagaggatgtggatccctcagttggtcgattccggaacatggtgcatgactgcgagtggtcccatgtcaagaagaagcgtgtggaggggccctgtgctccctgggccgtggaggaatcagggtagcaggcgcagtgctagaatgttcgcctatcagcggaggactctacagggggcctgccccccacatcacgagtgaagcaggcgtcccagtcaacatggcatccatgggacagtactcatcggtgggcttgcgccatgccagagccaatgacttgacccctggatgtggagcttgagatctctgtgttgccgtcgagcatgtgatagtatgaaccccttgcgatgcgaaacccatgcagtctatagccctgaaagcatgtaagtgaacccaagaagaagaan

SEQ ID NO: 550035 - DNA, 481 bp, Homo sapiens
  misc_feature (154)..(154): n is a, c, g, or t
  misc_feature (464)..(464): n is a, c, g, or t
  misc_feature (476)..(476): n is a, c, g, or t
ccgtgcacgcttgtcagtcgtcacacctgtaatccagcactttgggaggcaaggaagaggatcgcttgtcagcagctcgcacctgtaatcccagcactttgggaggccaaggaaggaggatcgctcgaggccaggagttccagaccagcctggnaacatagcgagacccccacctctacaaaaaattttaaaaattagccagaggtgggggtgcacacctgtagtcccagctactcaggaggccgaagcaggaggatcacttgagcccaggtatttgaggctgcagtgagctatgatcacactactacactccagcctggggtgtcagagtgataactcttcttcacaaattcaaaaaaacacaaactgtccattgattcacagcatggccctaatttcttagctgcaggtgtaatttcttattttctggggattctcaacctaaaggagggcaggatcacacntcctcaagggcntgggc

SEQ ID NO: 550036 - DNA, 471 bp, Homo sapiens
  misc_feature (234)..(234): n is a, c, g, or t
  misc_feature (351)..(351): n is a, c, g, or t
  misc_feature (465)..(465): n is a, c, g, or t
gtttattaaaaaagtgttagagcaggaacgaaaggaaataaagtacacttggaggagggccaggtgggcatcttgagagagcaagtacacggttttgacctttgacttggggtttatatcttggcatgcttctgggggctgcgtcccttctcccctgattcttcccttggggtgggctgtccgcatgcgcagtggcctgccgacacttgggagggccgcgtgcacagtgtcttnactggagttgtgcggtgccctcttgaggcagtcttcccttaccagttcctaggggaaggtcacacgctggttaaactttgccactttgcctcgtagtgtgcatgcttgacctcactncaccaactcctgagattttttttaaattttttaaatttaaagttcttaggggtacatgttacacaacgtgcaggtttgttaacataggtatggcatgtgccatgttggtttgcngcattt

SEQ ID NO: 550037 - DNA, 112 bp, Homo sapiens
gagagctataaccagaaatatgtggatgaggcaccaagaaggagatcaaagacatccacatccagtatgaccggaccctgctgatagctgaccctcgtcgctgccgagtccg

SEQ ID NO: 550038 - DNA, 297 bp, Homo sapiens
agaagaacatgaagtttgtcatttaagtgtgttatattttgtttactggttttatttattatttatttttatttttatttttgaaacagagtttcactcttgtcgcccaggctgaagtgcaatggtgcaatctcagctcactgcaacctccacctcctgggttcaagtgattctcctgcctcagctacttgggaggctgaggcaggagaattgcatgaacccaggagacggaggttgcagtgagccaagatcacaccactgcactccaacctgggtgacaaagcaagactccatctc

SEQ ID NO: 550039 - DNA, 727 bp, Homo sapiens
tctatgacaggcctggttttaatcggccgaggctgaagcctggcgctcttggatcggctgcggaccgctgcaatcctgtggaggaacgcgctgccgagccaccatcatgcctgggcacttacagtgaatggcttctggctgcgtggtcaccaaccgattcgaccagttatttgactgactgaatctgtgacccacttcagatgtgtgcttgaatgtgcatgcagatgaacaatgcaaaaaatgaatgcctggctggtggtgctgtgctgtttgtggggccctgtgtggccaatgatgctgcagctcagtgcctgctgtgcccaggaccaatctccaactgctggcatggcaaacatgctgctgcaaggatgtcccatgaaatgaccgcaagaacccgctgccccccagcgtttggcgtggtttgacagagaaacgagtgagacgcagaccgcccgtggcgcttaaggaaatgaaggaataagacgagttggaacgaagacctgatcaacagacttcagtggtgaacgtggaaaataattgatagaagaccacgaaatggctgaccacctcgtgaacgaagattcgaaagccacttgaacgaaaatgtggtgaatggaggcgaattttcatgttgatagacctgattattgaccgacctattcgaggtcgtggtggtcttggacagaggtcgaggtggccgtggacgtggaatgggcctgatgagatg

SEQ ID NO: 550040 - DNA, 153 bp, Homo sapiens
gtaggcatttgtatgtcttcttttgagaaatgtctgttcatatcctttgcacattttaaaattgggttgttttcttaccattgagttgtataagttccttatatattttggatattagcttcatcaaatgtatggtgtgaaaatgttctcttc

SEQ ID NO: 550041 - DNA, 200 bp, Homo sapiens
taaaaagaaaaaaaaggatttggggccttaattttaaccgggcagcaaaaaaaacccctttagggggaccggggcaattggacggaataaaaataagccccaaaaaaggaaaggggggacccggaaaagagaaaatatcaacgggggcctattccacacttttacacacagccgggcccctaaaaagggggaaaaagccc

SEQ ID NO: 550042 - DNA, 380 bp, Homo sapiens
  misc_feature (69)..(69): n is a, c, g, or t
  misc_feature (251)..(251): n is a, c, g, or t
  misc_feature (310)..(310): n is a, c, g, or t
  misc_feature (321)..(321): n is a, c, g, or t
  misc_feature (325)..(325): n is a, c, g, or t
  misc_feature (331)..(331): n is a, c, g, or t
tgatctagaggatcccgagcagtcgtgatctctatgcaatgttcccctaataatgctctgagctggatntagtgcttctttgggatccaattgttccttctctgagggttggtatactcccttgtgggaactcccctgtcacgtctggggcgactccagccctgggttaggaggatgaaacagacgtgtgccatagaagctcagaaaagacaggttccagatctaaccatgagacataccacactgctttnagaagatgctgtagaaggatcttcatagcctcagaactgggaagtatggaaggcagtangaaaagatgtnaggngttagntgtggtggctcatggctgtaaacccagcactttgggaggccaaggtggg

SEQ ID NO: 550043 - DNA, 419 bp, Homo sapiens
cataggttagggaggatcaaggtgatgagggctggaaagaggggctggggtcgaatcaccagatcctgtggttgcaagggaagagcctggagttattctcagagcagtgagaagccactggaaagttgtttttttgtttttctgtttttgagacagagtctagctctgtcacccaggccgactgcagtggtgcaatcttggctcactgcaacctctgcctcccaggttcaagcgattctcctgcctcaggctccccagtagctgggattacaggcacatgccaccacacccatctaatttttctttttcttttttttttttttattggaaaaagattttctgcccccaaggttggattgccgggggccaatctcagctcagggcaccccccccctccggggtacaagcgatcctcgggc

SEQ ID NO: 550044 - DNA, 670 bp, Homo sapiens
  misc_feature (116)..(116): n is a, c, g, or t
  misc_feature (142)..(143): n is a, c, g, or t
  misc_feature (154)..(154): n is a, c, g, or t
  misc_feature (156)..(156): n is a, c, g, or t
  misc_feature (161)..(162): n is a, c, g, or t
  misc_feature (164)..(164): n is a, c, g, or t
  misc_feature (167)..(167): n is a, c, g, or t
  misc_feature (170)..(170): n is a, c, g, or t
  misc_feature (179)..(179): n is a, c, g, or t
  misc_feature (182)..(182): n is a, c, g, or t
  misc_feature (188)..(188): n is a, c, g, or t
  misc_feature (193)..(193): n is a, c, g, or t
  misc_feature (205)..(205): n is a, c, g, or t
  misc_feature (213)..(213): n is a, c, g, or t
  misc_feature (220)..(220): n is a, c, g, or t
  misc_feature (233)..(233): n is a, c, g, or t
  misc_feature (241)..(241): n is a, c, g, or t
  misc_feature (249)..(249): n is a, c, g, or t
  misc_feature (264)..(264): n is a, c, g, or t
  misc_feature (278)..(278): n is a, c, g, or t
  misc_feature (281)..(281): n is a, c, g, or t
  misc_feature (293)..(293): n is a, c, g, or t
  misc_feature (310)..(310): n is a, c, g, or t
  misc_feature (315)..(315): n is a, c, g, or t
  misc_feature (325)..(325): n is a, c, g, or t
  misc_feature (331)..(331): n is a, c, g, or t
  misc_feature (351)..(351): n is a, c, g, or t
  misc_feature (366)..(366): n is a, c, g, or t
  misc_feature (378)..(378): n is a, c, g, or t
  misc_feature (389)..(389): n is a, c, g, or t
  misc_feature (395)..(395): n is a, c, g, or t
  misc_feature (402)..(402): n is a, c, g, or t
  misc_feature (415)..(415): n is a, c, g, or t
  misc_feature (425)..(425): n is a, c, g, or t
  misc_feature (434)..(435): n is a, c, g, or t
  misc_feature (440)..(441): n is a, c, g, or t
  misc_feature (443)..(445): n is a, c, g, or t
  misc_feature (447)..(448): n is a, c, g, or t
  misc_feature (450)..(450): n is a, c, g, or t
  misc_feature (510)..(510): n is a, c, g, or t
  misc_feature (547)..(547): n is a, c, g, or t
  misc_feature (555)..(555): n is a, c, g, or t
  misc_feature (582)..(582): n is a, c, g, or t
  misc_feature (605)..(605): n is a, c, g, or t
  misc_feature (608)..(608): n is a, c, g, or t
  misc_feature (612)..(612): n is a, c, g, or t
  misc_feature (614)..(614): n is a, c, g, or t
acacccgatgttgtcaagatggtttggggactaagggtccagtggggggagagatcctgcagaaccccccaaccagaacgtggttttgctgaggctggacctgagagaaagattcnggggctgtcttataaaataagacatnntcccataagcncngttcnncnccnttncctcctttnccnttcagngcagnttcttttcacantaggctgntgggtcnaactttgggagcncggactgncagttctntgggaagtgggcagngcatcccgcagggnttntcctcctctgtnttttggagaaccagggntcttntcaggggctntagggnctgccaggctgtttcagccnggaaggcccaaatcnagagtgagatgnagaaagttgtnaaatanaaaaagnggaggtggggaancgggtggtcnttccccccnnttggnngnnngnnanaagggttttagcagggtccccctttttttcccccccccccttttttttttattaatcaanagaaacttcaaaggtaatggggggggggggtttcccngggtgagnactcggtccccccccagcctttcatgnaaaagggggtttttttttatcanacnaacncnccccctgatggggaggggttccccaatctttccaaataaaaaggaatggctttgga

SEQ ID NO: 550045 - DNA, 328 bp, Homo sapiens
atctgtggtcataagacgtccagtgtagggcgggtccaacatcatcagtccccactatccatacgtaagacttgagtaagccgttaccttaccaactagctcatggaacgcaggcctatctcttagcgattaatctttcctcctcttctcatgtgatctaaggagagtatggtgtattaatccgactttcatcgggttattcaccactaagaggtaagtagcatacgtgttactcacccattcgccggacgccgacaacgtatagctacatctcgctgcccctcgacttgcatgtgtaaagcctatcgctagcgttcatcctgagcca

SEQ ID NO: 550046 - DNA, 913 bp, Homo sapiens
  misc_feature (8)..(8): n is a, c, g, or t
  misc_feature (10)..(10): n is a, c, g, or t
  misc_feature (20)..(20): n is a, c, g, or t
  misc_feature (24)..(24): n is a, c, g, or t
  misc_feature (32)..(33): n is a, c, g, or t
  misc_feature (39)..(39): n is a, c, g, or t
  misc_feature (71)..(71): n is a, c, g, or t
  misc_feature (108)..(108): n is a, c, g, or t
  misc_feature (133)..(133): n is a, c, g, or t
  misc_feature (138)..(138): n is a, c, g, or t
  misc_feature (143)..(143): n is a, c, g, or t
  misc_feature (176)..(176): n is a, c, g, or t
cattgcanancaattgattnaccnattaggannatgcantggacacatgtacttactaggcatatcacccntggcaccgtacggtcatgtaactatatcagtgcagtnggacttagcggtaaaagatcatctntcgtnacgcngttgctcatgagtactgtacgggcatatatganatacagcgtatgcataatatgcgcgcctccgtggcatcgacagagcatctctacgagtgatctcatgtgagcacttactgcatggagttcctacgatcactatgccatttaatctactagtctgagcgtaccaacaatgtacactagcgagatatcatgtgtatagttgtgacaccagagaggctcgctcgtgatcacttgtattcactagtagataccatatcatgattgaatgaggagctactcgtaatggatactcgagtttccttatgtaggaactatgcatctttataatagtctagtgatgacaagcactgcatctatatgcatgtgtacagtacgtcggatatctgccattatattgcatggccagaccattgacctataaggtactcatccgtattatgaacattatcatgaattttaatagatgctctaacatgcagagtctgtacaagactttgtcttaagggctcaaactggcagtttaaaaactgttacagaaagttggattttttgtaattttgtccatggctttaattccaaatcctttatttgatctggctggaataacgttttgacactttctgggacctttattggaccttattttggtgcaaaccctatttggataagcaattctttaaattgcatattccgaaaaatttttgtattaatatcttttaggtagccccattttggatacaaaatggatggttctcattggttccagctca

SEQ ID NO: 550047 - DNA, 203 bp, Homo sapiens
gccagctccaccccgtgactgctccctgcccaggcggacagtggggagggggcatacagcactctgaggatcataagggtggggaccccaggagctgaatctagaaggaaagggctccttccagaggaggtcatttggagatcctgccatccccacccccttccaaacagccaaacctgctctggcaacaccaccttacctat

SEQ ID NO: 550048 - DNA, 199 bp, Homo sapiens
  misc_feature (121)..(121): n is a, c, g, or t
tttcttttctccccacgaagagatttttttttataaagagggggggggggggaaaacacagagggcgccccgcccgccccttttctttttttgtggggggggagaggaccccccccccccngcgggttcctctccccctctcttttttttttttaaaaaaaaacaccccccccctctctgggggggggggggggcgggc

SEQ ID NO: 550049 - DNA, 1506 bp, Homo sapiens
  misc_feature (1)..(1): n is a, c, g, or t
  misc_feature (914)..(914): n is a, c, g, or t
ngcctgcggcgctggtgtagtctcgtagttctcgctggtcggtgttctctcacagttgggtggttgctcgttactctgttgttgcccagctcgtttgctagcccacgcaggttgcctccgctcgtgtgtccttggtggactctatcccgagctggggcgctctcgcgcagaacgagggtttttctgtttgccccccccgggggcgaaccttttttcggtcgctggagccgagtggtgccccccggccctctgttcttgtcctcccgggggtgtgtgcctctgatccgccggggtgggggtctcccccgcggtccgtaagcctttgtgtgagggggaagaggttttctttgggggggacccttcctgttgttgcccggcgtgttccccgttgtgtgttgaccccgctctcgtccccaggtttcacgggcccctggtgtgtgccccgaacaagccgaggcccccccacgggatatgtgagggatgttaagggcgcaacttgggcaccgagggaccacgagaagtttttgcccgcctgtggccaggagggcccactttccggggctcgctcctgaacccggccccccccgcgtttggtaaacccaaatcttcgcagcgttttaaaccttccaagagggattggagggacaagagaaatttgtctgtactattgcccccacgggtgttttctctgagtttggctccacgtgaatcgccccttctgaatgcgcctggtttaccctttcagactccccgggagagatctctataaggggaaaggagaatattggggagcgccaaactctagatgggcttgtgcaacccaaaaggccccacgagagaggagacaacccgcccgctctactgtggaaagagagagatttttctgccccgggatttgtgggaaacatagaganactggcccccgccccgcgggaactctctcccagagaatatatgagaagttggggtgacccccagagaatctctgggaaaaaccccgagagagatgtgaaacccctgggggagatatataggagaaaatatagagagagaaaatatgcgcttctcacagagaggagaaaattatagcctgtttctcctgtagaaatatagagaagagaatatatatcgctctatacccccgcttctgcgacacaactcgaccacattatagaatttctatcgaatgttgtaccccacattagctcgagaatccacgagaaggccactgtgaaagagtatataattttatatgtgaaattccacaaattattttctctctttttcccacggttgtaaacttgccttctttctaactctttaaaaagtatatatgaaccacgcttaactttcttataatcacgaaaagagaatgttttatatgaaccactctttcttttattaatataaagttatgaagaatgttctttcctatggcccgctatggctatctttgcccccagaaacataagttaaattttagagttctgttttccctgaggtcca

SEQ ID NO: 550050 - DNA, 267 bp, Homo sapiens
tactgggactggacggtggacagtcaacattccaagcagcatgaacaactgcatctgtaaaggaactgctggcaggtccctttagaatgtgttctggccacagggaggttcatcatgttcagtgcccttgaggaaggcgggttctgcatttcccagatacccgctcgctgagctccacactgccaggggacccatgtagcagcaaggggttagaacagggcagggagactttcccacaggcaaaattctcacacaaattcacaaata

SEQ ID NO: 550051 - DNA, 1791 bp, Homo sapiens
agtctcgagttttttattttttcttttttggaaaatgaaatgttccccatcataggggattctaaaccccgtcctccacgtatgcggggtgccaagcgtggagttctttgtagggcatacatgtgtcacacgattgggcagtggctagccaccacagggtcgggtgttctttcaaaaaggccacaccaaactaggccctacactgtgccctccgtgcacaagccaccgagaagagcgtggcgcccgaggaaagaccgcaagaactcgtggtcttacaagagctccgtagaagcacacattctcctcgccacaccagagacacgcgcgcggacaagcgacgacacagactacgcgccaaacactcaacaaagagtctctcgacgagatgtgcaaaccctctcgcgacacataaagccgctctcaataaaatctctcaccacgcgagccagccgccccctccaccacacgacatctcacgacgacgcccgcgcgtcacaacacgcgaaaaaagagagtgttgtctcatctctaccactagcacacatctctccaccaagaagactaagagcaagagagcgctcgacacaactcttcttatcgtgagcaaacaagagaggtggacacatattatgaggtagataagcaccccaaaggacgtgctgatccctctccccctgatgcgtagtaagatggtctcctattatcacccacaaccgtcgtgttgctcccgaaaacatgctgttgcgtgcgatgtggttacgaagcacaccttgtcgaacgcacttctggtggtcgactaactgatacagtgctcctactagtggtacgttgcataacaccacgaagaagaaccaacttctactatcctccttcttatattcagcatcattatccacccgaccaccgccgcctacctacttctatctcttactacctacttatactacgaagagcgagattgtgagacaaaggctcactacctgctggtagcagaccgataaaagactctcgaactaacaactaatgctagttgcgcgttagtatccagataccgagtagtagaccgactactctatgtcagcaacgacacaaactcagatgcatacaactaccattaattagtttgcatcaacaaccaaattccatcacccatctatctcactccacgcagatatacatctatcatactattataatttctctcgctacttatatcatattcctcatatattatactcataaaatatctattatatatatacttccacacaactattattcatattcaataattagattgctaaacactcttccttctcccacccaccaccaatactactccatctacatgctatatatagctcatattaaaccacaacaccccacacctctaaattacttaataactaacacaatacgcttgcgactcacaacacacccttcatgttcattacacacaacttatatcagtccgaacccatcatgtaccccacccaccatcttcttgtctcactcggcgtccgaccctcgacgcacaccaccgcagacacataacagctgcaacatcagcatagcagacaaagcgaagaggagaaacacaacggccagcacgaaaaccaactgaagagcgacctacgcgaggcgtgctgaaccaccccgatcagcgtactgaactcgcaatgagtcacccagcgcagcggcgacctactcacatacaacaaccgcaacctagcgtacacaacacgtaactaatgcgccactcaccaacagatacaatacatctatgagcac

SEQ ID NO: 550052 - DNA, 175 bp, Homo sapiens
actactattcctgtttcaattcatttgtttgtctgagaattgggaatgcatgtctgggcagtgattagaggccacagcaacgcagaagatgtgtgaggaggataatcttttttccacaatgagatgtcagaaatactgcttgctaaagtcagccatgaaaaccaaagcaagaaga

SEQ ID NO: 550053 - DNA, 451 bp, Homo sapiens
  misc_feature (10)..(10): n is a, c, g, or t
  misc_feature (117)..(117): n is a, c, g, or t
  misc_feature (402)..(402): n is a, c, g, or t
ggcaactttnccccaagagaaaagcccttcaggcaccaggacccaggcaagcccccgcaactggctggccagggcccgcccccgagcgcgctagtctccctctccctctcttttccnacggtctccctctgatgccgagccgaagctggactgtactgccgccatctctgctcactgcaacctccctgcctgattctcctgcctcagcctggccaacatggtgaaaccccgtctctactaaaaagacaaaaattagccggggtgtggtggtgcgcacctgtagttccaagctacttgggaggctgaggcaggaaaattgcttgaacccaggaggcaaaggctacagtgagccgagatcgcaccactgtactccagcctggggacagagcgagactccatcanacacacacaaaaataatttaaaaaataaagcatctacctgtggctgtga

SEQ ID NO: 550054 - DNA, 182 bp, Homo sapiens
  misc_feature (182)..(182): n is a, c, g, or t
agactgggtttcgccatgtcaccctggccggtctcaaaatcctggactcaagtgatcaacctgtctcagccacccaaagtgctaggattagaggcgtgagccagcgcgcctgtccagaaggctttattggtaaaaatataatttaaatctctttcaatacctcaaaactatcatataagatn

SEQ ID NO: 550055 - DNA, 281 bp, Homo sapiens
gatacaatcgagctcggaccccccgactagcccgacattagaggttttgctggtggatggatcgggcaccgtcttcctcatattccttttgggagacccacatctgcttaaaggtgtccagggcaggcaaggatggagcccccaatccacgtggaatacagtctctccggaggtgcagatatccggatcttcacatctttgggagctagtttcttcacttcagtcactgtcgggctagtcgggggctgtcgggctagcggggactgtcgggctggtcgggg

SEQ ID NO: 550056 - DNA, 478 bp, Homo sapiens
aagatggtcctcagctattcgaggctgagatgggaggatcgctttgggcccaggaggtcgaggatgcgtgagctgtgatcatgccatcacattccagcctgggcgacagcaagtccttgtcttaaaaaaaaaaaggaatttgtcggagttaagcatacttggtgggtttcaatccgatgtgattttaatctttattaagctcagactagcttattcgggtcagtgagagggagcctcttcagcttgggtctatgctttcttgggaaaagtgtgcagatgtgtgcatacttgtgtgcacagaccacacgcacagtcatggatagctccctgcaggcgggcatgtcaagatgctctaggcccaatttatagagcttctggtccaaacctgtcttaaccgaaacacttgagagaagttagcagtttaattgagcagagaatagtttcttgcagctgaggaccatcgtgggggtaccgagct

SEQ ID NO: 550057 - DNA, 509 bp, Homo sapiens
ttcagccatccctgccagtgtcaccagccgacagagatttgaattctccctgggacagagaacagggaagggcaggcaccatctttgctgtttgggtgactcagccactccagtctgtgggctttggagagcccaagccaacgaggacagaagcagtaccccagcacagcacagttgctccatgaaagcatggccagactgcttctttaaacaagtccctgatcccgttccttttcactgggcagaatctcacaactggggcctccagccacacataccgatgttctctggctgacagagatttgaaaacttcctgggacagagctcccagagggagaggtgggctgccatctttgctgtttgggcaacttagctgttccagcctccaggctttggagagcacaagacaatcaagggtggaaatggtaccccaacccagcacagctgatctatgaaagcatgcgcagagtgcttcttgaaatggtcgccaatccggggtaccgagctcg

SEQ ID NO: 550058 - DNA, 220 bp, Homo sapiens
ttttgaagggggggcccccttggggggctttttttttttccccccgggagaaggggggaaagggccttggaaattaagggaggtttccctccctttgccaattccgggccaaaaagaaattttttttaggggggaagggaccccccacctgggaattccctttggggtccaaatggggccccccccggcggttttcccaaaaaaagcggttttggaccta

SEQ ID NO: 550059 - DNA, 685 bp, Homo sapiens
gagaggtgttaccgtttcggcggcgacacgggtgtttccgaactaaagtggatagaaaatcaagtatattttacatgacggtatgcggtatcaaggaggacgaccttggcagccgaggagctagagccagctgcactgtatgcagtcattccagcaccatcagaatccatgccagatcgataggcctgcattgacccaagcttgcattgcccaaagagaagtttcaggacaggatagcttggaagatcaaccagtagcaatgatgtcttaaggcccagatatgtctacaaaggaatgtgtcgcacacattcagggaaatttccaagggtgttcacactttaacatgatgatgcaaccagggttgttgctcatgttttgacaattttgagacttttaaaaagcagaatgaagatcatgattaaactgtgtaatgtgctaagttgtatgactattcgagattaatgcttgttagtgaataggcagaattcaatttgtagtgactttgacattttgaggtgttgttctgcactaattatgcttgctatgccgtccttagatcgaatgtatccgcggatctgtaatcctaggctgcagggtgtgggaacaatttggaacgctgacctggagaccatggaagagcgcaatctttgtgactctaatggcattgaactctttagagctgctc

SEQ ID NO: 550060 - DNA, 114 bp, Homo sapiens
ttactctgaggatctcccccgactagccgacaggtaggtggagggcacaaccttgtaggtgcctgctggcgggaggcagagctggctcacctactgtgcgtagcggatgtggca

SEQ ID NO: 550061 - DNA, 105 bp, Homo sapiens
agctcggacccagcgccctagcctataaggggatggccatggctaggtttttagatagttgggtggttggtgtaaatgagtaaggcaggagtccgatgaggctag

SEQ ID NO: 550062 - DNA, 350 bp, Homo sapiens
atctggatgggcacagtggttcgtatgtataatcccagcatcattctggaaggcaagagaatcactgagcccaggaattgagaccagcctgggcaacacaggggagacccatctctctctttttttttttttcttttcctgagacggagcttcgctcttgttgccaaggctggagtgcagtggcacaatctcggctcactgcaacctccacctcctgggttcaagtgattctcctgcctcagcctcccaagtagctgcaattacaggcatgcaccaccatgcctggctaattttgtatttttagtagagacagggtttctccatgttggtcaggctggtctcaaactccc

SEQ ID NO: 550063 - DNA, 873 bp, Homo sapiens
cgcgcaatgggcgtatccggtgggcacacgggtcagaaaaggtgcagaaaggttatttggtgccagccgcatcagaaccgtcatcgtgtcagaatacgtgtaccgaaatagattcccggatttcagcgtgtggcctctattgagcaacgtggaaaaatgcggaatagaaggctgttatcacattgggttttgatagagtataaatggagacccttgtgattaagattgattcgccacgatagaggatctccattcttgaagacaccaaagctccacaggagacaccaacatggggtctcgagatctaatagcgtaaaaagggaggtataaataagttcacgtcttgcgtcaccaaagagtggtcttccgcaacattaggaaatggactccaatgtgaagatggagagaaatatgtgttgtgagagaagaggatacaccagatttgtgttctttaaagaaatagctcgcctgtgtggtccccaaaaggtggaacactttaagtgcacaattggttttggaattgaaccctccgtggtgtaactacacacaagagtgggcacataaataaactcatgggagattgtgtttgtgattataaaaatattaacacttgcgtttcttacatgattcaccgcacgtagaaaactttgttaacaccacgtgaacacccactttgcttggttggtaatttagtgttttctgaaagggtcgccacgttgcccttgaggcacacttggtaattcgcacgaagcttggagacctgtaagagttttgagggcacagaattaggaattctgcctgatgggtaagcttccagtattgggaggtggagaaggggagggttcagaaaaataaataagagttattgcacta

SEQ ID NO: 550064 - DNA, 391 bp, Homo sapiens
  misc_feature (16)..(16): n is a, c, g, or t
  misc_feature (251)..(251): n is a, c, g, or t
aagctcgcactccttntggccacgccactgtaccgggaggctgtgcattaatcggtaaactccgatcagcttcctggagccctgctccatcgcgtagatcaaccctggcgcgggggcgcgcgcagagcgtttgctgacgattcttatgggtacctgatcggtgatcggtaattccccaaaagccgcctgcgcggcttcaattatcgcgcggttctgcttgaacaagttggggtctgtcttgagctgagacngcagggcaacactggtcatcgtggactccgcgttgagattgccggcgcgggagccatacatgttgacgcccgtcttgcccacaaggactggtgcatcttcacctggcaggaccaacactgcagggtcggtatgcccgttg

SEQ ID NO: 550065 - DNA, 112 bp, Homo sapiens
gtgtggctgtgcaggctctttccccacagctgccctcgtgggctgagcggtggtcagtgcctgcggtttcccacaccgagggtgcaagcagttggtgagtctatgaatctgg

SEQ ID NO: 550066 - DNA, 123 bp, Homo sapiens
tgggggggggaccccctttttttttttttaaaaaaaaaagaaggggggggggaaggaaaaaagtacccgggccccctcccttttgtttaaaaaaaaaccagggcccccggcccgggggggggt

SEQ ID NO: 550067 - DNA, 424 bp, Homo sapiens
  misc_feature (217)..(217): n is a, c, g, or t
tatctaaggatcccgtgtcatccccttcgtggtagtgtatgaatgaatgggtgagtttgtgaacgagtgggcagttagtgtgtgagtgggcgagttagtgtgtgaagcagtgggcaagtttgtgaatgagtgggtgagttactgtgtgaatgagtgggcatgtgaatgagtcgatgagttagtgtgtgaatgggtgggttagtgtgtgaatgagggnttttgtgaatgggtgtgtgaacgagtgggtgagttagtgtgtgaatgagtgggtgtgtgaatgagtgggtgcgttggtgtctgaaagagtgcgttagtgcatgaatgggtgggttagtgtgtgaatgggttgtgaacgagtgggtgagttagtgtgtgaatgactgggtgactgtgtgactgaatggggccagtgtgtgactgagtg

SEQ ID NO: 550068 - DNA, 347 bp, Homo sapiens
tctgggtagactctgaggatccccagatgcatgcagagaaccccacaaatctcctcgaaaagagcaacctcaagacacataattgtcaaattcaccaaggttgaaatgaaggaaaaaatattaacagcagccagagagaaaggtcgggttacccacaaagggaagcccatcagactaacagcagacctcacggcagaaaccatacaagccagaagagagtgggggccaatattcgccattcgtaaagaaaagaattttcaacccagaattacatatccagccaaactaagcttcgtaagtgaaggagaaataaaatcctttactgacaagcaaatggggtaccgagc

SEQ ID NO: 550069 - DNA, 839 bp, Homo sapiens
  misc_feature (219)..(219): n is a, c, g, or t
  misc_feature (233)..(233): n is a, c, g, or t
ataagtggggaattgttctctgtggtccaaaatgttctctgaaaaagatctccttgttttcccaaatgattctcttagaaaggaaacttgatcattctgcttgttctggagtgttacacaagtgttataccttgttctggtgttataccttgttctggtgttatacctttgttctggtaggtagtactaccaaaagagaacttgagaaattatcccttngggtgaggatggtntgtttcaagttttttttttttttccttcaagaaaattctcggtcttttaatttttaaactttcggcatctgggttaatcaaaatttttctaagagggcaatttggagggttttacaattagcaattacggcaatttgaagacttggcttatgagtcaggtgagatgagggcaaagaatattctttgtcgagcaaggggtgcaagcttaggacccattcttaaagtcgggggagaattaaatttgggcggtaaaacaaagtgggccaatttttaactctttggacaaattctgtgagcgaaggccggtcaacccctttttcggtcctgggcttggtctccagggggggggagggggtggacttaaagccagtggtgtcctttccatgaatgggtggaggtcgatcctcccatctggcgggaaactggtatcaagctaaacgtgcgagaaccctttgggatattccaatttctctgtacccagtattgttttcactcctggtttacaaggttcaaaagagattgtccgtaacatttcttctagtttaaaaacaatccctaagtttttttgaacccttgttggggcgcttaaaggtctcttggtcccca

SEQ ID NO: 550070 - DNA, 109 bp, Homo sapiens
ccgatgcaagcatacaggacactaaaatgccctttaaaaacttaagtagaataaacagaaagtacgtgggtcataatcttctggtcaccatcgatccatcctccatgga

SEQ ID NO: 550071 - DNA, 645 bp, Homo sapiens
  misc_feature (575)..(575): n is a, c, g, or t
  misc_feature (592)..(592): n is a, c, g, or t
gccccccaggagctttctaattcttttttttttttaaacagtgaaattctttattcaaatgaaatctcacagaagcaggcctactcccagtaaaacagggttggggattctagagaccccacttgctaggctccacttttgtggaccccttagggttctgaggagcagagcttggaaagtgaagccaggacataagggttctgtgtcacctctgtcacagctgactcagtgaccttcagtgagtccattcctacctctgggattctgtcctcgggttccgaaagacagggaagggagaaaaataagtacaaagtagtgagttttacataaagcctgttattctgttctatttttacaatgttaaaaatgtcctttcttttatgttacaatagtaagagaagattataaaagtttctttttgaatgccctttatagattaaaaggttgcctccctgaacaacttttgtctcagggaatacttactggttcttgaagcccaaaggtgtaggaactcctttggacaatatccatgtttttcaaactttttgattgcctgccataggggaaaaaaggcntttagtactcttatatntaaccgaaataacagtctataaaaggtactttagtggaatgtaccccgatatt

SEQ ID NO: 550072 - DNA, 574 bp, Homo sapiens
cgcagctgcagcgtccgggccgtgatgcctcgctccgcggcatttagcctgagtctcgggcctactctttttattgtctggccggggagcgctctccagcgggacacacaaagattttatgtttactcacgtcattcagcggagaacgggaaggcaaatcccccgaacggctatgtgtctgggcttcatccatccgacaatgaagttgacttactgaagaatggagagggaattgaaaaagcggacccttcacacttgtcattcagcaaggactggtctttctatctgttggactaccacggaattcacccccactgaaaaagaggcagatgcccgccgggtggaccatgcgactctggcacagcccaagaaaggtaaggggaatcgagacatgaaacagcatcatgagggttgaagagcccgattgggatgggtgaattccaattctgctgcttgcttttatacggaatggctatcctacccttaagggccaaaggccggggatagatggtgcatcccggcagggtggtcccccagcaggcctaaccggggtcggcacttaaaggggggagcg

SEQ ID NO: 550073 - DNA, 244 bp, Homo sapiens
ctgctgttcgggcacataggtaggccgagcagcacgcgtcgttgcgcacggccagcagatcgagtcgggcgcgcggacgtaggccaggtcggtgatcgtgaacccgttgaaccggtgcggcgccatgatcgaaacgtcgaccgtgcggtaggcgttggcctcccagctgtaggatagctcgcgaatccgcgaaccctgggcctgcacgtagagtatcgaacccgtggtcaccaccggctgcacg

SEQ ID NO: 550074 - DNA, 234 bp, Homo sapiens
actgcgtcaccttcaccgttccagtttttacatcctgagtcacgccaaaaaaaaaaaaaaacccaaaacaaaccaaaaaaaccaattaaggccaggccattctcattgggtttccgggcgcacgttaggtttggtcaagaaaggggcgtaccgcacctaggtcatagtcggcctaaaagctttggggggggacagatgggagggggcgggacctcgtcattggagggcacagat

SEQ ID NO: 550075 - DNA, 145 bp, Homo sapiens
gtttcccttgactaaggaacaggtgcccatcagagtggggcgggcagctttgggaagtgacacaagaatgcagtaatgatgtgtaaatgatggatgctggcctgggcagtgccagtccatgcctggccactagcagaataccaat

SEQ ID NO: 550076 - DNA, 254 bp, Homo sapiens
ccccccccccaaacccccccccaaaaaaataaaaattttccacgcccggttttctccttttaggccccggaaaaaaagggcccccccccccacgggttttgggcccccccgggccccatgaaaaaaatcccccccccctgggttttaaaattttttttttttgggtttttcttttttttcctttttcctttttttttttttcccccccttttaaaggtttttttaccccccttattaaaaccccttttgtttta

SEQ ID NO: 550077 - DNA, 802 bp, Homo sapiens
  misc_feature (117)..(117): n is a, c, g, or t
acccaaatagagtgtagcccatagaaattgagatcctgtgagacatgagactatagtaggctcgcacatgaggaagagtatcgagagatacattgataatacgcatgggtcagtaantatctatgacacaggatctaacccgtatggcgtctgcctaatggatattagaactagatactaaatgggcataggaggaagccatagctgaaatcctactcgaaagcagatcgaggtagacgtacgaacatgctaatagagcacagcccggctatgtagcaaaatagtgggaagatttactaggtagaggcgacaaacctaccgagcctggtgatagctggtttgtccaaggatagaatcttaggttcaacttttaaagtttgcccacagaagcctctaaatccccttgtaaatttaactgttagtccaaagaggaacagctcttaggacactaggaaaaaaccttgtagagagagtaacagatttaacacccatagtaggcctaaaagcagccaccaatttaagaaagcgttcaagctcagaagccactacgtaaaaaatcccaaacatataactgaactcctcacacccaattggaccaatctatcaccctatagaaagaactacatgtcagtatcagtaaccatgacaaagcattactcctccgaaataacgccctgcgttcccggattcacgaccacttgaactgaagcaattaaccaggccaagatatctgccacttcaccccaccaaggttcatcatacaccctcactgtcaaggcgcacagacagggcctggcccgta

SEQ ID NO: 550078 - DNA, 1116 bp, Homo sapiens
gggaacccggtcgctccgttccctcgactctccgtggcgtgcgctgcgcacatgagcgcatgctccctctggtcacctcttcaccggaccctcggactgccccaatggccctacgaacgttcgcgtcctagcggctggacagacgagtccaatcggccgcacagccagcgcgagcatcttcctttatgatcgtccgccatgtactgaccagcgtccacctcgacaggtgcgccagaactaccaccaggactcagatgccgctatcaaccggctgaatcaaaccttggagcgtctacggcgctccgtgagcggtcgtagcctgctccatgtactaacctatctttgatccgcagattgatagtgggctcttgatacaaacctgttgaccatgataccttttccattcagtcaggtctcagtgaaagacgaggcgaaaccattgtctgaagcacacaactgctgtgacaggtcttgccaagaaagccaaaacgcagtgttggtgccggcacagtctgtcccctgttccgagggcattaatgccagggaacccatcccaagtaacttggtgagatggccacttggggctaacacccgggcgtcgttggatagtggcaataccggggcaggtttgtttgcaagtatagtactttctagtgcaaatgaccccttgttcgaccactccccgatgccacgtaccttcggcacagcttagtcacccggaagcattggaggcacgaacttgtatccaaagatcgattgggagcccccacaatataaaggtgggtcgacccatttccgactatgtaggaacctaacacgttgtaacccttgaaacgtgaacggcatgtgttcgacacaaggcccgatccaaaaagaaacttgtgagaggttagaacccacggtttgaatcccaatcatttgtgtcaggccatcggacttgagcggacgccgcccccgaaatcccttgcgcctttgcgagctggcaaacattatttcttccttttgttgaaccaaaaagggcaacaacccgctttggggcaaagaacgcggtcgaattacatttcgacaagagggcttacaatggccttcccggggggcttaacatttttacccccc

SEQ ID NO: 550079 - DNA, 359 bp, Homo sapiens
aaaaaaaagggtccaagggggttgggggggggaaaaaaaccccccctggttccttaaccccccaaaaagttttttttattccccccctttttttttccccaaaaaaaaatgaccccccctgctttggggggggggtttattccccccccaggttttagtccgttccccaaagaaagggggacccccccccctttttttttgaaaatttccttttttccctttgggggggggtccccccccccccccatgggttttttttttccccccatttagaatttttttttttgtttgacccgccggttttttttttatttaaaaaaaagcctcccccccaaagccccaaaataattgggatttta

SEQ ID NO: 550080 - DNA, 91 bp, Homo sapiens
  misc_feature (41)..(41): n is a, c, g, or t
  misc_feature (60)..(60): n is a, c, g, or t
cagtgggcacttttttttttccaccctggctccttcagacncgtgcttgatgctgaggcnagttcaataaagattcttggaagttttgggg

SEQ ID NO: 550081 - DNA, 127 bp, Homo sapiens
aaagaagtatcaatagcattattaactcattaccagacttgtcaacaaactctggaaaacacctgtcaacactggcaaggcaaatcagcttctattcatatggagataccctatcctcagagctcta

SEQ ID NO: 550082 - DNA, 203 bp, Homo sapiens
  misc_feature (171)..(171): n is a, c, g, or t
ggagggtgggacggtgaatgctctatccttgagcgtttatcaagtccaagccttcattttacagcttgggtgaacctgcagggacagagaaaggggcgaagtcactcattgacgggtggcatggtgcgggcatgctaaagagttatggtacgcagatcctactttttcacncctcctgtagcaactgggacaaaaaatgctac

SEQ ID NO: 550083 - DNA, 1458 bp, Homo sapiens
tgctttctgctcttgttgcgtgtctttttgtgcactctgcttggtgtcctctctggtgttctggtgctgtctttctgctctttttctcttctgttctgttgtgttgcggttctgctgtttttgctctgcgtgggctttgctccgcggtctccttgtcccgcgctgcctgtcgctcctctctcgctcgttctacttgttcttttcgttccgttcttcgcttgtccttcgttgtctgtcattttttttttttgtttttctcccctctgtctttccggttctggtggctctcttgtggtctctttttctgcgttctgctgtggtttatttgttgctgctttcctttgtgtgtttccttgttcttgcgtttttgtctttcgtgcctgctccctgtctgtttgtctgggggtttgttctctgtgttgtcctttctccttttgtgttcgttctttccgtgtcgtctcgtggtcttctcctgttctgtcctttcttcgtttttgcctggtggcttcttagttcttgtcccctgttgtgtgcctgatcactctgctttgttctgtgattcagtgctgtttttattccatgggtctagtggttactgtcaggggttacctttggggttatatctggttgttctctgcgcggtccatgtctttcgtcttctaagctgcggtcgatttgtcggtggtggttgcatccgtttttctctcttatggtcacaagttttcacatgtctgttggtttttatttgggtatgagtatcatcgtgtattgtgattcttttgttgtgtttatgaattgtctattattttgatatgatgtttatttgtgctttattgtactgtgttttatgtctttgatgtttatcatgtcatagtattatattttaatgtatctatgatatgtatattttccctatgaatggcgagtttttccttggttttgtttccttgttggttataattgatgtgatggtttagattcatatatgatatggttatctatcgttgcctgtacatctttttgtgtccctggccatcttcactggtttgtaacctaatttactcatagtacctaggtatcctggtagggtagtctctacttgcgggtagtctagtaactgtcagtggtgcagctactctggactggtctggggctacctggtcaggcccaggtcagatgaggtctggcagagatcctatctgaagtccatgttgtgatgacgctacaccttcatggtatctgcttcagttgtcacatgatcctgacattcagtctccctgctctggggatgcggattaaagcgtctctgaatgttaatagtccaggagaggaagcgtgcagagcatgttacagaccgagcgggatgcactattctaactttgacagggtacggcagggccaccagaatctgcatgtgcccgctgcccatagtgagtcttcctggctatccagaagtaa

SEQ ID NO: 550084 - DNA, 303 bp, Homo sapiens
acagatccacacatcacagaagtataatgaactgttcaactggtacaaggtctggttaagactgcaggttaatcgcacatgcctttaacgaggacacacatgatttttgaggctttgacaactgcacattttaagtatccatgtctagtatatggtacaaactaagtgaggtgaaatttttaagggtgtaaaagactaacagagaataaagtaaatcaatatgagtcatgtgtaagagtttaattcattttcctgtctacagatttcactaacgtccgttttagttcaatctctttgctgaac

SEQ ID NO: 550085 - DNA, 439 bp, Homo sapiens
  misc_feature (61)..(62): n is a, c, g, or t
  misc_feature (80)..(80): n is a, c, g, or t
  misc_feature (84)..(84): n is a, c, g, or t
  misc_feature (95)..(95): n is a, c, g, or t
  misc_feature (168)..(168): n is a, c, g, or t
  misc_feature (182)..(182): n is a, c, g, or t
  misc_feature (202)..(203): n is a, c, g, or t
  misc_feature (218)..(218): n is a, c, g, or t
  misc_feature (270)..(270): n is a, c, g, or t
  misc_feature (317)..(317): n is a, c, g, or t
  misc_feature (328)..(328): n is a, c, g, or t
  misc_feature (335)..(335): n is a, c, g, or t
  misc_feature (360)..(360): n is a, c, g, or t
gcagccctctgcacacgcttgccgtcttgtctggctgggcagctgagctccagatgggggnngatgggatagctcttgcnaccntatttggaganagatggcagggaagtcagcccccgtgaagaagacaggagcaggcaggtgctggacagtgctgcccaggccctngggctgaagtgtcnaaccccacagcctctaggtnncactaaagcagcccnagaggatcttctctgtccatctccatcctggcacctacagacacttggaganagtccttcacatgggaactcacaaatgcacactgataacccccacanggaactctcanacgtagnaagtgaaaagacaggatgccagttnaacttgaatttcagataaacaacaaatcattttttagggtaagcaggtcccaaatattgcatgggatatatttgcacca

SEQ ID NO: 550086 - DNA, 775 bp, Homo sapiens
  misc_feature (428)..(428): n is a, c, g, or t
taaaaaccctcatcaataaatggaaacatacaaaaatagtcaaaccacttctacaaaatgtcagttatcaggcgggggtcttcaaacccaaagtgatgttgggtattgtaaaggtggacaattattaatgttgggcgggtatgaacgcagtatagtggaggaaatgtttgacgccaatatatggcactgtgaatgccctgtggaacgcctgcggggctcacaaaaaatattgttgacgcctggtaatatcgccgtcggaatatggtgtgaaaggggaagaatctccgaaagttaactcctcgagaggtctgtgatgagagaagggtgtaaatataagaagaacccagataaacatatgggttatatgaagccaggtgctctgtgaatattatatgtgtgggttacgcggttgttgtattctctttatntcagacatctatagtgggtgaagctctccgagagtgtgatatgtgttatatatctccccgtgagagtgcgcgagagacttaactacagcggatagtgtgtgttatcagagagagagtgtgagagaatctatctaataaggaagcgattctatacggcgggggagtatagaagtcgcccgtgtgtgtggcgtgcgcccatgttgtgtcccctccctataaatgtgggggggggggagataagggggcgccataagagcggtgagaagtgtgcggctacaaaaggggccctccagaaaaaaaaccccccgttggcagaacgaacaaaaaaacatctttccgtgaaggga

SEQ ID NO: 550087 - DNA, 614 bp, Homo sapiens
tggagcaggtgcccaaaacgtaatgaaataccagtacatctgccaaaatgacaatgtatcattcgtttcctttcttaatggtttgatagacttatttatgggctgcatggagctttcttcgaaattgtccacatcaccatctttatcaaattcgtcttccgcaacaccttcatcacttattttaacggaagccttcttgtcaggagtattcatatcttgtaaaagatagctatccgtttcgcggccactaaatttgcttctcacggagcctttggagcgcagggagccactccgacgagttgcatttgggtttacaccggtacttgatggtaaaacatccaggtgattcatctgctcctgcgttttctgcgcataataaaaatgtggattatcaggattgttcagtcggcttctttcgggccgcactaaagagccttgtctatgaggtgctcctgagccgacactgtgtcttgacctaagtagagactcttcatcttgattaaggttcagatagtagtcatcaggatcatctccattcaagccggtcattctaatttctttcctgcggatagtctaaacaggacctttaagaaaatgggacctacaccaaaaat

SEQ ID NO: 550088 - DNA, 330 bp, Homo sapiens
  misc_feature (73)..(73): n is a, c, g, or t
ttttcccccccccttatttttcctttattggcctggagggtccttttcaacttccgagggtgaacccaaagangggctctttttaaaatcatcccccatcccaaattcctgtccccccaaataaaataagccctatgtttttaatagccccttaaacatggtttttttttaaaaccccttcccctggggtgtaaaatttttgggtttttttcccccctagactgtgggccccttgagggcaagttttaactttttttcttttttgggtttttagaacttgggccagggccccccccccgggggggccccataaatgttggttgaatgtta

SEQ ID NO: 550089 - DNA, 413 bp, Homo sapiens
  misc_feature (117)..(118): n is a, c, g, or t
  misc_feature (156)..(156): n is a, c, g, or t
caagagtttttccaattcaagaaagtccccatgctttggggcagggccctgccccagcccatgtttatccagtcagccaaccagccctccaaagggcgggccccccaggttaccggnnatttagggccttagttggcaaggccaaggacccccacncaattttttccatacagcccccggcaatggggccacccttcctccccaaaggacccggccgccctcagcccctcctgcaggttaggaccttggtgccctcccccccctgcctgggggccgaaattttcccccaaaaaaaagcaaaattttttgtttcctttttttccctttttttttttaaggaaccaatatttccatatgttgagggggggtcccatgctatgaaattaaaatttttaataccatttttttggcca

SEQ ID NO: 550090 - DNA, 419 bp, Homo sapiens
gtcgtctaaggtccccctgcttgtctgcctctgctgagagagcagatcgcacctcagcagccagctttctgccttctagtcacgcctcgtcatattaggggttagcacgaggggtcttcttgttttttgtagtggggggtgtctcactgttgttgcccaggacggttctctaactcttgtcctcaagtgatcctcctgcctgtagctctgaaatgacagcatttacgggtgtgagctggcacacccagcaggttcttaccctttataatgaccacacaaaattctcctggagttcctgggggagattgtctctttgaaatcagaatctttcccatgacagcttgagcatatccttcaggctctttctggattggaggcagaagaaattgcagctcggtgaccacgaaggcagcaaagag

SEQ ID NO: 550091 - DNA, 374 bp, Homo sapiens
cgtgtgaatcgacggttctctattgtgacagagttcgctctttcaccaggctgagtgcagtcacacgatctcggctcactacaacctccgctcccaggttcaagcaattctcctgtttcagcctcccgagtagctgggaccaaatcattctcttttaaagcacttgctgggtcaccagccttgtgtttccttcaggcataggtgccctaactgccaggtcctccttatggtctgcttagtggtgatgcaggcagctatcccatgtcactttactttgacttcgtgaagcaccgtgtggtttggcaagattcgcccttttcaccttcgggtcgcaacgaccagctagggcctagaactctagctgtcaacggcac

SEQ ID NO: 550092 - DNA, 469 bp, Homo sapiens
  misc_feature (24)..(24): n is a, c, g, or t
  misc_feature (41)..(41): n is a, c, g, or t
  misc_feature (83)..(83): n is a, c, g, or t
caccattgtacaagcttagtaacnccagtagcatggcaccnactgtggagaactgcacgcttggtcgaaggcttcttgtaatntcttaggggtttcatcaacaccattattgcccagtgacaggtcaaagtagtgagcgtactgtctgcggatggcctcagagtccttctgcagctgctgcagggattctgtctgagtgctctggtcagtaggtgcaatgagcacaatgaaagtgataagttctgctgtgcgaacaattgtcagggtctcgggctcaatgtcaaggatggcagtcgtgttctgcttatggatctggtgcactgtttcaaatttggtgccgaacatgttgccatggagtctgccaaactgctagtacgcattgtcagatatgttcctcgtcatctcctccgttgagatagagtggtactccttcccatcgtcctcactctgcctagtcgttcgtgttgta

SEQ ID NO: 550093 - DNA, 785 bp, Homo sapiens
caggtgcatggcaccctttcctgtcgggaagggagaggggaactacccccccagctgccctccgcccgcccagccggcggactgtgctgtttcctccgcccccagtcccgtgtttgctgacctcctgcctgagttggggtattatagacatattaattgttctgactgagctcaattagctggttgggagaacgtcttgaacaaaggggagagaatggctgggctgctgtcggagttccccacctccgagacccttccttccacggtccaatcctgagggcatgtggatttgggcacgtgtcttgggggccccccatccttgcatgctgaaggatttgggacgggaggtagcatagacgctagatgaaagtcccccttgggccactcggagcgctgacgaaccttcccagtgtagcaatttaaaccgccccccagttgggctgagaggttcccagcctagctggagtacattacacattcttgggaccccacacatggccctccatccgaacgtggccacccccgttggcacacctttaagtcgtcgcgactgtttccatggcttccttacgacaagttacgcgcagcgaagaggaggaaacataactaatttcctccccattaaaccttggtcgtggccccaaattctgtccaacactgggtgtggaattaggattgctactactcggggtcaacgttctctcattctatgatgttcacccgccccctaccatcctaaccgatttaatgtgatcagttgtcttgtctatacaacttggcactta

SEQ ID NO: 550094 - DNA, 349 bp, Homo sapiens
ctgcctagagagagcgtgtttcttttccctcatcttgagctcttattttcttgtctcaagtgctttctggtaacctttgttcacctggtacttctcaagaaaaaaagaaggatctcttacgagaggagagccagattaatgaattagtgagtcactcatagcagcgcagagcaaggagagaatctgcaatgtgaatgaggaggatctgagtgtgggtgtggttgtacttggggaaaagcaggacctctcttgaacccttgacatggtgcatttgaggcctctctcacagtagggccacgtgagtccctgaggagccgcaaggcatagtacagccttccctatatgggcc

SEQ ID NO: 550095 - DNA, 544 bp, Homo sapiens
agaaaaaaattagccgggtgtggtggtgggcacctgtaatctcagctactcaggaggctgaagcagaattgcttgaacccaggaggcagaggttgcagtgagctgagatcacgccatggcagtctagcctgggcaacaagaatgaaactctgtctcaaaaaaataaaaataaagataaaataaactccatcttaaaaccagtgaaaccaccattgcaaaattataactgagacagtgagagatctgacctaaccaactccatcctacttttaacctccaaactgtccttgttcattcctgggtgtaggccaaactaactttggaagaaacttagttttatgggttttccccgaaaacaaaaatccttttccttgtctggagactagactgctttgtaggacttaacaaattagcccacaagattagaaattcatggtttaagaaattccatgcagctgggagatttaccaagaattctgaaccttcccttaaaattggcttcccgggggattaccattcccttattgaaaaaaaccctaaacaa

SEQ ID NO: 550096 - DNA, 289 bp, Homo sapiens
acctcagccagttctcagacacttaggggacattttctctgcaggaccactctgagggactcttctgcatattgctgacctgagaggatgtcctcagagctgacttggtcaatcctccccaacaggttggggtgtcatttctttccactgagtaaacagttctttaagtggtatatatgtttcaaggggcgaagctactttatttcaggggaaaacgtgtctctttaaagctgctatgtgaacagcttttatagtcattaaatttacctaaactaaggttaaaaaaaaa

SEQ ID NO: 550097 - DNA, 204 bp, Homo sapiens
ctgctctcacatgatgccatcaaagccctgatggccacgacgttcttgctgtgcacctggcaccctgaatctcagtgcttcctgcaggctcctcccctgggagaggctgaagatgacggaggcattgaaggtgtctccagctcccagtgtatccaccacgcgtggtgctgggaaagcatcctgagtggagcaatttgccattgg

SEQ ID NO: 550098 - DNA, 269 bp, Homo sapiens
gtagtgaacacattagttgtatgaacacttattacgaaactgctgatcataaccatcctgtgtgtacatttgtttttctccaaaaaacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 550099 - DNA, 142 bp, Homo sapiens
ctcctaccgacgatccaggtccgcaaagaccagtgtgtgttcttgggcaggataactgaatttccccatttcaccgtgaatggaggtgacgcagttccctttagatgtttgtctaacggttaaatgaaataatatgtaggag

SEQ ID NO: 550100 - DNA, 211 bp, Homo sapiens
gcaaaaacaaacattttatttttcatgataggagctgtaccaaattatatgggggcctttgccaacccccaggctgggactggggcctgtgaccttgaaaaccttatttaacattttgcaaactttggggggggggcagggctcaaccactggctgggtgggctggtcttaacctttcctgcaggcccagggctgaaataataaccgtaag

SEQ ID NO: 550101 - DNA, 111 bp, Homo sapiens
atggccggtgaagagctgcagtgagactctcctcagtgctcatgaccttgagccatgtgctggtgacagcctgtgccatgcagggcctttcacagcctcttcacccgccat

SEQ ID NO: 550102 - DNA, 881 bp, Homo sapiens
  misc_feature (647)..(647): n is a, c, g, or t
ctcacatgctctgcatggtgcatcccgagataccgccccatgagacctgccatccagttggttgcccaggctctacggtgtcgagatccatccgatggcctaccagctgcggtccaagtcgccgagcaacttcatgagcgccagtcaagaggagttcgcgtgattccctcccctactgttctgcagtctttgaacttttccgtttcttttctagccaacctttatgcaaccctgtctgggtgctcagtattaatatttaaaggatgtcgttatcgctggtgggaatatggagataaagtatacatgatgcgtcatctggagcctagaaataaagggtcatcgaatggtggtgtgagctcgacggttccccacttggaggacacgtctgtactaatcacgttcgaatgctgccaggtccctctggagggtcggccaaacttgcttttgccctccttggtccaaggacacagtcccggggggaataacatactctttcgtttaggccactggattaaagtaagcgcccgggggcccagtcatgttatcgttacacacttctagtgtgcttgtgtatggacgaacatcaggacataatggaaaacccgatagactactttaaagacattgtgcccgcgggggggtgaaanccctctgaagtgtggccgttcggacttggttaattctaaacaaccatatttgtggaatacgcgtgaaggtgggtcacacaattgggaatgttcttgccctcttctcccaagggagggccccacatattaacctcgcattggttaatgcgctcctagcttgacgaccatatggcaggtttcacttcgttgcttccacattctcgcgaaaagccactatttacgcatccactttcg

SEQ ID NO: 550103 - DNA, 120 bp, Homo sapiens
  misc_feature (86)..(86): n is a, c, g, or t
aactttaagagattttttttattgaaggaacaaatcaaaatggctcagaaaattcagatggagtggatacacaatatcctcacatngtttttgcccaacacaccgaacacaaattttctt

SEQ ID NO: 550104 - DNA, 555 bp, Homo sapiens
ggccaaacacaatagcaagtgctgcagttgacaagagtcctgggttactaggtgtctttcagaagcggatgcatccaaagcaaatgaccaccaaggttttgtatcttctaaacatgtataagtagagcacatgcctccgtgaatcagttgaccatatataggaaacaaatcttcattctgctatgccagagacttcagaattccagaacaaccaagtttatcaagagtttagtagtctagataaattggtatggcataaaatatggggcactagccctacaagaaatctttgatggtatacaaccaaaaagtgtgggaatggtctgggaaaaaattataattcctgaaattcagaaggtatctggaaatgtagagaagaagatctgtgcggtgggcataaccaaattactaacagaatgtcccctaatgatggacactgagtataccaaactgtggagtccattattacagtcttggatgggacttttcgagttacccgaagatgataccattcctgatgaggaacatattattgacatagaagataaccaggat

SEQ ID NO: 550105 - DNA, 382 bp, Homo sapiens
gtgataaactgattgctggttgatcccagtaccgtgatatcgataacattaaacgaagagataccctacgcgtgtatgaaagtgcaagcgagcattattacgaagtcctagtattccggatcaccgggaaggaagtggactcatctctgagctgagggatgacttacctgttcagtactctacaatacctctgataatatattaacaaggatgtatttcttaattaatgttaatattaaaaagtctgtatggcatgacaactacttaaagtgagaagatacgatttctgtctactaagtgatgctgtgataccttaggcactaaaagcagagctagtaaatgctttaagagtaatcatgttggtttatttacacagataggg

SEQ ID NO: 550106 - DNA, 160 bp, Homo sapiens
tgaccttcactatagtctgcattacttctaccgattgaagatcgtttttccttctttggatcggtaatttgattccatattctttatccaataaaacaatcaactccaaagcatcgatgaatctaatcccaaaccgtcaccaaataaaggatcatcattt

SEQ ID NO: 550107 - DNA, 125 bp, Homo sapiens
ggtgtagctcagagacagtcttttcttgagggttcagttttcctagtcatcctaccagctcccaaaggtactcagtcgggttagtcaacctctctattcattcatagatatgggcgtgatgccag

SEQ ID NO: 550108 - DNA, 1803 bp, Homo sapiens
  misc_feature (168)..(168): n is a, c, g, or t
acggatacgacaatcttgctgtgttcttcagagattaaccgagttgaggtcgtaaagaaattatttcacgaggtattattattacgtatctgctgttgtcacatatcttatgtctcttgtggtgtgtaacgttggatattcaacacagaatgcatagatggcatttantctcataggacgagtgatcctcttgtaattgcatttaccatagacatttgcacgtggcagcacacgcaaatgtcacaaatgattcacacatgttctctactactagttgctctgcgtgagcgcgctaatcgctatgaataacgtatatctgccatacgacgcgtgtatatagtctctctagtttgcacctctctatatagatagagacagtctgtctcattctatcataagtgtgtgtccatatgtattgtcaatgtcaatccaaggtctctgtctatactctaataatctggtcgaggacgaaaacttctttacaagtgtgacttgtaatgagcgactattatctgagaccatattgtctcactgtctccttatacccgcgaggggacatcataatttagcccaatcacggtggctcttttcaaccacagcagaccgtgagtgaaaagccggcggatggcgttgctcacgcggctcccttatagtcgctgtggggggacgagacacgacactcccactcacactctcactctgtgtatacaccccacggagggacactgtgatgtgcggcggaaatagtcgccccacagtttagagtgctcgagcccagcccaaagagagcacactttgatttgcaagacatctgtcacccaggggacttagaatggagctccattggtctggatcgcggcaatcccccttggtcggaccccagatcggggttgtgaggtgcgccggatgatgcacaccaacgacgttggtgcacctcgcccatagtgtgggggcatccaccgtgattgtcatcccgccaagaagttgccgttggggggtttcaccccggtgtaaagccattatgagaacgacacgcgagtgggtgttattagttataggtagacccatgtgttgcggccgcaattcgtagggcgtcgaaaattaaaaatctcgatccttcggcgccaaaaggcggggcggaacacccatacgagaacaccgtttccctgtcaatttgcgccccagtttttacccggaacccgtgcaacagggggatctcccgaacccacattgtggataggatcgggtcgctccgcgaacacctagcgagagtgttcccagcaaccctcggcgttcgacaattatagtaccccccgattttttgtgcgctcatgggcccgccaggattaaagcccacccagtggcctcgttggctccccattattggcggtccccaaaaagccccccccggggcgagacccatacccgagcgcgacttgcacacatagctacccaacaccagcacagcgacaccttccagacaccccccggcgcgcggccccaacacacaacgcagccacctcatacaccgacgcccagcgcgaagacgaccgcccgcgccccaagcaaggtcgaccccacccgcggcacccacacccacaagccagcgaggccacactcgagcagaccgacacaccaagcggcagcccgcaacacaacacgagtcgagacaacccgccacactgccaacagcagccacaccccaccgaatcacaggcaacccgcgaccagtccgcaccacgaaaaaacaccacctctcggcagccgccacatccccagcgcgacacaccacaccacacagcc

SEQ ID NO: 550109 - DNA, 110 bp, Homo sapiens
atacgaatcgagcttcggtacccacccaccacacctctctcccagttaattgaaaagtaggtatgggggaatcagatgaaatatatgagaaagctgtaaacctgcactgt

SEQ ID NO: 550110 - DNA, 159 bp, Homo sapiens
ggttactgatgcataagagcagcacactaaaatggcataaaaatattaaatcacaaatggatagtgagaccatgtggcatactagaacacccaacatagtacgctactgaaaacattaggcaagagagataaaactataaagtaggcttcttcagttca

SEQ ID NO: 550111 - DNA, 103 bp, Homo sapiens
agccggacctgactgcattagactagctacttcatacgcagccccaccaagaaagactaatctgcgatccgatatacccattactacgatctaaatgcaatca

SEQ ID NO: 550112 - DNA, 965 bp, Homo sapiens
gaccccggaccgaccaaagcccgcgcgccgctgcatcccgcgtcagcacctacgtccctgctgccgtcgccgccgccaccatgcccaagacgacaacggctgaacggggactgctaacgggacgactaacacgcaacacggtgaacggacgaaccacagacgaagatccgcgaggttgtctgctaaacctgctcctccaaagccagagcccaagcctaaacaaggcccctgccaacagaacgggagagaaggtacccaaacgggcaacaaacgggaaaacgctgatgctggcaaggcaggggaataaccctgcagaaaactggcagcatgccaaaacagaccaggcacagaaagctgaaggtgctggagatgccaagtgaacgctgtgtgcacttccccgactaccctgtgctactctctggctgactgtacagcttcgaacaatacctatcctattatcacagctcccatacacacaactgccagtaatttctcgctcctcaacccttctctccactctctcttctcccaccacgccatcgctgcctcgctaacgccacaccacagcacaccaccactccaccgtgaccgcctccccccgcggcgccaaacgcgcgcgcaacacgtccacacaccatacacaacccaccagcgcccctcccacagccgcccagccactccgcaaagcccgcgcacacaccccccccctcaccacgcctatcctccgcaccacggcagcacgaacctcccccatcaatagggcgcctcacccaaggagaggacgaaggcggagaacaataccccccgttgaaccctaccacgaccccaccgccaaactcgggccaccaccgctcaatcgcgccaccacgagcacaccgccccctaaggagagcaccacaacacaccgcaaacacacaccccacaaaccactacggccaacacaaagcaggaacaccaacagaatg

SEQ ID NO: 550113 - DNA, 387 bp, Homo sapiens
aacacatgtgaccgtgatataaaaaatatctaggcctggcgcagtggctcacacctgcaatcccagcacttagggaggccgaggcaggcggatcatctgaggtcgggaatttgagaccagcctgaccaacacggagaaaccccatgtctactaaaaatacaaaaaaaattagctgggcttggtagcacatgcctgtaatcccagctattctggaggctgaggcaagagaatcatttgaacccaggaggcggaggttgcagtgagctgagatcacaccactgcactccagcctgggcaacagagcgaaactccgcccccaaaaaaaaattaaattaaattttaaaaaggccagacgcagtggctcacacatgtaatcccagcactttg

SEQ ID NO: 550114 - DNA, 315 bp, Homo sapiens
tgggccgtagaaccaagaggttgtagtgagtatttagaatgaactgggcaggaacagagatatagattatagaatactgggcaggaacatagagatatagaacactggaatgtactgggcaggaacagagatatagattatagaatactgggcaggaacatagagatatagaacactggaatgtactgggcaggaacagagatatagattatagaatactgggcaggaacatagagatatagaacactggaatgtactgggcagaaacatagagatatagaacactggaatgtagtcgacgcggccgcgaattta

SEQ ID NO: 550115 - DNA, 224 bp, Homo sapiens
ggagcaagagagagagatgggggtagatgtctcacacgtccaaacaaccagacctcgggagggcgtcactatcacgagaacagcaatgggcccacgctgccccatgatcccctctccttcctccaggcccctcctccaacactagggattacagtctgacctgagatttgggtggggacacaaatccaaaccacatcacctgggctcacctgtgtcaccaaagg

SEQ ID NO: 550116 - DNA, 128 bp, Homo sapiens
cacgaggactacgccggtaccgacataccaaccctgactggtgatggctgcggtggctgggccaacgaagattctcgttcagcacacctcaggatccgagccatgcgactggaggaacagcacacagc

SEQ ID NO: 550117 - DNA, 205 bp, Homo sapiens
atcacttcccgtaaacttttggtggagaaggaagatcaggaggtggacatttactttagctctatcaaataatttcatgactggcaactccttcatactggtagctgcagcaggtcctattaacaaaacaaaacaaaacaaaacattttggttaatcaagtctgtggaacaaggaaaaaggacacaaggtagggagggatccaga

SEQ ID NO: 550118 - DNA, 1033 bp, Homo sapiens
gagcgggggagcggggtacgcgagtggcgaggcggcactgcggggccgggaatgcccgcggtgcggggccccagagccagccggtggtcgtgtccgggcgatggcatcttcgcctggtcgccgacttcgacctcgggaaggacgttgctcccgtgattgctgtgttctgcagagggcagtgtcggaagccaagcggggccccgggaagccgggctggcgcagatagtaaggaaaaaggaattatgagcacgcttacacttgttatttaaccgtgtcggacaaggacacattggccacattatgacttaattaccctattcacgggattgcattccgcgcgacactggtccgcccttcgggaccttcatactgacatgcgtcaaagccccaaggaccaacacttggacgctttcttatttatttaaccccttttgtgggaaggaacaggcaactttggaccacagtgttttccgcacgactgtcggactcctgtgattcaaagccgtagtttggaacgcgcggggacctttttgtactcttggccgttggcccaacgggttgttaaggctttccaaggattcattaaacttaaaacgcgcaacagcgtgacgagccacaccgcggcaacacggtacatcgtttgacgaaacgcaccgcaggcgataattccaagcatgattgtgcctgtagcccccttttgtgattacggcgatcgtggatgcaacacctgcgccaacccccgctggtgttctgaacaccaagcatttggctgcgcaaggcgttctcgataaaagaccgggccctttgtgtgggacttagggcctcttaattattttatcgggagtgcgtttcccagggcttatatacgtttcagtataccacgaagccaacgtttagtttgtgacacaggggcgtccacgcttccccgttgccattttcacgctaaagaatcagtcataatccagctcaaccatcccgatgggtctcacacgactttcgcactttttatccactcgccacagaccacatgacg

SEQ ID NO: 550119 - DNA, 480 bp, Homo sapiens
  misc_feature (185)..(185): n is a, c, g, or t
gagtatgtggggcacaggactggtagcggtcgtggctctgtggcagtgcgtccggctggtgtcctgtgggccgcttagtggttatgcgactagagacagatgcgatcatatcttgcagtcagtcaaatgtgatccaagtggcctagatgacggttctacatgcaaggcagaatgtagcttacaanagctttgtaactacaccataggtcttgcccatggtatttctttgagaacccgcaagtacacattactacccatacacgggtgacgtgcgggatcgctacattttctcgagagaaagcccgggttttgcaaagggaaggcagtttgaattcgcttatactgggaatgcgacattgaatttgcttgacatggacagattcacaccggaggtacacccgagttcggagaaggaaaatctttgaggttgtgtggaacagggagggttgggaaaggttaacgtttaaggtggaaagatgg

SEQ ID NO: 550120 - DNA, 93 bp, Homo sapiens
cgcatgttacgagagcgggctgcgtttgtgtggtaatggggaggaaatgtcactgtcgaagaccaaaaacaagcttcttggataaaagactct

SEQ ID NO: 550121 - DNA, 193 bp, Homo sapiens
cctcggctccgcatcagagggagacggtggaaagagagggagagggagaccgtggaaagagagggagagggagaccgtggaaagagagggagagggagaccgtggaaagagagggagagggagaccgtggaaagagagggagagtggaattttgactcttaaagttttatgtgataatgccaaattgttttcc

SEQ ID NO: 550122 - DNA, 353 bp, Homo sapiens
  misc_feature (117)..(117): n is a, c, g, or t
  misc_feature (120)..(120): n is a, c, g, or t
tttcggtgttttccttttaaaccaaagggactgaaatagcattgagaaatatttttctttcaaattctggttcctctcacctatgtaactgtataccttaggcatggccaggaggcngantttaattctccttcccactatcacctcttcattcttgtgttcctcgttccccactccttccactaacaatctccctggactcctcctccatactgtatgtgcatgcattcacacacacatatgtacatgcacatagatgagatgaatctgcattgtaaaaaaattaaatcacatttagtgctgtataatttgcatgcaataaaattcaataaaattaaatgtaaaaaaaaaaa

SEQ ID NO: 550123 - DNA, 234 bp, Homo sapiens
cccgggctggagcgtcccggttttaagtcactgcacgatactagaagagctgaccttttttctggcctcacagcttatgctgaagcttagtgtgatgaacagagatgacctttctcgtgaccgaccgctgggtgcagagatggtctatgtcgccgacgatcctgcgcatcatgcaaggtgtaggcgggtccgtcggggaaggggcagtcttccactagtgtgtgctgcagcagt

SEQ ID NO: 550124 - DNA, 295 bp, Homo sapiens
ctagtatagaagtttcaatagcaactggaatagtataagccacatggattgtaaggaagatgaattatagtgacatccccattacccaaagtttattgtttaaaaccagatcgtctaatatgatgaggtcttctggcggcataaaaaccatttacggactgggacctctccatttctatctagtcagtatctcgtatgtcgtgtattaatattaacaagtccatgagcaggaatattatccttgaattatcccatgatagctattacctgctatagaaacttctaaaactaggga

SEQ ID NO: 550125 - DNA, 179 bp, Homo sapiens
atagtatctgtactgagtaaaaaccatcccaaaaggtgctaaacagcaactgtgtatttgtccatgattctggggttgggctaggcctggctgggtggttgttctgctcatctggtcagtggttactcataaggcttcattctgctagagaattggttggggaactgggctccgctggg

SEQ ID NO: 550126 - DNA, 124 bp, Homo sapiens
ctggtggtgtctctggtaggactggaccgtgtccctgagtctcgtgtgtacatgagcccctgcggatccgccagcttctccgtcccttcttcctgctagcagatctcctctatgatgaagaaga

SEQ ID NO: 550127 - DNA, 767 bp, Homo sapiens
ttcttcaaggagctgaactacaaaaccaattctgagtctccctctgtcacgatggtcaccctcctgtccaacctgggcagccagtggagcctgtggttcggctcctcggtgttgtctgtggtggagatggctgagctcgtctttgacctgctggtcatcatggcctcatgtgtcgaggtcgaagccgatactggtctccaggccgagggggcaggggtgctcaggaggtagcctccaccggatcctcccctccttcccacttctgccccacccatgtctctgtcttgtccagcaggcctgctcctctccagcttgaagccctcccgctatgccctgggccgccatctccaggggtctgaggggcgtcctccacgtctcggggggcctgaagggagagagttctcaacaagcagatgctcctctggggaggggtggcctggaagatgagatggcggttctctcaaccgcaatgcgttgagtgtgaggaagagatgggtaagctcagaattgtcagacagtactgtgaatgcaaatgctggtcaagctgtacctgtatgcttgaatctgttccacaaggggtagcctttcctggatagcaagcacattggcttgcagactctagaacggtacgagaaacacaggtagcgtgggtcgccaaggtgctccggggtgcagtccacaatgctctatgggacccaactggataacccgcggataggagacgtcaacaagtacgggacatactccaccttactgccgacgttttg

SEQ ID NO: 550128 - DNA, 115 bp, Homo sapiens
gggaacatcagttctacgagaccctccctgctgagatgcattcactccccaacaaggtggtattgtgcgctgaaatgaaggaactgtgtctaatagcatatcttgaaaggggacc

SEQ ID NO: 550129 - DNA, 243 bp, Homo sapiens
aatgagctggccccccgtgtcgatggcccagtgagagggctcaggagcaggcaatgtttggcaaggaggtcagttgcccgcatgtcatccagccaaggaagtggtgtcctgcctccgacagaagcctgccaagtgtcctcaaatgatgcccagatcaagactcctggcctgtgagtggtctctttccacatactgggtgtcttgctgatctgatggccgacttacctccgatgtagcctccag

SEQ ID NO: 550130 - DNA, 427 bp, Homo sapiens
cactccgtcgtggctcacattgatatatattagtagtgcatctatcccctacctccctaatatttcaaacttctatgtggacaatgacattcattttcatacctttatatttccagagacaacagaaacacaaaagcagcttagatgtagatttaatgaaagtagcaaaatgttaaatacataacaaaacagattgtcctgtcacctaaaacaaattagtgatgtatgagtcatatcgggttttgcatgtgtatatagaaaggctattttgcaaacagtggttcagtctgtattgggcacaggtgcattctgccctgcgattgccatctttagcacttttcagagaatttgttgccattaatgacactgatcttcagacacactgtgtagtgccttggattaaactgtcagactggcaacagatgag

SEQ ID NO: 550131 - DNA, 360 bp, Homo sapiens
  misc_feature (37)..(37): n is a, c, g, or t
atacatgtggtacccacgtttgtggtgggaggccctngttctactacccagccacatcaggcgcagccttggcagagggcttggactacccagtgcagttcgggttgcactcaggctaggccaaccgagacccctcagccttcgagactgaggaggtccagtccagccgacatgtttttccagcctttatagtagtctacttgttggaggagttgctggcgacggggggcccccacttgggctaccagggcatctcagtgctcctggaggacaccacagtcaacttctgcgtctccctcaccacctccaaagtcgcaggggcaggctaagcccacttcgtcctcccaccacaaacgtggg

SEQ ID NO: 550132 - DNA, 332 bp, Homo sapiens
acctttcggcgcgagcaccaggtcacttcttagatgacacacacacacacacacacacacacacacacacacacacaacaccccgagagtgcactcacctgggcaacaggtgggactatatttgtgcatatgagggacccccagtcccctccttgtgtgtataatttctggaagcccaggcgcagtctcagcttgtaagatatcctggcggtggcccgcgagttgcaccctgggagttatggggaaaggcgtggactcacggagtcacaggcagattgctccttgggccctctggtgttctatgatatttctcgcgcgcgtctacccccatg

SEQ ID NO: 550133 - DNA, 235 bp, Homo sapiens
tatttcaggctctaaaattctctgtgttggcctagtcatccctctctccaccctaacctttaaaaccactgagcattttactgtctccatcgttttgcctttttcagactatcatgtagttggaatcatatagtatgtagccttttcagattggtctctttcacttagtaatatgcatttaagtttcctcaacatctttttgtgatggcttattcttttagcactgaataatagt

SEQ ID NO: 550134 - DNA, 281 bp, Homo sapiens
gggggggttaaaaaaaggaaaaaaaatcttttccccccctcccccagaaaaataggccccaaagaaaaagggttaagcgggctgcccccaaaaattatagggggggtgagaagggcaaaatttttcccctttttcgaggggcccccttttaaaaatggggggggggggggtttagggcaagcccctttcccccccctttttggggcaaatgttttttgcctttttttttccccccccccaaaaccaaggaccggtttgggtttataaaaaccctgccctca

SEQ ID NO: 550135 - DNA, 353 bp, Homo sapiens
  misc_feature (98)..(98): n is a, c, g, or t
  misc_feature (119)..(119): n is a, c, g, or t
  misc_feature (186)..(187): n is a, c, g, or t
agttacaacagcttcccaaggatgtggttatacttggtcggagcctgtgacaattgttgacactgtggaccggtccaaaattttttaaactgcacctngtgaatggtagttgaggtctncatacagttcagcctctagaatggtaacaaatcagccaattggattcgaaacaaagaagactatgtnnaactcacccatcacacttgagactactcactggttggaagaatatagtattgcagcaaatcctgtatgtaagagcgatgtgggcttccgtggtgtgagtcttgtgctataggtgctgagacgttttcacatgggcataatacagggagagtgtcttctaataaagt

SEQ ID NO: 550136 - DNA, 654 bp, Homo sapiens
ggaaagaccgccgctaccatggaggagtaccatcgccactgcgatgaggttggcttcaatgctgaggaagcccacaatatcgttcatcagtagtgtgtagcatgggagttttaaggtggtcgcaagatctatacagtcacgaacaacatcaacccaggtgagactgcaagcatagtggaacaagtccttaacacacctggttcagttgggaaacagcctataaatatattgtgaccctgtgcacgtggctcgcagcaagagcgcatatggctttcacacagccagctcctgttctttgggataccacatctgatggaacctgtaccgtaagatgggagaaccggaccatgaactgtattgtcaacgtttttgccattgctattgttccttaactgactaaacactgtcgcgcgctaaagccattaaccttaacgaatccgtcacgctgtatcctttccaacaaagacgtactagttgtctactagtgtgctacgatgacacagcgtgcaatatgctttcaacagctatcaacaaacactgaatattatcaagcaagcaatatcatacgtacatcgcgcagattagctcatattctatacagcatcgtttaaaataggaacaaccccaatgctagcaaccacatcaatttagaaa

SEQ ID NO: 550137 - DNA, 747 bp, Homo sapiens
ttcgccacatagtatgtgatgagagagtcatataacagcagtctgcttgattatccgcgaatggtcagccttatcagatagttcttcatgtggagttcatctgcatgtgcccttactctggaagcctcttcctgatctggaccaccgtctgtctgtcttcccagttcatctccagtcctcgagaaaggccctttaaatatgtcactttccccattttcccgttaaccctgggttgtgtgagcccagaaagagctttgagaaagatggctgcgttcccacccagggtggaggcttctaggtctgcatgatgatggggcccctttcatggcccgagggtggctctgggacgccagattgtgctgcgggcttgctgggggagaacgctaactgttgccagaaaccagagcttcatggcttgcttaaattacttagctgcgaatattttaaagtgtccagataatgtgatgtaccaagagagtatgccgatgccatttcattgtttttcgccattatctgtactccagtatttccccttgctagcccgaataatccagaccccagactgtttcttgtccactggattctggaagccttgccctttccactggatttatgtttgtttctgctgctgtgaaacccccaagtaatgccgtaggttttaattgaaaattgtttaattctattattgataattatttattgtaataaaagtaaaagagtaatttttaaatcccttttaattgttta

SEQ ID NO: 550138 - DNA, 279 bp, Homo sapiens
taggctcggtacctgcttacttaacccagctgtgcattcatgatagactgcatagaaaatgtggcacatatataccatgaaatactatgcagccatacataaaaaagaatgagttcatgtcctttgcaggacatggataaagctggaagccatcatccttagcaaactaacagaggaacagaaaaccaaacactgtatgttctctcttataagtgggagctgaacaatgagaacacatggacacagggaggggaacatcacacactgggtaagtaagca

SEQ ID NO: 550139 - DNA, 733 bp, Homo sapiens
attctagaggccgaggcgggtggatcaactgtggtcaggagtttgagatcagccaggccacctggtgaacacccgtctctactaaaaatacaaaaattagctgggcgtgatggtgggcgcctgtaatcccagctacttgggaggctgaggcaggagaatcacttgaacccgggaggcggaggttgcagtgagccgagatcgcaccattgcactccagtctgggcaacagagtgagattccgtctcaaaaaaaaaaaggaaagggaaaaaaaattagtttatacccttttcctggttttaaacggccattgaaaatttctggaacactccaaatttcaggtggaattaatccaaaacaaaatttatacgtattaaaataattttaaccttctatatagatactaggtatacttaaaaaaaggcctcggggtaatataatcttactaaacaggctaaacaattcaggtgcggttacatttaaacaaacttatgttctctagtggagaacaacttaggcctatttcaacgtgggtggtagcctcaggggcctaacaatgggtgccaaattaaatattcgtagaattacagtgaattggtaaacccattcgtttttgttaaaatttgcacaaattcaaaaggtcgtgataaatggtaatcttggagatatcatttattcgattccagatatgggagggtgggggtgcttagacatagtctcatatttaaactaatag

SEQ ID NO: 550140 - DNA, 539 bp, Homo sapiens
tctctagagaatgccacgatgtcatacctggatgcatgatgaatgaggcctagggtccatcaatgtcaccatgtctggaccatggttggtgagaggttaaatggcacagatcctgaggatgtcatcagaaacgcctttgcttgctttgatgaagaagcaacaggcaccattcaggaagattacctaagagagctgctgacaaccatgggggatcggtttacagatgaggaagtggatgagctgtacagagaagcacctattgacaaaaaggggaatttcaattacatcgagttcacacgcatcctgaaacatggagccaaagacaaagatgactgaaagaactttagctaaaatcttccagttacattgtcttactctcttttacttctcagacacttcccccaccctcatagaacctgttgcatgcaacttagtttcacagctttgcctcttctttttgatgtatttattccagacctttctgccacttagcacttgtataatcagactggaaatggggatgagggtgtacattgtat

SEQ ID NO: 550141 - DNA, 277 bp, Homo sapiens
cggatagtacatagggaaggggtaggctatgtgttcagtcagggggtagagaatagagtgtagaggcgtattataccactagccgcctaggtatagagagtactgcggctagtactattgacccagcgatgggggcttcgagctgggcttaaggtagtcctaagtggagtccgtaaagagtgatctttactataaaagctattgtgtcagctagtcatattcagttgtaggctcaggagtttgatagttcttgggcagcacaggttcagcgtagaag

SEQ ID NO: 550142 - DNA, 457 bp, Homo sapiens
tctattctttctactcattaaggaaaaaaggttagctgtaaaacagccccagacaggtccttcggaaggtattccaaaagaaggaatgttatcaaagatgatagctccgtgtgtgttactgttcctgaagaccttccagtgggacaagatgtggactgagaagacagtgatattgatgatcctgaccctgtgtaggcctaagctaatatatatgtttatgttttcattgttaataaaaaaagtttaaaaagtgaaaatgaattttttggagacagggtctccatctgtacaccaggcttgtgtgcactggtgcaaacacagctcactgcagcctcaatctcccaggctcaagcaattcttctgcctcagcctcacaagtagctgggattacaggcgcacaccaccatgcctggctaattttggtatttttagtagacgaagggaaacaccgggtacc

SEQ ID NO: 550143 - DNA, 195 bp, Homo sapiens
aatgaaatatgtgatatatgtatacaaatgctgatcgtctcttctcctcgccctatgtaggatgtcaacacatacatttcagggtttgggcactaccagtgagaaattcctttctaactccagcgacaaatagtctagatgcgagatagaaattacattccagctggcaaatagcgagactcatctctactaacg

SEQ ID NO: 550144 - DNA, 820 bp, Homo sapiens
  misc_feature (149)..(149): n is a, c, g, or t
  misc_feature (171)..(171): n is a, c, g, or t
  misc_feature (235)..(235): n is a, c, g, or t
  misc_feature (423)..(423): n is a, c, g, or t
  misc_feature (431)..(431): n is a, c, g, or t
  misc_feature (455)..(455): n is a, c, g, or t
  misc_feature (464)..(464): n is a, c, g, or t
  misc_feature (470)..(470): n is a, c, g, or t
  misc_feature (472)..(472): n is a, c, g, or t
  misc_feature (477)..(477): n is a, c, g, or t
  misc_feature (480)..(480): n is a, c, g, or t
  misc_feature (486)..(486): n is a, c, g, or t
  misc_feature (504)..(504): n is a, c, g, or t
  misc_feature (518)..(518): n is a, c, g, or t
  misc_feature (520)..(520): n is a, c, g, or t
  misc_feature (525)..(525): n is a, c, g, or t
  misc_feature (528)..(528): n is a, c, g, or t
  misc_feature (531)..(531): n is a, c, g, or t
  misc_feature (534)..(534): n is a, c, g, or t
  misc_feature (537)..(537): n is a, c, g, or t
  misc_feature (540)..(540): n is a, c, g, or t
  misc_feature (546)..(546): n is a, c, g, or t
  misc_feature (554)..(554): n is a, c, g, or t
  misc_feature (564)..(564): n is a, c, g, or t
  misc_feature (569)..(569): n is a, c, g, or t
  misc_feature (571)..(571): n is a, c, g, or t
  misc_feature (574)..(574): n is a, c, g, or t
  misc_feature (577)..(577): n is a, c, g, or t
  misc_feature (579)..(579): n is a, c, g, or t
  misc_feature (581)..(581): n is a, c, g, or t
  misc_feature (588)..(588): n is a, c, g, or t
  misc_feature (608)..(608): n is a, c, g, or t
  misc_feature (684)..(684): n is a, c, g, or t
ggccagccttggaaaaaaatgatttaatttgcctttctgaggcagggcggggatggatcacttctaacttccagttaagaattaggtccgccctcaagccaatattgactatgcatctcaggagctctttgaagccagggggctaacgnatgtgtgtgaagtcctggctgnaggtcctccccaggtggccttcctccttcctttaacaggcggtctctctgacaggaaatggggnaaggatctagaaccacgtgcacctagagatgtttctgtaaatgggtacttgtgatcacactacgggaaatcaaccttatttgggggggagtatggggaaaagagctgagagtttatgctgaaatggatttatagaatatttgtaaatctatttatagtgtttgttcgtttttttaactgttcattccnttgtgcanagtgtatatctctgcctgggcaanagtgtggangtgccnangtgtnttnattctntcgcacatttccacagcncctgctaagtttgnanttaanggnttntgnttntgnttttgnttgtttcntgaaaatganagaananccngananangattttnataaattttttttttttttnttttactatttatagctttagatagggcctcccttcccctcttctttctttgttctctttcattaaaccccttccncagtttttttttatactttaaaccccgctcctcatggcctcggccctttctgaagctgcttcctcttataaaatagcttttgccgaaacatagtttttttttagcaaagaccccaaaagggataccgagctggaat

SEQ ID NO: 550145 - DNA, 925 bp, Homo sapiens
  misc_feature (9)..(9): n is a, c, g, or t
  misc_feature (230)..(230): n is a, c, g, or t
  misc_feature (555)..(555): n is a, c, g, or t
  misc_feature (588)..(588): n is a, c, g, or t
  misc_feature (591)..(591): n is a, c, g, or t
  misc_feature (604)..(604): n is a, c, g, or t
  misc_feature (615)..(615): n is a, c, g, or t
  misc_feature (642)..(642): n is a, c, g, or t
  misc_feature (664)..(664): n is a, c, g, or t
  misc_feature (684)..(684): n is a, c, g, or t
  misc_feature (715)..(715): n is a, c, g, or t
  misc_feature (719)..(719): n is a, c, g, or t
  misc_feature (782)..(782): n is a, c, g, or t
  misc_feature (806)..(806): n is a, c, g, or t
  misc_feature (819)..(819): n is a, c, g, or t
  misc_feature (826)..(826): n is a, c, g, or t
  misc_feature (895)..(895): n is a, c, g, or t
ggaccccanggattgttcttgggcccctgactgataggactttgaccaacgtttcactttgaccatttgacgtggggcccagcagccgtagtcacccagagtgccggcacccttggggaggccggtgaggtcaggaaggcatcgtaccgctttttctcctcctcccatctcgtggtggacagacagaaaaaggatctgggaacttgccctgggggccacaggcctcagancccccaggggcccaacctagggcatggaggcggctgctggtgcgtgggcggaggcggaggccagctgcccccagcgtggcagcgtaaggcacaatttcaaatcactcgagacttgacagtaaacacccgaagctggttctgcggccggaggagctgtggctggggctggtgctggtgcggtgcccggcggtatttctcagaggaagaagctacagtttagacgctgggcgggttccggctgcacccactccggcttggggcgcgttccaggggagggtgggggcctcagccacagccacttggcctcctcccctgaggggctctnaggtacctcaggtacctatgttccaaggcagcnctngagaatgtaggtnagaggtcagtnaccttgttctccagttcagcggcaatntgctgcaggcggaaggccagcngcatctcctgggcggcaggntcctcctccaagggatttatgaacttgttanagtncttctgcgtgtattggtagagctggtggagtccaagagggtgtacaaggagtgcgtgtgcgcncgggaaatctctgccaggtgtgtntacatgttctggncgctganctgcaccatctgccggatccctttgtagttatcctccaccatcttcttgtaggtggagatctccttggngtacagagcttgttgctgggagaatcgcgg

SEQ ID NO: 550146 - DNA, 1905 bp, Homo sapiens
ggccaactctcgacactctgttcttcctgccggctcctgccgtcgccgttctctctgcctggtcgccaactggaagaacgacgatcgcctgcgctgtgtcatctgaccaactgtgctcctggcactgtgcaaacgctgtgctttatgcctacggcggacgcacagcctcaccctgagcccgactgttctccatatcccactcagatcagcggccgacccccacgaacacccaggggcccggctcactgcgcctggcgccaactggcgccccaccgaacgggcaccatccattaccgctgctggcgccgaaccgacgcgcccccagaagccacatgcccgttgagcacttccatggaaccccctgcacacgctacccccactctcgcaacgcccacgcgcccacttcggcctcccaccccaacaacactggcgccaccggcaaccacttgcgaaagccaaacgccacgtcctggggccaaccccaaccgagcaccctttgcctaaccggcaaccgcacggccctggccagcacggtctgggcggccccccgcggacgccacgcggcaacgccaaccccaccaacgcctggaccctgggcctacgaaaccccggaacgcggacccaccccccccgtaggaaacaccccccccgacatgggggccgccccaaaacccaccggcacccgaaccgcacacccgcaactagggacccgttcccacagcgaacttatccaggctacgctatattagggacggcagaccccccatcactcaagcaaccccacgcccccccccgtggcggcccccaacttgggcaacagcccgcatcggagcccccaacgtttccccaaatggagtgacccctggctttggccctataggttcccccccctgttcccctacacccgcccccatttcccatgggtgatcgtccgggccccaccaccaaaacaattagcgcgcccaactcttatcggcgctcccaactttgggacatcccgttatccgtacgcgagcacgcaaaacccgacggtggaggctatccaacccacgccgaaccacacaacgacggggccacgagccgccccccaccactacgcttacacccgcgcaaaccgccgggccggcgcctaacaccacgcccaccaccatcaccacgacgcgcgcccgaaacgacctggcccccacaagattccgcccactggccagcgcgatcccattgggggcgccacccccccattgggccgccccctggcggcgcccccggccgacggcaaacacgcgccatgcacaaccccccgcgaatcccccgttcgaacccaccgcatagccaacatcagcgccaccacacagcaccaccaataccccaactcacacaaagcccacgagccaaacgacccgccgcaaagcaccggccgcaactacacacccacaggcccaccactttcgcccccacaccccgcacaaccggcacgccaccgcgagaccgccaccgggcaaaccgcccgcggcggccgcgcaacaaacacacactcgccgcgggacgcggaccagggtccaccggaaaacaaccagacttcccagaacctcgcgaccacagcccacacacgccacgtgcgacgcgccgcccctcaacccccgctaacccacgagcaccccgacccgtgggcgcgaagaacgctatgccgagccgacaacgccgcaccgagggacatagccgaagttcgcggggcacgccccagccccgggagccaaccgtgcagaagcatcaccacctctccctcggctacccatcacgcgcctccgcctgggcaggcccgagaacaacccgagagcgcacgatcaacccacgcaggccagcgctcgggcccccgccccggcaactgagcggggacccacgagggcg

SEQ ID NO: 550147 - DNA, 103 bp, Homo sapiens
tatttaaacatcatctcccttttttttttggaaaaactccccccccctttttccccgatccccccaggcctttttgtaaataaaagctcccaagttggggcca

SEQ ID NO: 550148 - DNA, 209 bp, Homo sapiens
  misc_feature (77)..(77): n is a, c, g, or t
cccccccccaaaaaaaagggattttgggggtggtttttttcacaacccccccgggccccctaaatgggggggggttnaaaaagacccttaaacccccctttttttttcaagggaaattaggggtttttaaaggggggaaaccctcccccccgttttattccccccccaaagctttccccccgggggggttttttttgttggggggttga

SEQ ID NO: 550149 - DNA, 967 bp, Homo sapiens
gttgccgaggctggtctcaaatctggactcaagcaatcttcctgcctcagccctactgagtagctgggactacaggcacccgccaccacgcccgtctaattttttgtatttttagtagagacggggtttcaccgtgttagccacgatggttatcaatctcctgacctcgatgatccgcctgccttggactacccaaagatgctgggactacaggcgtgagccaccgcgcctggccaatatatagtatatattcagtagagacgagggtttcaacatcattggtacaggctggtctcgaactcctgaactcaagtgatccgcactgcactccagactcacaacattactgggattacaggcatgagaccacactctggccgaaatttccaatctccttaaactctctctctggtatctcatctctctctctcatctctacaaacacacagaacacacacacaacacaaagcaacaccccatgtggattacaatcgaataaacaagacttagtcataaataagatcagcagcacgatcacatagtcatctatgcgtatatcataataaacaatataggggagcgaccgcgaggatcatacctagactctcaagacacaaccagtaaagagcagctagaggaaataaaaaggagcgcaacacgcaaaagaaatgcacccaacatgaagagtagagatgcagacagaaatgacagaacgaaggaggcgtagtccaagcaaagaggacacgaaaaaaacgaaatgccaacgatcggaagacgacgagcagaaaaaccagtaggccccaggagcacaaaccaccgcccaggaaccaacacgggagggaactaaaagcgcacagaccaaagaacgaagagacgacaagggcgcccagaaaacagcagaaggcggaggagacaaaaacacgaggacgcagcatacagcaccagagagcgacaacacccccacaca

SEQ ID NO: 550150 - DNA, 463 bp, Homo sapiens
catggactctgcagtcatctattttctatgagtcctatgtccttagcataagagtatttgaatagccaatggagtggtacaatagcatattggggtggtacaaattattttccttaattttgcctgatgataaagattgttttttttacctgcttgaactagtatccttatctacctggattagtatccttatgtatctgaatcagttttaacatatcttggtataataacaaacacatttttatcttaggatgacaaaatagttttcagtctcaaaatgcaaaaatacaagtagttgtacttttatggtaaatgaaaaccttagatacagaaaaacatgcagcaaatatcacaacaaccatatatatcacattcccagcctaatcaaaaggtaattgtttcctggagaatcaggttaacagacacagaggtttcctttagtttcaacagaaaagaaaaccat

SEQ ID NO: 550151 - DNA, 154 bp, Homo sapiens
  misc_feature (46)..(46): n is a, c, g, or t
  misc_feature (142)..(142): n is a, c, g, or t
gatccagtatcttcctcggtttttagggagcaggaaaaatgcgctnaaagaacttttttaaaaacctgccctggtggataaaacggggcttgttaccgggtgcccccaaggggtggacttgaataacggtaaaggggcacgntttccgggggta

SEQ ID NO: 550152 - DNA, 257 bp, Homo sapiens
agggaagcgcggaggcggcgcgcgggggcagtggtcggcgagcagcgcggtcctcgctaggggcgcccacccgtcagtctctccggcgcgagccgccgccaccgcccgcgccggagtcaggcccctgggcccccaggctcaagcagcgaagcggcctccgggggacgccgctaggcgagaggaacgcgccggtgcccttgccttcgccgtgacccagcgtgcgggcggcgggatgagagggagccatcgggccgcgc

SEQ ID NO: 550153 - DNA, 146 bp, Homo sapiens
  misc_feature (12)..(12): n is a, c, g, or t
  misc_feature (77)..(77): n is a, c, g, or t
tcgagctcggcncccattgtggcgaacaggtaaccttccgccatgacctacggacagatcaccctgacgggcatccntgcccacgcgaaccacggcgtgcttgccagcgagcgtgaactcggtcagcctttcagcgtcgacgtgag

SEQ ID NO: 550154 - DNA, 948 bp, Homo sapiens
aggatctcacctttcggacagggaagctgccccgtgcgcgggaggatcgggcgcccgcggtccccaggacacgcgctgaccgcggctgccagtccctcatgatcatgagcaaggatgaagaactttagagcgccgtttctccgctgtcagtgccccgcatatgagaccattgaagaatccttggcctgaatttcacggagcatagttcaaccagtatccacaaccggcgtgcaatgagaacttgcagactcggtcctcttggcagagaccccccgcaggatgtgcagcatccttctccccaacagacagcggggaggagccggggcagcatctccccatggacgtgcagttccagcggcggcagaaccagcgccgcttctccatggaggacgtcagcgaagaggctctctcgtgcccatgggatatccgcctgccccagggaattcctacagaatgctacagatggagagcccagatcttgcccaagccgctcagccgctttgtcccgcctgggcctccctgtcagacattggctttcgggaaactggaaacatacgttgaaacctggcacaaaccttgggacgagggcaccttattgccaacagtctttcaaacggtgcgcagccaaatcttgacctggaggaagccttgttgtgcccttgaaatgcagaatccgggcttggaagccacctgaggcaatgggaagccgcccttgcaacttgctcaattcacgagagggtagtcctcgtgccttgaaaggcaacccttgaagggcacggccaattatttggtgcaccctttgcattgacccttcattccacaaccagcattcgggtacccttcacccgctgggtgtttcgggggttaccttggcaccaggtgacccttgagggcagggtatcctgggacccaccttgtggggaaacccttcattgaggcattccacca

SEQ ID NO: 550155 - DNA, 105 bp, Homo sapiens
tgaataaacacctacagtctaacataataataataatattccattatcctagaagtcctgaatgggaaaataatgtggatgagtgagagtctccgtcgaactggt

SEQ ID NO: 550156 - DNA, 128 bp, Homo sapiens
acggatccgttgtgctggactcgggcacccgccgcgcgccgggctagttttttgtgtttttagtagagacgaggtttcaccgtgttagccagcatggtctcgatctcctgtacctcggtgaccagccg

SEQ ID NO: 550157 - DNA, 552 bp, Homo sapiens
agctggagtgtctcgtttgcagatcggcgctttagtgtggaactgtcttcctccgcaggcgcgaggctgggatacagggtctattgtctgtggttgactcctgtactttggtctgaggccttcgggagcttttcccgaggcagttagcaggaagccgcagcggacgcccacgcccgtctcctctgtccctgggtcccgggagggaccaatcttggcgtcacgcccctcagcggtcgccactctcttctatgtagtggggtccgcatcgtattcccggaatcagacggtgcccccatagactggccagacgattccccgtggggcaacgatgaagagcagactcgttagaatttcggacctataaggtggaactttttagcttccctgagagcgtacccgtttcgaaccatatgcaaatggtggctccgttgaaatgttgagacctgtgggcatttgggcgtccgagaatggatccatacgctggggggcgttgaggtcagcaaggatcatctggacccagtaaatgcattggtacctgtgggcccaggtgcc

SEQ ID NO: 550158 - DNA, 1293 bp, Homo sapiens
gattaggtccaagcgcccgcccagaggcagggcagtcctgcgagcccagccgaccggtgtcgccggcagtagcagccttcgccagcgagactgccgcggcggaaccgggcgcaggggagcgagcccggacccgccaggcccagagccagccgcagcctcaggcctacgtccctcacccacgcacagggcaagtagccgttgctcagacgaggaagggtggaggactgaaatccaggagcctagcgactgcgcggctagccagtctatgtgacgcagttagtgagttcttcgagggcacatacctcaaatcgcatttacggtgactgccaagataggagcgacatgcgtggacctggtggagctcgatcccttggcagccggggcctcgtgtggagtagatgccagtcactatggacacacgtagcattgcgacgggccattgggtagtgaagcgtcgcccacacgtctctgccgaacggcggggggcacgacaatggatctgaggagagcaatcttagacgagggaactgtggcctgggcattggggcctcgaagtcgtcatgtcgtgagtgcatgggagggtcatcgtgcaggctgtaatgccttgtgccaggaccagaggggaggtaagatgagagtgcaaggaatgatcttgcccaagcgtcccagagaggttcctcgcgatgttcatgacggcatgacacataggcgtgcatacctggtgtccatcgtgagctcgagagaaggccgtaggatgcgcatggtcgcacgatgacgcctgggtattgactctgtgaccccattactactagccgtcctttgtgccataccgatggagaagttctcccgctagagacccagacgtagacgcccgagcggcccccggccgtagaaccggtggcggtcgttccagagaatacgaagaggacaaccttgagcacacaatgtgtgactttccagcaaatttcggccttaatggcgagaaaggaaatggcttggggacaccggaggctcagagtggagccaaaaaggcgtcattggaaagggagtaggggatatggggacaatctgggtggaagagcgtggatcagatcgagaaggttggaaacaacggcttgtggaccgtggacggcgaaagatagggggagaacaccagtgtggtgatattggtaacaatatacgtccaaatggggacggagtgggagaagaagacatcagagtaactgatatagggaaatgtggtacagagggtaagaggacacatcatagggatgtggacagagagaggggtgt

SEQ ID NO: 550159 - DNA, 854 bp, Homo sapiens
agtgcaagacgatgacttgaaaaatgtcgccagctggaacgcaacatacagaccatcatcaacaccttcgcaccaatactctgtgatagctggggcacccagacaccctgaaccaggggaattcaatagagctggtgcgaaacgatctgcaaaattttgctctaaagaatgagtagcagtacccgaatgaaaaggtcatagaacacatcatggaggacctggacataaatgcagacaagcagctgagtcttcgaggagttcatctatgctgcatggtcgaggcgtaacctgggttgctccctagcgagcaagatgctcgaggcggtgacgagggccctggtcaccaccataagccaggtctcggggagggcaccccctaagagcacaagtggccaatgatcacagtggccacggccactgcacagctcatggtggccacggacacagacactaatcaggaggccaggccatcctctgcctctagccaatgcagggcccctggggggcctgttatgtcaaagctgtcttggctgtgtgggctaggggctggggccaagtaaagtctattcgctccataataactaacgggtcaatgctctgaaatctgtgggagcaaaaccacagttttcatgccccatcggtgcgggggggtggacttcccacgaaaaaatcttggagagtacgcggcccgttatttacgccctatagttttcccatacaaaggcgctctagaaggcgggaggaagatatacaagcacgagaaggcggcgcgggttaaacaacgttcggggggaaaaccgcgagagcgacactggggggcgcaccctttttgcgggggattatggcaagctccc

SEQ ID NO: 550160 - DNA, 614 bp, Homo sapiens
agcgggcggggaggggcgtggggctggatcgcgcagcggatgcttcctttaccttcctcccatggtctccttccggttctcgagttgcttctctgagcctaagggtgtccgccactcgttcacccatcgacgacgaatgctgatgtagtccttgcttctgcttagcactgcgactccttgtgctctcaaacttccgtagtctcggacatcaacggtaaggagcaaggcccaggaagtaatagactcaccgtttaaggaagcctagcacacgggactgacaccgccaggaactccggcatggtttgcgatcgcacccgtcctggtttgagccgaacgtgcttcaatacttctgcgcttcccttgctgactcctcctcaccgaggcagttggctttatacgttgctggcacgtgtacctcctggctaggggtgtagacaggtatccgtgcacgcctggtggcttcgtgggacaaaaatgcttgcgattgttgatctaacgccttgacaaataggactatccacttcggagacgagcagatatggacccaacctaatagggttgtgctccgtggtacgctttgttgaaacatttaccaccccaaatgacccatctga

SEQ ID NO: 550161 - DNA, 211 bp, Homo sapiens
  misc_feature (13)..(16): n is a, c, g, or t
  misc_feature (55)..(55): n is a, c, g, or t
  misc_feature (59)..(59): n is a, c, g, or t
  misc_feature (67)..(67): n is a, c, g, or t
  misc_feature (81)..(81): n is a, c, g, or t
  misc_feature (103)..(103): n is a, c, g, or t
cttctcaatgggnnnncggctgagctccagccaccccgcaggcactttctttgtnacancttccttnggtgacatcggaancttacacagattttataacggntgcatacattaacttatggcctcattttgttatttttcgaaacaaagccctgtggaagaaaatggaaaacttgaagaagcattaaagtcattctgttaagctgcgaca

SEQ ID NO: 550162 - DNA, 138 bp, Homo sapiens
  misc_feature (62)..(62): n is a, c, g, or t
aataagggaaatgacagaactattttacctcacaggcgtacaaaaacaggtacaggctggtntggctctggagccctcaatgcattaataataatccagagtgaaagtctgcatagtggggtccagaggccaaaccag

SEQ ID NO: 550163 - DNA, 358 bp, Homo sapiens
  misc_feature (160)..(161): n is a, c, g, or t
gggggcttatcctggaatcaacaagaaccccaagtataagaaactcaaagatgccattgaagaaaagatcatcattgctgaagtcgtgaacaaaattaacccgtgctaatgggaagagtacatctctggattttccttctataacaaacaataatctccnnttcttgctgacccaaaagtcttggacaacatcaacgtcagcaggttcccactggctggcatgtgacccaaggtatcagatgagctcacaaaattgatggcttcttcgccgtccaccctcaaagagggctcagaagcagctagtaaaggagactttctcttcagcagtgatcacctgattgaaatggtcgccaatccg

SEQ ID NO: 550164 - DNA, 904 bp, Homo sapiens
cacagattattaattatgaccttatgtgactctatttgtctgcttgcctgggattttcgtacacctgccaaccgaggagcgctgactgacgtgtgctagtggtcctgtgggtgctgctgggcacccctgcagggcgtatgttagctgccagattctataagtccttcggaggtgagaagtggaaaacaaatgttgtattaacatcatttcttggtcctgggattgtatgtgtgcttgactttcgtactataatgaatctgatcctctggtgggagaaggatcttcagtcagctatccctttttgggacacatggttgccttattgggcctttggttcgtgcatatctgtgccttctgaaccgtggattggtgcatacattgtgggttgtagtgaagaggtgccattgagagcacccagttcgacccaatctagattccacgtcatgattccatgaacagtcgttctacagcgataggccccttgcctggtagttatcatgggagggattttgcccttaggctgcatctgtgatacaacttttcttcattctgaatatgtatttggtcacaccaggatgtattacaatgttggcttcctgtttctggtgtttcatcatcttggtttattacctgttcttgaaggcaagtatacttctttgctgattccacctatgtgccgaggatttcatgtggcaatggtgtccatccttaacgagtggcttactgggtttattcctttatcgatgcagtacctagtctttcaaactgggattacggtaacggagcccaatctgtgcttgtctccacgatatgggttgggctccttcttcacggacaggccccggaggtccggggcccacattctggcgtgacgggttaaacacccggcctaaaagaatactcc

SEQ ID NO: 550165 - DNA, 914 bp, Homo sapiens
cggcctgtctcaagaaataaaaatcaatcagcctggcgcggtggctcacgcctattatcccagcactttgggaggccgagggtggggaggatcacgacggtcattgagatctaagaccatcctggctaacatgtgtgaatagccctgtctcgtactataaatactacacagaagagttatcctgggcatgggtggtgggtcgtctgtatgttcccagtctactcgggaggcttgaggcaggagaactggcgctgaaactcggcgaggcggcagcgttgctggtgcagtccggaaggatcgctagcctacatgctatctccagcacttggtgtgacagactcgagtactccgtctccaaaagaagaagttagggaagtaagtgaggagcacacaaaacacaaatatacgggcgctgcgatgcgatgctaaggaagtgtagtgtgccgctccgcgaggtgccacgcactgctctatgagagttgtagcgccttctatttattctgtgtgtacccaaggtgtgtgggcactcgctacataaagatgggagctacgatatgtttgatcaccgttgtgaggacccttgggggcgcagccgtgtatattcttccgacaacgtgtttcatgtgagattgtgggaaataccatttgcgtatagagctctaggcgaagctcatgtcgcgtgatgaagcgagaacgcctttataaatttttgttgaggagcgcgtggttggccatgtaatttgggtgggacgcggcagttacggctttggcaagaagtaatttataaccagggtcatcgctcataggtttccaaattattttcaaaagttgtgtttaacggaaggatgaatcgcgggtttcttagaattgtaaacgtgggggcattttcggtatggatgtctttggaaagagtt

SEQ ID NO: 550166 - DNA, 693 bp, Homo sapiens
  misc_feature (82)..(82): n is a, c, g, or t
ccctttctctttaaaccaaaggggtccgcgtataggcccccccccaccccattctgcaatgcccctttctcttgaaagttcntcgcacctcacagtctctgcccattttgggcgttctgccagtctcttaccagacccatttgtgtcctcattggctccttcacacaaagggtcccctcttgcttgttgtgattggcaaacaaagtggcttgcccaaacccctgcactgtcaattgtagggtataatagctcagtctctagagcaagatgggtctgcgttggaatctctggagccaccatttcgtgtttgttctgaaacttcgtagagccttagttcccgcatctgtaaaatggagcaaagagtctcagctgaagggttgtgtaagaattcagcgacacgatgcgcacagagtccttacacgcgatcagtggcggcccagttcgatggctctcacctgtaatcccagcactttggcagtccaagacgggcagatcactaggtcacaagatcaagtggctacacacggtcaacccccgtctctcctaaaaatacacaaaaaattaaccgggtgtggtgtcgggcgcctgtagtcccagctgctcagtagactgaggccgaagaatggcgtcaaactggaagtcgtagcttgcagtgaaccaaaagtgcacctctgcactccagcctgggcatca

SEQ ID NO: 550167 - DNA, 234 bp, Homo sapiens
tgtcgtcggaagcctggagtatgtggcgctgggcgtcattagcacccagcctttgccagatcgtttttatggagtgttgattccctccaacaatcaaatctgaaaaaaggagcacgacgactgctctttacactccacgcttcagaaacaccaggcagtggatcacccttcttgatgattcttcctaactgcggtgagtaaatgtaatcgaccgcttcaccgttcatccgcgtt

SEQ ID NO: 550168 - DNA, 160 bp, Homo sapiens
ggtggtgttctagaggatcccagatgattgtccaccgctcctcctgtgcatcagcggcaacttcctgcggacctgatgcgggtgggcgagcagtgtggacatcagccgctttttatatccatgtacattcacctggggaaaaaaacggagcggtggagca

SEQ ID NO: 550169 - DNA, 223 bp, Homo sapiens
ggtcccaaatctagtaggcgtccttgccctattactatgcatccatcatcctagtcaagaagtccccattgctgtatatatggtcatagcgtgtgcattgtgtgtacagcccgatttcgccaaatcactttattgactcctagccgcagacctcctcattctaacctgaatcggaggacaaccagtaagctacccttttaccatcattggacacgaatgttca

SEQ ID NO: 550170 - DNA, 321 bp, Homo sapiens
actcagctccgggatacaggtagacctctcaggcttccaaggaatgccaagtgctatacgccagtctggcctcgtccaactcgttcgcgatctggcataccaaatggtaatgctccggctctcgtggcctccctactaccactcagagagtcgagtctgagtgcccggaccgcttggctattgacctttggtggcgctgagttgccgacccagtcaagggctggactgacaggtgccagtctggaggcgttcccacagctgtgcaaaaacttagcgcaactccctggtatcggtgttggtgatccccgagatacagggttc

SEQ ID NO: 550171 - DNA, 366 bp, Homo sapiens
cttttcgcagaacagatccctttacttctatgtcaggaacctgtttcgtttgaggtgctttgtaggaagtacaagtctagttttactcagagactagcgattgccagccctgcctttttaagctttccatttgcttggtagatcttcctccatccctttattatgaccctatgtgtgtctctgcacgtgagatgggtttcctgaagacagcacactgatggatcttgactctttatccactttgccagtctgtgtcttttaattggagcataaagcccataaacatataaggttaatatagttatgtgtgactaagatcctgtaattatgatgtacgctggagataaagctcgtaagtagatgcag

SEQ ID NO: 550172 - DNA, 782 bp, Homo sapiens
  misc_feature (121)..(121): n is a, c, g, or t
  misc_feature (143)..(143): n is a, c, g, or t
  misc_feature (166)..(166): n is a, c, g, or t
  misc_feature (188)..(188): n is a, c, g, or t
  misc_feature (195)..(195): n is a, c, g, or t
  misc_feature (275)..(275): n is a, c, g, or t
  misc_feature (289)..(289): n is a, c, g, or t
  misc_feature (296)..(296): n is a, c, g, or t
  misc_feature (298)..(298): n is a, c, g, or t
  misc_feature (309)..(309): n is a, c, g, or t
  misc_feature (324)..(324): n is a, c, g, or t
  misc_feature (359)..(359): n is a, c, g, or t
  misc_feature (410)..(410): n is a, c, g, or t
  misc_feature (442)..(442): n is a, c, g, or t
  misc_feature (455)..(455): n is a, c, g, or t
  misc_feature (460)..(460): n is a, c, g, or t
  misc_feature (483)..(483): n is a, c, g, or t
  misc_feature (485)..(485): n is a, c, g, or t
  misc_feature (510)..(510): n is a, c, g, or t
  misc_feature (619)..(619): n is a, c, g, or t
  misc_feature (621)..(621): n is a, c, g, or t
gtgagacagctggtcatgaccatgggtgtggtctgactctcagcttttgcttctacccagcaacttctgcccatacacacgttagatgtcaagagtacaatgttacctgctgccgttcgtngctctgagtcccgtctttcagnagaaggaatatcttactgctaanggtctacacatgtcctgtggtngggagtnagcagccaccagaatgatccaggaatatttaatgtgccatcttgtgcacatatcaacaagatatgacattgctgcctgangtgggaaaccatantctcaanantcagaatgatnctgggtatatccaanaaaagaggccatatcaatgaagctcacaattgtanagcaggagaacaaccagaaatggttttccgacagttcctggtagacgacanaggacttacggaggctcttcttatgtggattncctttgttgtgtncacanggagatctgtcagctgcttaatnanttgaaacttctctgtcatggatgtngcattccaaggagataatctccttctttggtgcctaatttctagatgataataggctagttgggattctttgctcatttcagaatcacttccaggaacgagatggcatntngaacttcacttggtgccaggtatcacaggccactacggtccatttgccccattcaggggcccatctggtctcggtggccacgtctccatcttacacccggtggggctggcgtccaaaaggcagggtccgaacctaacctttccatttttgggagcctaatt

SEQ ID NO: 550173 - DNA, 189 bp, Homo sapiens
agaggatcccccgcgtgtttcggggccagcggggaccaggggcacgtcgagcgttgtggagtaagctatctctccacttgtgccatagcccacttacatccagagtgtcaacattctcttcacagccacgtctaagcggctgcgagagtgatggagtgagcgatgggatgtgctcgatacgagagggta

SEQ ID NO: 550174 - DNA, 167 bp, Homo sapiens
gactctagatggatccccagaccacacttgcggataggctccaaagctgggagggagtcctccaactaccttggcactcttccccactgcttgcagaagccgtgatcactgcaggaaactggagctgcatagtgcaagctcccatgtgcaatgcaaacagggacaat

SEQ ID NO: 550175 - DNA, 260 bp, Homo sapiens
ccgtcttggaacccgggtacatcgactcagaaataggaacttcagaccagattgttccagagtaccaggaggacagtgacattagttccttcttctgctaatccccaaaacctcagaaacctcataattcttaacaacctgcattttcaattctaaaggtgggcaaggccttttgcgttgtacccaccagataatgacttcatcaagatggaagctctctggactctgccatatgtgtctctctcttctctgtttgggtg

SEQ ID NO: 550176 - DNA, 164 bp, Homo sapiens
ctaccccatgcactttgtcacagctccattgaagaagcttcaggagtgtatcctattgatgacgatgactatgcttctgcgtctggctcgggagctgatgaggatgtatgagagtccatagctgacaacatctttgaacacttccaaagatactgtgacaaagg

SEQ ID NO: 550177 - DNA, 283 bp, Homo sapiens
ggtatactccatctgaaaaattacaataaaaagataattaggtaactggtaggaaaaataattacattaattcatatatgcaacatcaattggtttggtataaattataatacaagaccttatttgtaacagcaacaaagtagaacatgcccagcaatttacaacatgttcaaaaccaagatggatataatctttaaacattccttaaagacactacaataccgggcatggtggttcatacctgtaatccctgcactttgggacacttgaggcgggtggatca

SEQ ID NO: 550178 - DNA, 378 bp, Homo sapiens
  misc_feature (5)..(5): n is a, c, g, or t
  misc_feature (69)..(69): n is a, c, g, or t
  misc_feature (89)..(89): n is a, c, g, or t
  misc_feature (340)..(340): n is a, c, g, or t
  misc_feature (344)..(344): n is a, c, g, or t
gcctnaggccaggagaaatccgccttgaacccccgggaggtggaagattgccagtgaaacctgaagaancctgctgcctgcactcccancccgggtgatagagccgagactctgtcctcaaaaaaaaaacaccttagcactttggcaggctgagatgggcggatcatgaggtcaagagatcgagactatccctggccaacatggtgaagccccatctctagcaaaaatccaaaaaattagctgggcatggtgctgtgcgcctgtagtcccagctactcgggaggctggggcaggagaattgcttgagcccgggaggcggaggttgcgctgagccaagatncttngccgcaatgcagtggtgacagagcgagactccat

SEQ ID NO: 550179 - DNA, 375 bp, Homo sapiens
agtcgctctagaggacccggtgagcatcagagagaaaccttgtgttagagaacacagaacaaggctgggcacggtggctcatgcctgcaatcacagcaccctgtggaggccaacgcaggaggatggcttgaggtcaggagttcaagaccaagctgggcaacatggcaaaaccccatccctaccaaaaatacaaaaatcagccaggcattgtgatatgcgcctgcagtcccagccactagggaggctcaggcaggaggatggcctgaacccaggagatggaggctgcagcgagccaagattgcatcactgaactccagcctgggtaagaaagcgagaccatgacaaaaagaaaaaaaagaaaaagaactaaaacag

SEQ ID NO: 550180 - DNA, 887 bp, Homo sapiens
  misc_feature (419)..(419): n is a, c, g, or t
  misc_feature (439)..(439): n is a, c, g, or t
  misc_feature (445)..(446): n is a, c, g, or t
  misc_feature (481)..(481): n is a, c, g, or t
  misc_feature (483)..(484): n is a, c, g, or t
  misc_feature (491)..(492): n is a, c, g, or t
  misc_feature (513)..(513): n is a, c, g, or t
  misc_feature (516)..(516): n is a, c, g, or t
  misc_feature (523)..(523): n is a, c, g, or t
  misc_feature (528)..(528): n is a, c, g, or t
  misc_feature (573)..(573): n is a, c, g, or t
  misc_feature (575)..(575): n is a, c, g, or t
  misc_feature (577)..(577): n is a, c, g, or t
  misc_feature (579)..(579): n is a, c, g, or t
  misc_feature (583)..(583): n is a, c, g, or t
  misc_feature (585)..(585): n is a, c, g, or t
  misc_feature (591)..(591): n is a, c, g, or t
  misc_feature (595)..(595): n is a, c, g, or t
  misc_feature (598)..(599): n is a, c, g, or t
  misc_feature (602)..(602): n is a, c, g, or t
  misc_feature (605)..(607): n is a, c, g, or t
  misc_feature (613)..(614): n is a, c, g, or t
  misc_feature (625)..(625): n is a, c, g, or t
  misc_feature (628)..(628): n is a, c, g, or t
  misc_feature (637)..(637): n is a, c, g, or t
  misc_feature (639)..(639): n is a, c, g, or t
  misc_feature (641)..(641): n is a, c, g, or t
  misc_feature (645)..(646): n is a, c, g, or t
  misc_feature (654)..(655): n is a, c, g, or t
  misc_feature (659)..(659): n is a, c, g, or t
  misc_feature (662)..(662): n is a, c, g, or t
  misc_feature (667)..(667): n is a, c, g, or t
  misc_feature (670)..(671): n is a, c, g, or t
  misc_feature (678)..(678): n is a, c, g, or t
  misc_feature (684)..(687): n is a, c, g, or t
  misc_feature (691)..(691): n is a, c, g, or t
  misc_feature (697)..(697): n is a, c, g, or t
  misc_feature (699)..(699): n is a, c, g, or t
  misc_feature (719)..(719): n is a, c, g, or t
  misc_feature (726)..(726): n is a, c, g, or t
  misc_feature (729)..(729): n is a, c, g, or t
  misc_feature (731)..(731): n is a, c, g, or t
  misc_feature (738)..(738): n is a, c, g, or t
  misc_feature (741)..(741): n is a, c, g, or t
  misc_feature (748)..(748): n is a, c, g, or t
  misc_feature (773)..(773): n is a, c, g, or t
  misc_feature (794)..(794): n is a, c, g, or t
  misc_feature (814)..(814): n is a, c, g, or t
  misc_feature (857)..(857): n is a, c, g, or t
gtgtgctgaggtgatctagaggattccaaatcctactcgcagcctgcagaggagtgagctgcagcccggcctcgaagaacttctgcttgggtggctgaactctgatcttgacctagagtcatggccatggcaaccaaaggaggtactgtcaaagctgcttcaggattcaatgccatggaagatgcccagaccctgaggaaggccatgaaagggctcggcaccgatgaagacgccattattagcgtccttgcctaccgcaacaccgcccagcgccaggagatcaggacagcctacaagagcaccatcggcagggacttgatagacgacctgaagtcagaactgagtggcaacttcgagcaggtgattgtggggatgatgacgcccacggtgctgtatgacgtgcaagagctgcgaagggncatgaagggagccggcactnatgagnnctgcctaattgagatcctggcctcccggacccctnannagatccnncgcataatccaaacctaccancancaatatngacgnagccttgaagattacattctctcttacacatctttcattttccancnantncttntntctctntcanctnntgngannnatgaannaaattatcttnacnatgctctcntnanacannattcccannaccnttnttagnctnnagagaanaaattnnnnacanattatntnaaatttctaacttttctctnttccctnaancnaaatcanctnttgcatntgtttgatgaatacaaaatgatatnacagaatgatattgaacagantattaaatctgaaacatctngtagctttgaagatgctctgcttgctatagtaaagtgcatgangaacaaatctgcatattttgctgaaaagct

SEQ ID NO: 550181 - DNA, 102 bp, Homo sapiens
accttctgattatgttttaaacatgtaatgcccgcttttaaacctaggatcaagaaattgaagtttcacgaggtgaggtttttattgcttaatttagtctca

SEQ ID NO: 550182 - DNA, 155 bp, Homo sapiens
cctgctcagactatctgtggtagctagggattacaggtgcccaccagcatggcctggctaattttggtattatttaatagacgacggggcttcgccagcgttgcccagtgctgatctcgagactcaaagggaatggctcacctgcaagttgaact

SEQ ID NO: 550183 - DNA, 405 bp, Homo sapiens
aacacctggaaagtggggccggccacagccatagccccagatagtgaccccagttagcaccccccgtccagagggctcctgcaaggccaggggtcccccaggttcaccctgttggggaaaaaaaaaagggggttcaaaggcgggtacctcccctacaaaagcccttgggtcattggcccctttagaagtgacccaagtgacttcccctgggagccgcattttccctatttggaaaatgggctcaatgcaaaggtggcaaacatttatggaccccccccacgtggtcccggagtggaagggtgcctcccactgaagcctttgctttttttccccccaaggcccgggaatggaatggggtgggttgcccaataaacggttgtggagtggaatttcctccaggcccca

SEQ ID NO: 550184 - DNA, 252 bp, Homo sapiens
agggataagaaggggactggggattagtgatattctgtttattgatgcagatgcaagtcatgcaggtgtgttcagtgggtgaaaaatcattgagctacacccttacatgttgattaaatattcagggctgggcacagtggctcatgcctgtaatccctgtaaatgcttacagaggccaaggtaggaggatcacttgaagccaggagttcaacagcagcctgggcaacatggtaaaatccagtctctaccaaa

SEQ ID NO: 550185 - DNA, 188 bp, Homo sapiens
acaaatgatcttaacatattgtacgggaactgctgttttaataacgccatcagatcgttcattttgtacatttaagagttttttatcaataaagatttcataggaggacatcatcatacttgtctgttcttccattgatgttctcagagtcccgggtcagtctctgagtgtctcatgggtcgggatgc

SEQ ID NO: 550186 - DNA, 171 bp, Homo sapiens
gttgtggtatatcaaggcataatcaagctccttctgggagcttgattcaatgcctactcaagctccttccgggaagaatgggtaggcttggatatattcctgggttgaacccgacataagactggtagtgtcaaactatggttccatctgccacgactgacactatacttg

SEQ ID NO: 550187 - DNA, 258 bp, Homo sapiens
  misc_feature (51)..(51): n is a, c, g, or t
acgtaaatactagcgagaaggagcagaggcgggagagtaatacgtaggggngagctacgtagcactaggctgtacaggtaagcaaactaccccgtagggcgccaaagtcaaaagaaatactactagcaccagggtatcctagataggactacctaccatagtacctatcagacgacgcgctacgcgtctacctacgacactaagtaagccgggccctacctagggcacgcatacgatagacaggcctagcgtactagc

SEQ ID NO: 550188 - DNA, 101 bp, Homo sapiens
agaaagcgttcaagctcaacacccactacctaaaaaatcccaaaccatataactgactcttaaaccatttggcccatcttatacctttaggaggactaatg

SEQ ID NO: 550189 - DNA, 122 bp, Homo sapiens
taccgccattatgctaaacaaaagactttctttttaaaggaggaggaggaagaggacatgatattgcacagaggacccaacactgaatggtgggagctagaggttgctggaggccacggagg

SEQ ID NO: 550190 - DNA, 364 bp, Homo sapiens
  misc_feature (318)..(318): n is a, c, g, or t
cctgtggtcccagctactcgggaggctgaggcggcaggatagcttgagcccaggaggccgaggctgtagtgagcttcctgcatgccttactggtagaaatcctagggcagcgtgccattttcgaccttctgccattgcccatggcagatcacgtcgctgcactccagcctgcatgatggagtgacgaccctgtcttcaacaaataaattaataagtaagtaagtaatgtgaatgagtaaataaataaactaaactgattggagctgcgctgccatatgctgagagacgacctgaagccaggagagagaccttgaacanatgcttcctccgcaccttgagagggaggatagccccgttgacacac

SEQ ID NO: 550191 - DNA, 126 bp, Homo sapiens
atcatcgcttagtgctcccccgaggtcaggattaaccaacaactctcactaaatcctcaccagtcacccctccacatcgtctaaaaaatgaaatcttttgattagattttcacctctctgcgtctg

SEQ ID NO: 550192 - DNA, 1055 bp, Homo sapiens
aaggctaagtagatgacgcggtgttaatatggacgaggataccctgacaatgaaccctgacaacccggaggcctgcggacaagtttaagtgagatcaacaacgcgcacgccatcctcacggactgccacaaaaaggaacatctacgacaatgtactggctactgctgtgtgtctctacgtaggccgagcagttctgggtgaatgatgaactgtgaacacctacttctgtgctagtccagtctagggtagtggccaaggcctctagtatttgtacttcttgctgtgtctacctacactgtgtctgtcttactagcgtatttagctaattcttaatatcttactaaactgattaatctaatctaactgaacttaatataattattatatctctctattaagtcttctcgatatatgattctattgatagaattgctaagatagttcaattgcctaattatctctctcctatgattatattcaatatttgttttctttctttcgttgctttttccagatttcgatgatataattatcgaattcttcaatattcttcaattattccttctagattaataaaatgatataagatttcttttctgatatttttctatttttatattgtttaattatattacttattatatatacccctttgatgtatttgttactctttcttagtaactactgctctttatattcataatccttttatactttattctcttatacttatcaccagactcctttcatctgttatttttattctttacgcctctttaattcttttcttacttttatcctgttatatcttgctctcttatccttctccttaattttttatatcttctcggtagttgtattttcgtattaatatagtcgggtctctaacacttatcatcttttcacgatgtacatttctttataagaagattcggtatcatgaagaggcactagcccgatatgtccccggaaagtctgattgctcgtgtgtccgtatatggtagtggggtttacgtggtggaattaattgcactggtattcgtatattgtgttgt

SEQ ID NO: 550193 - DNA, 104 bp, Homo sapiens
gactctagcaggatcttaggtatatttaggaataaataaaaagaggcgggcacgggtggctcacacctgtaatcccagcactttgggaggcgaggtgggcggat

SEQ ID NO: 550194 - DNA, 178 bp, Homo sapiens
cgctagcggctagtgaacgatccagacactggatctgacaacactttgatcttggactttccaatccccagtcttataagaaataaatatttgttgtttaaaccatgtggcctatgatattttttttccttttttcttttgtctttttaaggctgcgttcacttaatgccgctagcgc

SEQ ID NO: 550195 - DNA, 277 bp, Homo sapiens
aagtctgagggaggctgtgtataagaaccggacaaactccttaacgctggtcttcagaacaggacttggtacagaaaataaaaagaggcttgtttactacattactaaattatttcagtaggagacttgtaagtaaccatactatgtagaaaatggtttatggctttgagccatgaatattaatttgcatttagcaggtgaaatattagcatttccacttaatttcactggttacaaacataatagacactgtttacacataagtttcacattcagg

SEQ ID NO: 550196 - DNA, 194 bp, Homo sapiens
ggcggtgagctccagccaccccgcagtcactttctgggtaacaacttccgttgctgccaacgaaaactgactgcttgtttataacgtgtacatacatgaagttattacctcattttgttatttttcgaaacaaagccctgtggaagaaaatggaaaacttgaagaagcattaaaggcattctgttaagctgcga

SEQ ID NO: 550197 - DNA, 864 bp, Homo sapiens
ctgaggtgtcgggcggactccctccttctcccggcgcctcaagcggaagagacattcctcaagaattttgtatccaaggcccaaaagttggtgacccaagatgatgaatgctgacatggatgcagttgatgctgaaaatcaagtgtgcactggaggaagaaaacaagacttattaagtcacagtgttggtaactccaatacacactgtgagagatctctctgcaagagtagatgcagttaaggaagaccatctgaagctaaaatccagaaaaccaagttcttggacaatatatagaaagatctcatgtcagttcgtagtgtgcccaaagcaactgacacacaaaaacgcaaaagaaagtaagggattgacacccttctgttttatggaatgctgctgatcatttcattcttttacaaacttggataggattccaaaaggttacagtacctttgtggcttcatgaatattctgaagataatgtcagatgtgacaaaaataccacagtagcaggagacttccataagtgcggtattatgtagtctatgaaaactgtgcaagatgtatggtacgagactttatgatttagaatgggcctatattattaaacctaagagatgaatgtaatcgacttgaggtgagcacccgccttgaattatagggtagaagattacaagaaataaccaccggtggaaaagtgaccaaccgtgtataatggcaggttattacctggcacactggcccttcaatggcttactccattcctcgctaggaacatgggtccttgtaggaacacaattccaaaacgcttgtgaaaaccaaaagccacgcacaaacggcaacaactcacaccgcgccatgtccca

SEQ ID NO: 550198 - DNA, 521 bp, Homo sapiens
  misc_feature (309)..(309): n is a, c, g, or t
gcagcagctgctcggcgccctgcgcgagctcccccggcccaaggggctgcagcgacgtggtgcttatcgacaacgcgggctctctgggggatgtgtccaaaggcttcgtgggacctgagttgactccactcaagtgaacaactacgtgggcacgtgaactgtgacctccatgctcgtgctgtgacttccagcggtcctgaagggccttcccgggacagtccgtggcctcaacagaaccggtggttaacattctcgtccctctgtgccctggaaacttttcaaagggcgtgggcgctggtactgtgtgcnaggaaaggcgtgctcgtgatatgctggtccaggtcctggcgctggaggaacctaatgtgagggtgctgaattatgcccaggtcctctggacacagacatgcagcagtgggcccgggagacctccgggggacccagacatgcgaacaggggctggcaggagctggaaggcaacggggaagctgcgggatggcaggggtgtcagcccaagaaag

SEQ ID NO: 550199 - DNA, 188 bp, Homo sapiens
cccaaacccactccaccttactaccagacaaccttagccaaaccatttacccaaatatagtataggcgatagagattgagacctcggcgcaattagatatagtaccgcaggcagaagatgagaaattatacccaagcataatatagcaaggactaacccctatacctcctgcataatgaattacctag

SEQ ID NO: 550200 - DNA, 721 bp, Homo sapiens
aaaaattggcacttttttatttttaaaaaacaagggctcactttgttggccaggctggtttcaaaccccttggctcaagggattttccagcctaagcctaagcctcccaaaggggtgggactacaggcatgagccactgggcccaggggctttttttttcaaaaatctaaaaacccccattggcctatttgctttaaaaccctaaccctagacccttttgtggaagggtggttttttctccccatttggagctggtttttatgaaaacatttttggggagagccgcttaagggaaaaaactgggaagggtcccctgggaaagggaattttttacctttatacatgaaggaaatgggggctcaaaaaggataaacaattttggtccaaccccaagacaaatcccgcccccaaaggtggttttccagggcgggttttattagggggaaggcccaatttgtcctcctgggaccccatttctggggggggacagggggtggtttattcacacccctctgggccagagggctccccgttgacctttccctttttttttttgagaaaggggtttctgtctgcaccaaggttgggaggcggggggggaactttggtacatggaagtcccctttccgggtaaagcctttcctggctaaccccccgaaaggggggacaccggtttgtgggggggggtttttcttttttgaaaaaaacttctttcccccgg

SEQ ID NO: 550201 - DNA, 163 bp, Homo sapiens
ggacgattagcatatattagctagacgttactttctgtgatagtggttcactgaataagtggcgtcgtcttgccatgattgtcaggggagaacgggagatgggtagcatcatttggattaacatttggggcctgataggggcaaactggtgaaacaatggaaa

SEQ ID NO: 550202 - DNA, 401 bp, Homo sapiens
tggaaagggagttttgggctctgttgcccaaatgggaaagcaggggtgcaatctcagggcattgaaacctccgcctctgggatccaagcaatttcccggcctcagcctcccaagtagctggaataacagatgcctgtccaccacacccagctaattttggtattttaagtaaaggcgaggttccaccagtgttgcgctccaaagtgactctcaaactctggacctcgaggtgacccgtctgcctcgtgcctccgtgaagtactaggaatccaggcgtgagccaccacgcggggccttctcttctctctctctcacttggattttccaaggctaagtgggccatcccttgaatagggttacagccaagttccacttaagacttctaagtagctcaaaataga

SEQ ID NO: 550203 - DNA, 202 bp, Homo sapiens
gtggtgatctgaggccgttttatgcggggcacgtgtcgaggagtcccttgtgtcggcacccccatgtttgtggtcaaggcctatctgcccgtcaacgagttctttggcttcacgctgactgaggtccaacacgggcggcagggtcccccagtgtgtgtttgaccactggcagatcctgccccggagacacccttaaactcgc

SEQ ID NO: 550204 - DNA, 201 bp, Homo sapiens
tgttgaaagcagtctggccacggttccagcacgacacatcaactcgccctggtagtcggaatcgatcaggccgaccaggttgcctagcacgatgccatgtttatggcaccaagccggagcgcggcaggatcagcgccgccaggccaggatcgccgacatagatcgacaagcccgtggggatcaggatggtctggcccgcca

SEQ ID NO: 550205 - DNA, 309 bp, Homo sapiens
  misc_feature (131)..(131): n is a, c, g, or t
  misc_feature (168)..(169): n is a, c, g, or t
  misc_feature (225)..(225): n is a, c, g, or t
  misc_feature (258)..(258): n is a, c, g, or t
  misc_feature (294)..(294): n is a, c, g, or t
cattgaaagtataaaccgttgccgcagtacaaacccattacagaataatgcatccaaaagcgctatggactacccgtgacaattctgcttaccttccatcttgatgatttcctatcagtatccaaaattcnatactccagcattttttccgaatatagtcttacatgnntgcaattcctgaggtaacctaagtgtccactgccaacatccttggacgaaaaccangtcccccgggagaattcagatatttatattcanacatacaatacaacgggaatttcatcaatggtaatncagatatttgcagat

SEQ ID NO: 550206 - DNA, 760 bp, Homo sapiens
gcttgactaccatgctgatgatcgcaagctgtacaatggactgtaggccaagggccgccagtttgggtcaaagtgcaactccggggtaccggattgcctgtgtgcattgagcctgtgtctttgatgtgcagtaccgcccagatcttcttcagcaaaaatgggaagcgggtggtgctcttaccatcatgcccatgtccccagatgtgacttgttcccagcagttgggcattgcactccctgtggtgaacgtgaggtgcggctgcacctctaacgtctgtagctgggacggtgtacgtggactgacaagcgtcctgattgtgggttggacagttacgagtgatgaatgtggtgcctggcttacatgattgtccatgacggtctgtgtgcacctcttgatcgtgacgtacttaggcgaaattggcctatacgtactcgttggattgttgggctgtccctaatgacccggcagtccacttcagtacacctgaaggctcattacttccgttcggtcgtgatgatcgtgtgagccacttgtacgacgaaatgtgctacagtcagacactcaagagtgaggcgacgtgtgatgaacgatgttcccaggaacagggagctccctgtggattggatccctagtgaggctcgtggtgtaattcattgcatacccatgtggtcaatacctccattggtatttcgttcgcatggagtcctttaggtctgaagcttgtgcctgtgacacattgttctctctctgtaatgatcc

SEQ ID NO: 550207 - DNA, 415 bp, Homo sapiens
acgatctgggagtcatagtctcacgggggagataaaaaataaagtgtgattacttcacagatagattacatctctgtgataatatatacatacaggccccctcaaataggaggattcgtgtacccaagcagtgtactgaatatttcataatatatgttggtcattatatacttgatgatgccaattctccagtcagagatggtttacactgtacagacatttcgaaagaagatgtagccttctacttaaggtaggcagtgtgcacagggattatatcaatgattagtagctgtgccaccgacatgaatgtctaatagccaatgtatccagattcctaatgtgtattcctaacatggcaagctgcccacaaatacatacacaaacacctatatctctactgtcccgcaagactctc

SEQ ID NO: 550208 - DNA, 109 bp, Homo sapiens
gcgtggtcgcggccgaggtacagcatagtgactataattaatttatgtatactggaaaattgctaggaaggtagattttaaatgttctcatcacaaaaaaagacaaatg

SEQ ID NO: 550209 - DNA, 426 bp, Homo sapiens
tctctctctctctctctctctctgtctatgtctgactaccactggatcacgctacactgccaagtctgaaaatcgagtccacaagatttgattggcagaatgtgctatcattggacaactgaaaatatctactaatttccatttatccatttgacatgagttgtatagaaatgtatgcatcagtatgtgagatagcaacaactcgtgagacccatagacttacagacatacctaaacataaaatttaaatattagaaactatcttacaagcagacttacacaaagagtaactgacaagaaagcgagatcgtgataggatgacggaatgtcaagaccaattgtcccgaaatgactgacacgggaacgacaatcagacaggactaaggacttagaagatccgaaactatgaagctactgagcatagag

SEQ ID NO: 550210 - DNA, 257 bp, Homo sapiens
ctctacgaggatccccctaggtggcaaagcgattgtctctctaggtggacaagcgacgtctagtgtgggagcgtctatgatccttggtattatcggacagcccgtaccagtctgttcaaaagcctcgtccaggtagatacgctatttggcctgaggtctcaaaagtaagccaacgtgatggaaggcgcggaacggctgcggcttctgatcgggggatctctaggtgaaaagcgaagtaagcgcggattgctatacgt

SEQ ID NO: 550211 - DNA, 103 bp, Homo sapiens
tgggtctcaaaattcctgacaaatttttgccaagtcgtttccattaaaaagtactgattttaaaaactaataactaaaacgccacacgcaaaaaagaaaacca

SEQ ID NO: 550212 - DNA, 223 bp, Homo sapiens
caccaccacaccaccacaagggtactctagaatgtgggcagaggattcacatttctccaccctgccctcctgccatgcaactgcagtatctcctctgggagagtatacatggccttccttaggtggtatcagagctataccaccacaactcctttcaaaaaacgccacgcgcagaagatccattcaatggtgaaataataacccattcctttctcatcttaat

SEQ ID NO: 550213 - DNA, 115 bp, Homo sapiens
ctctagagtatcccccgagcgggtgggggtgtacactgtaggaaggagagcgatatttaatcagtaaccacttcctagggtattttaacatgccatcagttcgccaaccagctcg

SEQ ID NO: 550214 - DNA, 460 bp, Homo sapiens
  misc_feature (252)..(252): n is a, c, g, or t
acagcaaggggaaaggattccctatttataatgatgctgggatagctggctaaccatatgcagaagatagaaacttgacccctccctttcaccatatacaaaaatcaactcaagatggattaaagacttaaatgtaatacctaaaactataaaaccctagaagaaaacctaggaaataccactccagacataggccctggcaaagatttcatgatgaagactccaaaagcaacggcaacaaaaacaaaaatngacaagtgagacctaattaaactaaagagctctgcacagcaaaaaaaaaaaaaacctatcaggggagtaggtagacaacctacagccgggcagggggaggcccgggctggtaatcccagcactggggaaaccccaggcgggaagatcattggagcccaagagttcaagatgagcgggggcaacatagagagaccgggtctccacaaaa

SEQ ID NO: 550215 - DNA, 147 bp, Homo sapiens
ctctaccgttaacattactgcaggcactactcatgcaccgtaatggaagcgcaccctagcaatatcaaccattaagccttccctctacacttatcatcttcacaattcgtaattctactgactatccttgaaatggtcgccaatccg

SEQ ID NO: 550216 - DNA, 200 bp, Homo sapiens
  misc_feature (10)..(10): n is a, c, g, or t
  misc_feature (32)..(32): n is a, c, g, or t
  misc_feature (78)..(78): n is a, c, g, or t
  misc_feature (107)..(108): n is a, c, g, or t
  misc_feature (141)..(141): n is a, c, g, or t
  misc_feature (148)..(148): n is a, c, g, or t
  misc_feature (158)..(158): n is a, c, g, or t
  misc_feature (160)..(160): n is a, c, g, or t
  misc_feature (164)..(164): n is a, c, g, or t
  misc_feature (167)..(167): n is a, c, g, or t
  misc_feature (175)..(175): n is a, c, g, or t
gaatttagtngcgcctctgccatggcctgggngcataggaggctacaacgcccatccagcaaacattcgtcaccgccntctacattccctgtggacaggatgcagcnncagaatgttggtacgttcaaacctgtattaccntaatggnacgcaacgtngncccncanatcgacangacctcatactatcacgctcgcacc

SEQ ID NO: 550217 - DNA, 120 bp, Homo sapiens
caggattttgaggctgcaactaagtatgatcgtgccagtgcactacagcatgggcaaaagagcgaaactccatctcacataaagtaacaaataaagttatcacagacaaatgcatctgag

SEQ ID NO: 550218 - DNA, 140 bp, Homo sapiens
tagctatctttaagtaagaagaatctacagtcatccgtgagttcactgtttcacacgacagcgcccacgaaacaatcaatcaccaaatcttattttgagcttccctgagacttagtgaaacatctggtccatttatagcc

SEQ ID NO: 550219 - DNA, 410 bp, Homo sapiens
ctacccatctattttatcatttactaccataaaatacacacaaatctattataaaaagttaaaaattttcaaaacttacacaaacacttacagacatggtcccattcccagtcgagagaaatgtaaacaaatgtaaagatgcagtattaaaccactcatgcataaaattaactgtagttcatactgtatcactgtaatactttcatagccacctcttgttactattgcagtgagttctggtgaataaccacttcaaatgccatgtgatgctaccatctctgtgtgagcagttcatctctccaataaattgcatattgcagtaagtgatctttcatggttctcatgtatttttcgtttagtgccataccataacaccatggagcccataatgccactgtggtcctgggtgg

SEQ ID NO: 550220 - DNA, 122 bp, Homo sapiens
ttgacgtcgactctgcaccttcaggttcggatgcagcgtcagaagacgcgacaggctcggggccagatgctgcgagccgacctcgtaccgggttggcgatccgcagcgtgccgctgacctgt

SEQ ID NO: 550221 - DNA, 129 bp, Homo sapiens
  misc_feature (22)..(22): n is a, c, g, or t
atcctcaagctcaagcattgtngtgtgcaggcaaggtcaggtttcccccaaggcccaccattgtctttttccacctttcccccagatgctgcactcagcttcaggcatccatctgcgccggggtcacgc

SEQ ID NO: 550222 - DNA, 232 bp, Homo sapiens
tctagaggatctctgagaagctttattactaacacaaaggaagtctgtgcaatgttgcgagaacccgtctctgaaaaaaaaaaaaaattaatttggcgggtgtgggggtggtggagcctatggtcccagctactcaggaggcggaggggggaggatcacttagcccaaaaggtcaagactgcagtgaaccatgattggaccattgcattccatgcctagtcaacagggtacc

SEQ ID NO: 550223 - DNA, 374 bp, Homo sapiens
ggagatgccatgcattgcacgatgaatgaatccagagtagggacatgtagaaaaaaaaaaagaaaaaatatatgaagccttcacggcagctacagcagcaggcacaaaagcttggcattggtggcaaaatacatttttatcaaatggaaaattcagcttttatgagggtgcagggttgctgtaagaaaggcatacctttccaatctgtcccggggtctaacgaaaaaaagccatagctgtagactccaatgtgatcccagaaaaagcaaggtcattatatgacaacttaaagcaaaaggaaggtgaaggatctaaagcgggagaatttaatgccagcaagggatggttggataattttagaaagaggttgggct

SEQ ID NO: 550224 - DNA, 300 bp, Homo sapiens
gaccaaaaataataattaattaattaattaaatagctaagcaatctttaaagcttaactaaagacatgaaggatactttgggaataagattttccatcctggagcaggggaggtttgaccaaaacgatactaatatttgatctagaaaagttaatgtgcaagaatactgcacacagtagctcacgcctgtaatcccaacactttgagaggttgaggagggaggatcacctgaagtgagaagtttgagaccatcctgggcaacatagcaagactctgtctctacaaaaaaattaaaattgg

SEQ ID NO: 550225 - DNA, 380 bp, Homo sapiens
  misc_feature (179)..(179): n is a, c, g, or t
  misc_feature (259)..(259): n is a, c, g, or t
tctagaggatccctgggcgaagaccgtattggaggtcctccccgaatactcagcaactggaccatggaaaaagtcagacgagagggggttaaggtgatgcccaatgctattgtgcaatccgttggagtcagcagtggcaagttacttatcaagctgaatagacggcagagaaggtaganaactgaccacatatgtggcagcttgtgggcctgtgagcccaagtgttgatgttggcccaagaactggtggccttggaatnatatgactcagattttggtggcttccggtgtaaatgcagagttacaatgcaacgctctaaacatctggggtggtaggacgatgctgcagtgcttctaacgatataaaagttgggaacggag

SEQ ID NO: 550226 - DNA, 184 bp, Homo sapiens
agccggaccgcacacgcgaagccaaacgcgcgagtcgagaggtcggggtggacgaagttgttgcgcaacaacttcgtccactatgacatgatttcaagaagtgtatggagactcggcgtgtgcagtctggaccctctgacacgccgaacgcccaaaccgccgcaggtcagaatggacgaagttg

SEQ ID NO: 550227 - DNA, 306 bp, Homo sapiens
ctcggccgcattgacgtgcatggcatctataactgtcacagcaccggtagagtgtcttttagcatgctaatgtattataattagagtataatgagcggtgaggacaaaccagaagtcactttcatcaccatcgtggtttggctgggttctttaccgcatcctcttctatcagcaggggctttgtgacctgtatcttgtgataccaaagctgctgacctcctatttcatcctgtgaccaagaatgaccaaactcctggggatggagcccagcagttctcagccttcaggacacagtggatctgtgaa

SEQ ID NO: 550228 - DNA, 152 bp, Homo sapiens
aaaccccagcccatgactcctacagggccctctaagccctcctaatgacctccggcctagcaatgtaatttaacttcaactcaataacgctcctaatactaggcctactaccaacaaactaacatatacaatgatggcgcgatgtacacggg

SEQ ID NO: 550229 - DNA, 107 bp, Homo sapiens
gagaaaattggtacagaaatgtgaaatttgcctttgttgcaccatacaattgcaaaagatggagtttaaaaatttacatacaaacagcttgtattatatttcatatt

SEQ ID NO: 550230 - DNA, 424 bp, Homo sapiens
  misc_feature (38)..(38): n is a, c, g, or t
  misc_feature (106)..(106): n is a, c, g, or t
caatactctactttcgccaagtctcagggacccatccnccagcaacggtggcggcgccctgtgcctttgcgagggcggagctgccttctcctcagcacagacccgnagagcattgccagggcggagctgagttctcctctgcacagacttcggagatacagcgaagcggagcatgttctcctcagcacagacccgggcgggcgggccaggggcaccgcgagggcggagctgcgttctgctcagcacacacccgggagacaccgcgaaggcagagcagcgttctcagcacagaccttgtgggcactgcctcgctttgggactactcggagccgcatcaatggtgaataaaatccttcctgtttgcagcccttaataatcagggtcagagaccagttagaagggttcagtgtggaaaacgggaaac

SEQ ID NO: 550231 - DNA, 425 bp, Homo sapiens
tcccattcagatggggttgtcagagaattaaaggagacaaggtgtacaaatttcttaactgtgtgtgacacttaaataagcatttgataaatattaggagttttaaagaatccatcctaaaaggaaaattatttgaatctataaaatcagttaaattttaccttttcatttttactaatgactgcagacagaaagttgaaaactactgtagagctctttctcctgtaattgctgcttcagtagaaaaacctagactatcttaactgaatgttcctctctccttcaagtttctatgtaacctttagagatggattcataatttaaaagaataccattactgcggaaaagcgtattgccttactaactaatctcttctgatactgcaaagatatttccaaagataattcgtttgctttttcttctgt

SEQ ID NO: 550232 - DNA, 113 bp, Homo sapiens
tatgagcacgcagttcagcagcaggttgcacacgttaggcggcgcgcggcggcgcagcagcagcgtgaaggtgacgtcggggtagggctcggagcagcagccgtaggtgagca

SEQ ID NO: 550233 - DNA, 165 bp, Homo sapiens
ggatcccacttaggtcccgattgcgcttgttctcccgttaattaccgtttagaggtcaacacggtgcgcctcccgggactagagccgcgggcgatttctcttctgcgctcctgtggcagcgcggatggcgtattggcctccccattgcacgcagaacgcccctta

SEQ ID NO: 550234 - DNA, 147 bp, Homo sapiens
cgtatctacgcgttgacagtgggctcgagactctggctgcctgaggaggcctcggctaggatgcagatggatgctgcagcatccagagactatggaagagagtacctatatctagtttattccaaagacagacaagcagtgtgtgcc

SEQ ID NO: 550235 - DNA, 706 bp, Homo sapiens
ctgggcgtgcgcggccgcaatgaactgggagctgctagctagtggctagctaggtgctagtgcgcgctgctcctgctcttggtgcagctgctagcgctatcctgagggctagacggcgacctgacgctactatagggccgagctggcagggcacgacgcccagaatgggcagctagactagatataggtaggtagtagggtagactaggagcctcgcagtggaatatggtagaggagctaggctataaccagtatagtctaaaactaaggagtttctctatgtgctagtcagccagaagagtgcatagagctggaaaggggtgaaaagaagatgcctagagaatggcaatttacaacagaaaaagatatacttgttttgccccattgacctgaccgacactggttcccatgaagcggctaccaaagctagttctccaggagtttggtagaatcgacattctggtcaacaatggtggaatgtcccagcgttctctgtgcatggataccagcttggatgtctacagaaagctaatagagcttaactacttagcggacggtgtccttgaccaaaatgtgtacctgcctcacatgatcgaggaggaagcacggaaagatttgttactgtgaatagccatcgtgtgtatcatatctgtacctctttccattggatacctgtgctacaaagcattgtctccggggttatcca

SEQ ID NO: 550236 - DNA, 880 bp, Homo sapiens
gattgcgcatgtgggaaacccacgctgagggaagaatcatgggaaagagtggagacggggttccaccgtgttagccaggatggtctcgatctcctgacctcgtatcctcccgccttggcatcccaaagtgctgggattacaggcttgagccagcgcgcccgttcctttcgtgttccaaaggctttgtaaataaacttccactcctgtcctggattctgctttatggccctcagtcgaattctttcttctgaggaggcaaggacctgaagtggcttctgaccagtacaggagaaaacgaatacagcagggatgacttccaccagctccattttgccagctctgaggtgtatcaagaaagtgaccctgaaggaagtcatggccacgggccaagaacctttaagcattcctttgcggttgaccccaggatttcagacgaggctacaattttcctaaccagtcacaaaatcagaggaatgtttgattccacctatgacctgtgagctcctgtttcaagatattccaccttttttaggccaaaccaatgtataacctccaagtgtcgattcaacactttcgaatgtaatttctgcttccctgagatttacccctgcttaaaacctggtgtgaatccctcggagggcgggattatagtcatgaggtgccaatcccctggtggtgcctggaaataagaccttctttccccctgaaaaaaaaaggagagaagagagtgggggggcggccccaaagttaaaaccgtggggggcgcgagaagagagcgctagaggccagggacggcacaaggggggacccaaaccgggcggggaaaagggagcggaaagccgccccgccgggacgcacaaacaagggcgaacagcagagg

SEQ ID NO: 550237 - DNA, 1082 bp, Homo sapiens
tttggtctagtgttgtgtgttgtgtctctgttttgtttttttgtcattgtacttcttgtcgtataagtatttagtgtgttacgtgctgtaatcatgcccgttctcgtttggttctttgggttcctagctctgcattggtggttcgtgtgtgggatagattgctgaggttatggcgttgtatcggggttctccacatggttaaggttgggagttgtggagtgttgtgcaattgtggtctagtgcgtgctatcggtgcgtgtgcgtatgttgtgggttgtctgcttgccatgtgtgtcgagtccatgggtccttgtgttattgttgcttcgtggggtttcagggttggatgtatgtcaagactcgcgttgcttaatggtggatgtcgatacaatggtgatggagatcattacggcagcatgtgtgtctttgacgcttcatatggtacatacggtctggattatttgttggattgtaaatcttctcgaaccctgcgccttcgtggatcccagtcatctagtttgctacatctattggagccctcccagatctcacgcttgagccaggcatctttgacactgatgggccaagattaagtctagtttcttgattgttcatactgttacgccccaggttgagagaacagaggcttagggaccttcagaccatgtggtatcactgtttgcctagctgtgtggccttggtcatatctctcagcctctgagaaagcctcgttcccactatctggaaataaggatgatctatagcgtacctcacggttactattgcaaagcctgtactatacaagctcccagcctacagaggctctcaacgaagagtcaccttcatggtcgtcttcaggaacaggacggatgaagaaggggtggggttaagactcaggggcacctgagggtctgagcccccttatgagtacccaagaaggactgtctatgcatgcacacccacaagccttatacacctatttatataccatacacgaacggcaagagaacgcagagagataggcgatgcagactcgcgagtcaatgatcgatatgtctccattacgttgcctgggttatttt

SEQ ID NO: 550238 - DNA, 678 bp, Homo sapiens
  misc_feature (39)..(39): n is a, c, g, or t
  misc_feature (65)..(65): n is a, c, g, or t
  misc_feature (146)..(146): n is a, c, g, or t
  misc_feature (159)..(159): n is a, c, g, or t
  misc_feature (167)..(167): n is a, c, g, or t
  misc_feature (175)..(175): n is a, c, g, or t
  misc_feature (184)..(184): n is a, c, g, or t
  misc_feature (221)..(221): n is a, c, g, or t
  misc_feature (235)..(235): n is a, c, g, or t
  misc_feature (243)..(243): n is a, c, g, or t
  misc_feature (246)..(246): n is a, c, g, or t
  misc_feature (252)..(252): n is a, c, g, or t
  misc_feature (262)..(263): n is a, c, g, or t
  misc_feature (281)..(281): n is a, c, g, or t
  misc_feature (285)..(285): n is a, c, g, or t
  misc_feature (297)..(297): n is a, c, g, or t
  misc_feature (312)..(312): n is a, c, g, or t
  misc_feature (315)..(315): n is a, c, g, or t
  misc_feature (337)..(337): n is a, c, g, or t
  misc_feature (455)..(455): n is a, c, g, or t
  misc_feature (528)..(528): n is a, c, g, or t
  misc_feature (600)..(600): n is a, c, g, or t
  misc_feature (678)..(678): n is a, c, g, or t
ctcagacctctaacatctgaaactatacgaaaataaagntctgtgtttatgtcactcggtttgtngtacattgctgtcgcagccctagtaaccaatacactgagaggtaccatgttctctccaatcaaggttatggctttggccanttcctcacttgtntatcttgntttctgcntcctcagtntcggtcccctttgcctcctggggttgccccttgtggnagtctaggccagcntagtggcngcncctgcncatcttctgnnatggggccagcctcagcngggnggtctgagactntgcctgtctgggacnggngctggtggcccctggggcctgngaccatggcggggttcacatcatccgtgttttgcactggctgggctgctttcttccttctagtcttcactctgaagatgaagcaaacacagaggaaaaccagggttgtgatgctagcnccccaggctgctcccaggacaccaccagccctgccttctggtttccaatgcacaaagagactcagagagattngcagggagcccagaggatgctgagcacggcaggtgaaatctccttcttctgcagaccctacttgaggcagcnccaggaccccggtattggagatgggggtggcgttcagggcggggaagcctggaaccagctcaggtgtgcaggggggtn

SEQ ID NO: 550239 - DNA, 481 bp, Homo sapiens
  misc_feature (80)..(80): n is a, c, g, or t
cacgaggccggccgagagcccgaaagaagtggcgctgaaatccgagtggttgcgtacgtcgttccacgacagcgttccantggtcaagctgttcttgtcagcagttgccgtactggcgatcaccgcaccatcaagatccgtgttgcccttgaccgtgatatcgaacccgccttcaccagcccgaatggctgtttgttcggtgacattggcgtagctaccgtcggccttgcccttggacgccgaaaaactggctgacccgccgccctggctgatgctgaagccaccgcccttgctttcctgccgggcgtggaccacctcggtgtcctgacggctttgcaggttcaggtcgccgccaacattagccgcaatcttgccgccggtgacgacgccgcccaggatattggtatcgccgccggaaacgattgcgacggaatcggtaccggtgatgtggctgttcacctgtgttgcgctgacgctgtcc

SEQ ID NO: 550240 - DNA, 920 bp, Homo sapiens
ccgggcgcggtggcgcgtgcctgtagtcccagctactggggaggctgaggcaagagaatcacttgaacctaggaggcagaggttgtggtgaactgagattgcaccactgtactccagcctgggtgacaaagccagacttgatctcaaaaaaaaaaaaaattaaaaggaaaaagattcggctaaaggtaaattttccatagagaagggacattaatcccagaagggaaccttgaaccctcaggattgaaagacggggcaacgggacctgggtaaatatcctgggtaaactatacatagattattccatctggatttctctacaactatgtttggagggtaaacaggttaacaacaacaacaaatttacttgtggctggaagtttttttaacgtgtttgtgcaagttttacatttttaagcacaaattacaacattaagggggccataagggtaagagagaacctattgtgagtgggtggagaactaacggtggttggggacacttttgaaggtgtggtaaacactttgtggacctcttaggtatgaactgtggtggaacgagttaacgggctggtgtatattattgggtaaaggcccttagaagggcacacacggggaaaattccttattaccaaaggggagattatttggtaaaaagttacagatgttagcgtttgagagttcaaaaaggtgtgggaaattcaccttaacaagcgaagggtttcccctattttcttaaacgaggggggcggaccacaaaaattgtggggagaaaaccgactgtggaaggggtgacaacaaccacggggaacaaccagatgtgtggcaaaacaccacacacttagtgtaacacattattggggcagatagaaagctggtcaaacgctatgataaaaatgagcgtgaatgtttcagcgtaga

SEQ ID NO: 550241 - DNA, 241 bp, Homo sapiens
cttccggacgcatcttcgattaatctataacatctgtgatatggcgtctcatggctcctattacctgatcttatacctctcaacgctgagatggaggggctcccgttctctcgcttcgatcgctatagtggaagacctgttactcactgtcatcttgtccgatcacctggaaacctactgagttcttccaaacgttctgagttttgagatacagcttccactgtggatcctctaaactctt

SEQ ID NO: 550242 - DNA, 815 bp, Homo sapiens
ggtcagagtgagtgttacagcggcgggagtgctggccgggttccttccgcgggacggggagaaagagagagcgcgaaacgacgagaggatgtctctctcagactggcacctggcggtgaagctggctgaccaggcacttactccaaagtctattcttcggttgcgcagagacagaactgggagaatactcgcgtagggggctatagtattatcatttctgaagcagcttattgctggcagactccaggagtctgttgcagaccctgagctgattgatctgatctacttgtgcgtctggaacgctaagacgatgaccagacacttgacttctatggcattcaacctgggtccactgtccatgttctgcgaaagtcctggacctgaatcctgatcagaagaccggaacctgtggacatagagtggctggcatgagatgagttccgggtgttgcacactggcctgcacagtagctcctcttacagggaggcggtctttaagatgctcagaaataaggagtctctggatcagatcattgtggttcaccccaggcctcagcagtgatcctattgctcttggggttctccaggaccaaggacctcttctctgtacttcggctgatcccaatatgcgttgatacgttaggtgcctgtgtcacccagtcctcgtcaatgccattgtcgctggttcttgcactccgaaagcaggcaggtgcccaaatgcctggggactgactcctcttcccggagcatgcctccagtcataccgggatatgcaagtggttcctgtttgaaggggtctcagatgatgaggattga

SEQ ID NO: 550243 - DNA, 201 bp, Homo sapiens
  misc_feature (110)..(110): n is a, c, g, or t
  misc_feature (113)..(113): n is a, c, g, or t
  misc_feature (152)..(152): n is a, c, g, or t
  misc_feature (161)..(161): n is a, c, g, or t
  misc_feature (177)..(177): n is a, c, g, or t
agtgcaatatgcacattactaagcacaaaaaacaagtgtaattcagaactacttgcattttttttagttaaatgccaatgaattattatgccttagttttatgaacctgnctnctccttgtgcaattccttccttgcaaatgaattgacttnaacgccgtnagtgaatagcctcagnctgtaggatgtcctttcaaatttt

SEQ ID NO: 550244 - DNA, 1196 bp, Homo sapiens
cgtgacgcgatgtgcgagtacagcgatgggcaggctgagagagtggggtgatgactgccactggcctgaagcaggcgcctctggtcccaagggtagtgaggcccattcagcgaaacggagtgggcctgcgattctgcggaggaagaccgcccaggtcacagagcagctccacctttactgatggtcatgagcatccacgaaaaagtggccagtacttcagctgtcctcaaagcaggacagacagagtgtttctggcagaaagaacagcacaagcaaagatctggtaaccctaggtgcctccagtttgagggaggagagaggacaccccactaccaccccagacataggaaagcagtccacctgcgacaccaggggcaggacacgtggctgggattgcagacgctggcccggatgtcgcggaggactcgcgggccggtagagcgcgcggcgagcagggagcggaggcgaaaggcggaagggagaagcaggtcacagccccctacaccaacaagctacccgaaagacagagggagacgaaacgacggccgaagaaagcccgaggacaggatgaaatccaaaagaaggaaactgagacatgagaacaacacaccgagagaaggaatacacatacaagaacggagcctacggacaaacccccgaggcagttcacacatccgtgtggcataaccgaggacgtcaggaatacagaccaagacggcaaatcggaatcagagatcactaacagaagaaacccgaagcagcagagaaagaaattacagcgattgcaggggagcacagaatagagggcaacgtaatatgacaacagaacgatgaacagtacgagggggaaaccgcgggcagatggggacaacgggaggcgaaaattaaaggaggcggaaccaccgagaacgggaaacaagacataagacaaccaccaacaagcacacgacggaccaaggcgaggaagagcggaacaacggcagagggggagtccaagaaacagagaagcctagagaagagtgggcagtaagaggagggaggggaacgagagaaagcgagaataggacgaggagcacgccgaagagggaaggggagaggagataggagagcgagagagagaagggagaaagagagcaaagaacgcagagacggacggcaagaggacgaacaggaagacgaaggcagacgcatgggga

SEQ ID NO: 550245 - DNA, 464 bp, Homo sapiens
gacgggtcagggtcaagcccttgttggagcagccgaaacaggcgaaaaccaaactgctcttcgaccttgttcaactgcgcggccaaccctgcaccgtcaaactggactgctccgcggccgccgacaacgagccggtctgcacgatgcgcatcaggttgcgtaagattctactgtccatgggctgatgcctctaaggtgagctggcgattgtcgcgtaccttgcggtctatagggcgccatttgaaacaacggctcacagcgcaccttcctgaaaaatgaaccgacatgaccgttcggcgctttttttggcgcgatcggaaattcatatctagggttacgtaactggcgaaatgcagtctgcgagtatcggaaaacctgctgttaccgacagctaatacccaagaaaatcagggatgttttgtgcttgcgatcatctattcgctcgccctgagtgacgagttgat

SEQ ID NO: 550246 - DNA, 575 bp, Homo sapiens
atatattaacatttccttctctcttcttaaggacaaaaaccacccccaataaaagctgggactacaggcatgcaccaccacaccaggctaatatttttgtatcttcaccccaaaccgccgtccccccacctcttcctccctccaccctccctcagctcccaacccttccccaccaccccaatccatacaacttcctccccaacagatcctttctccaccccccgcagccacaccacaacatacaccctcactctacaaccccctccttcccccgcggccttccaaaatgaacctcccccacccacctcttcaccacaacacgtctcccaaccctctcctaaaaaaacatgccaccctacccatctcctatctcactacaacccccatcttccccaccaaacatactctacaacaacactctcttccctccatcaccacccacctcatcgtccaaacccctccccctgatccgcccacaaccaccacagaactctcaccacccctcttcccctttccaaatcctcccccacatgaacaacccactccatctacaacctccctcaacccaattctcg

SEQ ID NO: 550247 - DNA, 172 bp, Homo sapiens
tgagatggagtctcgctctgttgcccaggctggagtgcagtggcgcgatctcggctcactgcaagctcggcctccggtcacagcactatctgcctcagcctcaatagctggactacaggcaccacacacgccgctaatctttgtattagtaggcagtcacgggtagcaggac

SEQ ID NO: 550248 - DNA, 1366 bp, Homo sapiens
cttagatccaaataatgactttggatcattgtccagtttttacaaatccatcaacccagagccatttaataagtaattatccctcaattttctctttcctaatctccctgacacttgaagaaaacccctaggctaagttaggtttggggggatttctagaaccatcaagactctgcctgtatctcactactgtcagctctttgcacaatgtaataaattaccattattgttcaaatgggtgggctttagcaagtctttcaaagatacaccaggctctgccttgcaaagctacatgggagaggaagctaaacaggtagggtgtgagacccctcccaccataccgccaccagagcagcctcatatctgtgcaaggtgaaatctctttgccattcctgtcataaacacagattggatacttagagtatatatgatggaaaactggggagcagaaggggcaaaccttgtgtccatctagtctctggcacttctggctaacgttgctaaacagagccagctttctgggcaatgtggacagttgcagatagcacagtgaccacatatgacgcaactcccctgtgatgtatacgaatgcactggcttcaaaggctatgctgtccgcgcaataccttaatccattgcacttttgtatcactaataaatcaaacgtctattgtaaatgttcccttcacacttacatatccttctgtattgagacaaccatgcacatgtccactttccagttactcaccagatacacagactttatctatacatagacaccacagagcaattcagcggccattgcatagacacctcctacatatatcgtcgcaaatagtataaaaatcatcaaatgacaccactatgagagaacacagcactttcttttacacgttaagctactcagataatcagtccgccccacctcacattatcatacactcagagtgataatcagtaaaacttatattagttgtctcacctgagtacataatcaccagcacctcagacggtagcaaactatactaaacaagacaacagacagctaacaagtctagacaataagtcacactttcaatattctactcccatcatacattacttctcctccacttattccacaatcatcaccaccgcaccacctccactcacttactccaactaatcatatccttataatctattctacctccactccacctatctacaatatattccactacacaacatcacacatcaaaaacatccacctcactaatacactaacaccaactaaatcatacaaacaacccacccaactcaccatcaaaccgcaatcaactaaccactccaacttaccaaccacaccacatctccacattcacca

SEQ ID NO: 550249 - DNA, 313 bp, Homo sapiens
gagcagaacaaagctgacactagaacaaccaaggataactacaaactaccactacatagcccctgacgcatggtcagcgagaggatctaggctagaataggggtgaggcaaggacccctgactattactacatacaagtgtacagctaccctccgtggtcatagcaggatctctactgaggcctactgaggctggctggtagtggtgagtgagaagtggcatctcctctgtatcctcccaacatctgtctgtccagaataggtcccctcctctctgtggaggctcccgccgtgccccagcacaagtgagccca

SEQ ID NO: 550250 - DNA, 747 bp, Homo sapiens
acaatttgcaaggactctgaattttgcaggactattttgggatactgtaaaaaaaaaaaaaagaaacaacgacacacacacacacacagctcatagccagagcctgctctggctcgctctaaggcctcttggagggaaggacagttccaaaaggcacggaccgggtgacatgggtgggcccggcccctcctcaggcagacagctcagccagggccctgctccaagggggtccacgagaccaggaatcatcagtcccagcgcaaggaaccagcccacaaaggagggaggctcaaagccttgctatcaccacggtgatgggcggtccgccgatcccgatgggcggggtccggtctcgagtgtaccggttagcagaagtcaagggcttcgtggggctgtatcttcttctggagaatcctttccaagcccagacaaagacctggtcccagggtggtccagaagcgtgacggtcatcccgtggccagggtctgcctgcatgagctcacccaggaacctcttcgatcacaaaaggtccaatctgtgtgggacgcaggcaaacgaggcgaggaggatgggcatccatcttcgtgtccttcagccggggggatgtgcggtaggcagcttccggcgccaggctcccagaagccatgtggtcggggcttctgcccctgcacaggttgggccgcagaccctgagaagctcctgggccgcgtcttctgtgcctcgggtcctgtaccacccaagtagggg

SEQ ID NO: 550251 - DNA, 414 bp, Homo sapiens
gggggggcgcgagactcacctagatacgaggtgctcaaaggagggctctatgagacagccaccacgcctgggggccaaaaaataggttggtggaaaacacccccggcggtggcttgctcggttggtaacaactcagcacacaagaagatgtacgccccggggcggctgtctgaccgcgcgggggcagccacacgtgaggggccccgcacagcacacaccctctgcgggagcggcggtgggagagcgcaggggagagaaaccactttctctccacaccgcggagggcgcgcggaggtgttcgcacacagacctgcaaagagtccacacccccgcgaggaacctcccccactcccggggcggacatcgtcacgaccacctcggccgctctaaaaaataaccaaccacaaaaaaaca

SEQ ID NO: 550252 - DNA, 141 bp, Homo sapiens
tcgcgtacatatcggcttgactagattcaagcagcttccagcaagtctcgatgtgctgctgggctttacgggcatcgtgaaagtagattgcctctcgtgtttcagttcctgaacatagcgtgccaagtccacaatgatctg

SEQ ID NO: 550253 - DNA, 705 bp, Homo sapiens
ggatcccccggtctgcaggaattcggcacgagtacatgtcaaccctttaacaacccagtagttagccatgatcattgtattaggctgcttgggttgctgtaactgttaataccatagactggctggcttaaataacagacctttatttctcacagttctggaggttgcgaagtccaagatcaaggtgctggccaattctgttcctgcctctcttttctggcttatatatttctgcctttttgccgtgtccttgcaaggcagagaaatatcttctcctactccaattcttccttctactccttctttttcttcataagccactaatcctatcatgacagccctattctcattacctcattcaaccttaattatctcccaaaggtcccacattcaaataccgtcatattgagggttaaggctttaacatctgagttttcgggcagacacaatttcgtccagagcaaccatcattttgctaatgccatctgccttggaaatattaatagcaagcttaagacttttctcaatattgaggaaggctcatagagacttcgatagcttttcgctcgcttgggaatatatacaagctgcacagagcgttcagcgtctggacgctatcacacccttttttaacatctactcccatactttgaccgcccattacctgggctatgcccctctcttgtgctcgtccggttcctgccg

SEQ ID NO: 550254 - DNA, 898 bp, Homo sapiens
ggctcgtggtccccagaagcatctgaagcgggtggcagctccaaatgcattggatgctggatacaattcgaccgggtgtgttagctcctcgataccatccaccgtgtaccccatcaagtatgagagagtgtctccccctcatcattttcctgaggaacagacttaagtgtgccctgtacaggacgcatgagagtaaagaagatttgcatgcagcaggttcattaagatactcgactggctaaggtccgactctgatataacctatccctgctggcattcatggatgtcatcacgcgttgacaatgacgggagagacatttccggctgatctatgaccccaagggtcgcgtttgctgtacatctgtattatcacctgaggagagccaaggtatcaagttagtgcaaagtgacgataagatctttgtgggctacaaaacggaatccctcatctggtgactcatgcatgacccgtaccatccgtctaccccggatctccctcatcagggtgagatgatagcattcagaatagatttggtagactggcaagaattactgatgtcatcaagtacgatcacatggctaagctgtgtatggtagacgtggaggtggctaacctagagaactacacttggtgtgatcaccaaagtgagacaggctccctggatctccatgaagcagtggtccacgttgaaacgattgccaatggataacggctattgccactcgacgttccaagcatgtgtggtgatttgggcaagggctagcaaagccatggattttctctttccgcgaggaacggggtatccggctcaccattgctgcaagaagagaagacacacagtactggcggccaaaacagccccaagtgcgttgacaactggggtcccctgggtggaca

SEQ ID NO: 550255 - DNA, 111 bp, Homo sapiens
ttagctcggcccctaaataggatgtcctaactaattgattataataagcattatcggaaatgtgagttgggatcaggcgcgcgcgcggtcagattcccctcagtgccttct

SEQ ID NO: 550256 - DNA, 148 bp, Homo sapiens
attaagcttgacacatctgtgttatcacgcactgaagacaggaagcagttcactgagtcagctggcttccaagcttacacagaaggcgataagtcactatcaaagagccaatgagaatcttcttatagaataacctgggcccaagtga

SEQ ID NO: 550257 - DNA, 171 bp, Homo sapiens
catggacactgatcattcgtgcttatcttttgcctgaaaataacactgctattaaaaaccatgtagtactgtgaggtagaagtgtatcctgaatagcagtttttcatatctcgaattagcttatcaaactctttgtagtttagctcaaaactaataatcatcaatagtctc

SEQ ID NO: 550258 - DNA, 839 bp, Homo sapiens
  misc_feature (1)..(1): n is a, c, g, or t
ntgtcgatggcttcacccaagcgcgatcgggtgtggccaaccatacattgtggtttccgcccccattggtgaagaatagattttccggcccccccccgacaccaccctgtgtgctttgttgcggcagaactaaagaggtcttatctttagtttaagaaaaaatcgtggggccgccactcatagacggaggcgtaggtccaaacccaaatgatgtgcgtctcggaccacgcaaggttggtgtttacagacgagaatatccgcacgctctcacacgacacattgcgtggttacatatactcaccacgcgtcaggaccgaaacagctggtgaggtgccatctcccctactttcaagggagcccgctctttccccccagcgcggacgatgatctctcttgtgggttcccgaccgtctgcacttcgaggttcaaacccctctgtgataatcgtggtcgttgtcatcgctcctaggagaaagggctcacatataggcgccccgccacccggttctgtacctaccttaccctcggaatgtcgtgggctcgccgcttcgtgagccccctaacagaggatgacgcgacattgaccactacatctggggtaatcgttgcctacaacaagagagagcgccccctaaaagcgagaggattgtcccgcatatctcagtgagggacgtccccgccggaagtaatgagagctgacctcgtggggagcacccaccggtcgcctttcatgatgatcgctatgggaacagtacctaggcacagcgcagaagctctgcgggccttgtggcgcgccttaaagaagaactttttcttctccccgaacacgacaaaacaca

SEQ ID NO: 550259 - DNA, 492 bp, Homo sapiens
ctaggacgtaacgtatttactgggccatgactaatatccaggcacaggctgtggtctcctcagttctctattattagtgcgattattaagagtttgaatattctttaaagaagttgcaaaatgatctctagtgttcatttcttagactagtttcgtatctctcaaaaaagccagagttcgctcattatagctccttttaccgagaaagaatcccaataaaacaggcgccacgatgtacaatcagaaatcacatctcccacattttataccttctgcatggttgcccccacatctttcactcttatacacaatttagtgaagccaaaaaacatctcttaccaggcgaatcatattaaataccaaaacacgatggctgaatatacactagaaggaagaaaacccattagagaggccatagttttctctgggctcgacttgccatgataacgctcagtctgacattctttaacacacatctttaggtatccgatt

SEQ ID NO: 550260 - DNA, 1112 bp, Homo sapiens
gacgccctcgagagttgcgtctacgctgctacacatggcataaccgctaactattctacctttccacagccctagctggatcgacatagagtctaggttgacagtgcccggatgcaatcgctcaactatcgtactattactaatcattaagtgggtctggccacactaatgttgcgtagctgtacgactcttggcgtgaagcaatgtgcttaggggttaatgtgtgtccggctagtcgcgttggtggtgacacagaccaagcaagcttgacgggttgtcaacccactagaacatgacaaggggctgatccatctgtccccccactggggcccgttagcttcctgctcgtgacgtgactttgacgatagaggaggcgcaactgtgccctggttcccgaggatccagaggtagaacgtgcgaggtagaaggtacaggatgatcatatccagctgtcgtgcgttcgtcctatggtgcgcagtaacaatgtttttggccagtatctcatggtgtcgtgcttctcggtatggaccaaggctcacggatggcataattctcctggacctgatcatgtcattctccaagtgtagactacgtcgttcatgcgttcgcagagaatgaaccgtagtcaggaccccggcatgaggtgtctgcaggttctccttgtaacgcactatcccagatcctcacaagctagtgtatcgagagggatcatggaccatatacactacatgacgggtccagattacccgtaaggaccatgcgggccctaaaaaacaaggtgtgtagaatgcaaatctctggcgaatgaattcctgggcagaccattacggtgctcgacggatactaggcatcccaggaaagacattgaaggccggtgcctccacgataacaagtcacgaggaaagcagtggcggcaagaatttgatcgcttaaacattaggcgctgagaggcaacatcacggaggctcgagagacggcatccgcggggaagaacgagcccgcgaaaggagactgctcaccccttggttgggttgccacccggccaggttgcacggcctcatgcagcccccccggggctgccgggttatgagaacctctctgggaacttggga

SEQ ID NO: 550261 - DNA, 190 bp, Homo sapiens
ggcacgagacggtgaaacccatttccactaaaaatacaaaaaattagctgggcgtggtggcgagcgctttagtcccagctactcgggaggcttaggcaggagaatggcattaacctggaggcggatttcagttagcttagatttcgccacttacttcagccttggcaacggaaccagactttttttcaaa

SEQ ID NO: 550262 - DNA, 178 bp, Homo sapiens
ataaaaactgtttgaataattagacctttacattcctgaaggtaaacatgtaatcttttatcttattttgactcaataaaattgttcagaggtcaaagtggtaaagacaatgtaaatttacacattttaatactgtgtgtgtgtacactgtgtttactttacattttgggaggtgact

SEQ ID NO: 550263 - DNA, 106 bp, Homo sapiens
aaagcccagcctttctggatccacagtgtatgggagccctgactctcacgtgctgatctgtgccttggtccaggtaggccacccctgcactccactgcccagccct

SEQ ID NO: 550264 - DNA, 382 bp, Homo sapiens
  misc_feature (32)..(32): n is a, c, g, or t
  misc_feature (377)..(377): n is a, c, g, or t
acaataactctccattccccagcccctggcanaccaccattctactttttgtctctgaatttttctactcctagatacgtcatggtaatggaatcatatagtatctgttcatttgtgactgggttatttccataacataatgactttgcaaggttcatccatattatggcgtacgtcagaattttctccttcttatgggtggataatattccattgtatgcgtccacattcttttacccaatatttttttgtgtgtgtgacagagtcttgctctggcccaggctggcagtgcagtgtcacaatcccagcttcactggcaacctctgcctcccagggttcaaggcaattcttcatggcctcaggccttccgagtaggntgggc

SEQ ID NO: 550265 - DNA, 769 bp, Homo sapiens
cgagatgctgatggggccttcacctgctgcacctaagtgacaaggccacccagacgcccctgtgctggcaagagctagaaggtgagcgtgccaggttcctgtgcacacaagcgctcagtcatcctggggcagcacagaccaccgaaaagagatttccaagttgaagcaacaactgcagaggacgaagctgagccagcagtgggaaagagaaggatgcgaggttcaccactcctaggggacgcactgcagtgcggggagcaactgagtggcgtcccctcccatcttcccctcagggtcccctgtcttgcgacatctagccccttgcctgcacaggagcctggaagggctcatagcgcaagagctggaggaggtatctgtgaaggagcagggagaaggaggagcatagcatgaggatccttgatatccctgatgggcagccgagtgctcccagcatcctccccagagatggcggctgatgatcattcgcccatctctcctcgcgtggagtccttggctgagcgcttgccacgtctctccgttccagtgtccttggcagtctccccagcgcttgtggcctgtgccaggtctatgaggagacatcggggtgccggtcgaggaagctgtgcatcgaacccctcaacgacgaagcctcctctccaggacacccaggagctttcttgaacgatggcatgcccgatctccagtccttgcctttgcttgcctcccctcgacgctaatcatagctacgatcttcaaacgggagccccca

SEQ ID NO: 550266 - DNA, 358 bp, Homo sapiens
ttgttggtttgactagtatgccatcaatagtacccgtaagctgggcacagtggctcacacctgtaatcccagtactttgggaggccgaggcaggtggatcacttgaagccaggagctcaagaccatcctaaccaacatggtgaaatcccatatctactaaaaatacaaaaaattgccaggcatggtggtgcatgcctgtagtcccagctcctcggggaggttgaggtgggagaatcacttaaagccaggaggcagagtttgcagtgagccgacattgaaccacggcactccaacctgggtgacagagcgagaccttgtctcaaaacaaaccaaccaagcaaccaatcaagctacccct

SEQ ID NO: 550267 - DNA, 421 bp, Homo sapiens
  misc_feature (70)..(70): n is a, c, g, or t
tcggtacccccagttacaacagctgaactcattcttatacatccacagttttattactcattccagtcanttgctatctataatatattttcagattcattcatcaagcagttattttattgagagctgtctttctgtttgactatacttcattttctcaactacttcttgagggatggacctgatgcttatacttttttttttcctaattccctcaacaatgcttagaagcacccctaagttatagtgccaggtatactgaaggtgctcaaagtattggtggatcagttacttcttatccatgtaatttattaggtcaaggcacatgtcagaaagcagcaaagttattcatttaacatcttttactgacatttctgaatgtctgaagccccagctggagctgtggtaactgggggtaccg

SEQ ID NO: 550268 - DNA, 313 bp, Homo sapiens
ggtagtatatacctgacctgttctcagaagctacagatcctctaagttcctacttagatgatactagacgaacatagcaggcatatggtgtaatgcacaagacttgttcatgaaagtacattggggcacgtggctgctttatgaagcaacctggctttcagggtgttcctttcatcctggaacctggtgaataccctgacttgtccttactgggatacagacgcagcgtacattggatccatgcggcctctgaaaatgggtggccgtaaagttcgaataccctacagatccaacggtagttgtatatgaaaag

SEQ ID NO: 550269 - DNA, 101 bp, Homo sapiens
tgatcctgcggactcaggccctggagtcatatactcgcccatgaagacagggaacttgtgcttgctggtcccatgagcacgatagaggaagggctgctgca

SEQ ID NO: 550270 - DNA, 168 bp, Homo sapiens
ttgcttctaaacgggaacgctaaggtcttgcttatatggggagaaaacaaaaaaaaattgaacaggattacaatagtttttctacaaggctagtttatgagtttcagcaatttgattaattacagctgttttattttccttttccaattaaaaaatatatttaatatt

SEQ ID NO: 550271 - DNA, 181 bp, Homo sapiens
actgatagattttgacttaatcaaaagttttatttattacttgtgtctttcagaaattcactcttctggaaagttgtttatgaactacttcgaagagataactagagcaaatagtttaatcccatgtgtctaacacctagatttactaaatgaaactttctttactccgtacttagggttt

SEQ ID NO: 550272 - DNA, 271 bp, Homo sapiens
tgtgtccacacggctaggcttgccggctgaaagcgtcggtcaggcagccaagatcgcgtcaggctcacgcccggtggcgggttgtcgcgcagctggtcgcccaactgacggccaatgccgtagctcacgcgggtttcgtcggtggacagattaacttcggacatggaaaggctccgctgtaggacgacacaggtgtcgtccaaactaaaagggcgagcagactagcacacaagccacgcccttgatgagccctgcgcccaggcaacgggga

SEQ ID NO: 550273 - DNA, 244 bp, Homo sapiens
  misc_feature (21)..(21): n is a, c, g, or t
  misc_feature (43)..(43): n is a, c, g, or t
  misc_feature (93)..(93): n is a, c, g, or t
  misc_feature (118)..(118): n is a, c, g, or t
  misc_feature (127)..(127): n is a, c, g, or t
  misc_feature (241)..(241): n is a, c, g, or t
caaccgcccaatccgtggggnccatcatccctggccaagcttntccatcgtccccgtgcgcagaggctactgggggaacaagatcggcaagcncccacactgtccccttgcaaggtgnacaggccgntgcggcctctgtgctggtacgccctcaatccctgccacccaggggcactggcatcgtctccgcacctgtgccttaagaaagctgctccatgatggctggtatcgatgactgctnacg

SEQ ID NO: 550274 - DNA, 106 bp, Homo sapiens
aggatcacttgaagccaggcgcttgagtcagcctgagcaacaaagcaagacctcatcttcaaaaaaaaattaaaataagggtgggtgcagcagctcctgcctgtaa

SEQ ID NO: 550275 - DNA, 146 bp, Homo sapiens
  misc_feature (142)..(142): n is a, c, g, or t
gggtgacttcaagttcttacagcatttcatcaatatccaagttgagtgtggctaatatccagtgtgaatgacagacagttggactttgtgcatttatggttctaatgatgcatttgagcttattttcacagctgccgagtangcgg

SEQ ID NO: 550276 - DNA, 134 bp, Homo sapiens
gctcgacctggctgggtgcggtggcttccatgcctagcttgtgtcccagcactttgggaggcgggtggatcacctaaggtgcacggacgttcaagcaccaggcctgggccatacatgggtagcaaccccggtct

SEQ ID NO: 550277 - DNA, 200 bp, Homo sapiens
acttaagtggagtcttaaagcaaggcaggatcttaggatagctatcagagcgtttagcgtgggggtcccagtaaaagggcactgtgctgaagccagagagcggtatgcctcaggccaccaagtggggactgtgacaccacgcattgacttccacccagaaggtctccaatgacatccgatagtcatgagtagttgatgaa

SEQ ID NO: 550278 - DNA, 1734 bp, Homo sapiens
  misc_feature (1293)..(1293): n is a, c, g, or t
  misc_feature (1434)..(1434): n is a, c, g, or t
ggaccgtccacttgagtaattcgatttgttgtgtggtggtcggttgatgttcgctccgtgctggtgcttccttacgtatggttgctgtgttgttcttcgctccatcagtgctggcggtatgtttctttcgcgcggctcatatcctgctctactatattctcttcttgccctcgttgtgttgtggtctctctcgtggataattgtgttctctctcccggggaagcactacctcaccgctcgggggtgggctacccctattccggtatggtcctcttctgagtaccagtgcctcccgctcctgtcttcgctggatatgttcactccttggggggcccttcttcttttgtgatctctcttcgagagtttgttcgtcggtggtggacccaacaggccctccggctcgctgtgctgtcgccctcgtgcgtcccccggagattccccccgtttttggggtggttgctcccccagatgggcccgacacgggtgatccatcgctcgtgtgtgtctcccaggaagtatatcgtcttggtgctcaatgaaacaaatggtgttctcatctgtgggatgagttttttactccctcttggcgggcgctttctttacaccagtccctagtgttcctcgaccacgagtctttggtgtctccctctttttgataaggggatccctcacgggatcccaatgcgcgtgtccccgcgccccgaaggataatggggtgttttcctacttcggtgcgttgaaaaaggaggggaaaaattattatccttttttggggggaaaaaagcccccccttggggagacacattccggctacccccaccacagtggccccccgcagagaacacatgtcctcgagggggggggggaaatatggggaagttttttctgaaccgaatgtatttacacacgctggattttcccgccgccaactctccccttgggacccctcgggagagggccccgcttggaaaaacaccccccttttccgcacaaggggtatgacacccacttggaagccacatgtttcacacgcgccccctcgtgatgctccctcttgtgggaggaaagccctattttcatcccgggggaaaatttcccacgggccgcttttcacccggggcctccgcccactatggtgagagcctcgctctcccaatctcaacaggggggcccccgagagatcttgtctctcacaagcgcccactcttttctctggggagagagatatgcctctggctctggagccccttgataggagagcgcgctctgtgggctctctctgagagctcttanagagaaagtggagaggtggcggcgagtggagagtggggagaagtgagagaagaccacctcgagatttcttataaatatccacaattgttccctcttctcgagaagttcgcttgcacagaattgtgttccctctataaatanagagaagaatggaaatttctctctcgtatgaggcgttctcacaatccacacttttaaaccactggagatgaggagagcacgagctcccactttataccctgaaaatatgcacgctttcttcttgagagagaggagagagagtgaacctggagagcacaactccgcttctgctgcacgctgagccccctcaccctgagttcacccgtgcgccctccctccctcccacttctgggggtagtgccttatgctgggtgttggaaccgaatgagggagaggaaaaaataagacctgcaccatctg

SEQ ID NO: 550279 - DNA, 291 bp, Homo sapiens
  misc_feature (28)..(28): n is a, c, g, or t
  misc_feature (201)..(201): n is a, c, g, or t
cagttatgttaggtgtcagtttcactgnaattaaagaagatacccagatagctagtaaagcattatttctagatgtgtctgtgaggggttctggaagacactgacatttaaatcagtggactgagtaaggaagacctgccgtcatccaagtgggtgggcactatccaactgaatgagtgccccaatgaaacaaaatgcacnagaaaggtaaatttgacctctcttctggagctgggacattcaccttctcctacccttggacataaggactacagtttctccagactttgg

SEQ ID NO: 550280 - DNA, 476 bp, Homo sapiens
gcacgagttccaaagacacttgtgaggacgattcttaacaataacgatacaaatttggccttaagaactgtgtctggcgctctcaagaatctagaagatgtgtaaacaggtatttttttaaagcaaggaaaggctcattaaaaacaggcaaagttttacagagaggatacattgaataaaactgcgaggacatcaaaggggaaaatactgagaaataccgatactcacaaaaagggaaaaaatggaggtggtttatcaacttcgctagaaaaaaaaaacacctggcatacaaaaaatttaagtgaagggaaaggctaacgctgaactgacaatgaagggaaaattgggtatgggttatgaaaaaaacaaagccttagttctattttaaagggggaaaaaaaaggttccccaaaaaataggaaggggacaacaggttcctaagctgaaaatttcgccataaaaacctgggacaccct

SEQ ID NO: 550281 - DNA, 206 bp, Homo sapiens
ggatacccacactttcgagcatcagtgtcagtgcagtccagtgagctgccttcgcaatcggagttcttcgtgatatctaagcatttcaccgctacaccacgaattccgcccacctctactgtactcaagactgacagtatcaactgcaattttacggttgagccgcaaactttcacaactgacttaccagtccacctacgctcccg

SEQ ID NO: 550282 - DNA, 695 bp, Homo sapiens
aagaagatatgcagcttatttggccattagcccagcgacattgacgacattctagtctcgctcattgctgcgagtgggctgctacagccagtgtccggtccatgcccagcaggttgtcccaggtcgctgtgcgggatgaacagcaagacagcaggagaagtgaaggcgtctccaggagtggcaccgagagagtcagccacagccatagagaagcgatcaggtgtgagacactggaaagacgcgggaagagacgtacaacttctgaaagatctcagaggactggcactggtctggagacggcttcctggaagaggagacgtccgagcagatgccctgtaagtgtggacaagcttcgcattcgagctgcaacattcggtgagcacactctggtgtcaggatcgtagtaacggaagatgggcttgagcagagcagggggtacctgtggggttcttctcttcagttttcacgcaggcacaaagctggtctaagctgccatcaattcccacctggacaactgtccaaagccttccagctgttcctgcttccagtctgtgctcctctacaattcattctgcacgcagaagtcagaatcaaaatcaagagttcatcatgtcattctcttgagcttgtggcgtccctttgctcttaagctaaagttaaagatcattatcatggctaaaaaaacaggaatgaaa

SEQ ID NO: 550283 - DNA, 157 bp, Homo sapiens
atgttatgagagctactcagacttgccgggactcaactgggagccttagaaggtgtaaatactgtcttacaggaaaatcattttaaatttttgagccttttactaaaaaactcaatttcagaatgcagtccatgtgtttgatttcttgggctgccta

SEQ ID NO: 550284 - DNA, 109 bp, Homo sapiens
cccctggggtttttttacctgtgggaaggggatttgaatggaaaattttagccttgtttggtttttgttcccagaccttggccattaaagccttttagttggatgggga

SEQ ID NO: 550285 - DNA, 289 bp, Homo sapiens
ctcttagaggaccccggaactcactaaatactttgtattctgtgagcattatgcattctgaatgtatgcctctacatacttcgctgatttaatgatgcctattattaaaaaaacactgtggtattcatatggagaccggagttacctggaggcagagattatacgctgttacaatacttgtatctgtgagatatcaagcccaagcatagaatgttgttcctgcgaatggcgaggaagattccagtcactgcagaggacgacttcggcagtctctggcctagattttttt

SEQ ID NO: 550286 - DNA, 1418 bp, Homo sapiens
  misc_feature (277)..(277): n is a, c, g, or t
  misc_feature (323)..(323): n is a, c, g, or t
  misc_feature (496)..(496): n is a, c, g, or t
cctagcatgtatcaaccatttaaccttccctctacacttatcatcttcacggacttctaattctagctgcactatccctaggaaactcgctgatcgaccttatactccgaagcctgacgcttgtgtcacacttcgtagatagagctcatctacactgcgacgacgaacgatcattaagtgaccctagctcaatcacatgcctatcagatagtcaaaaccgcaggcccatgaccgcccgtgaagcagggggccctgctgcagccgcgtcctagatgancgcgtgcgcggtgcctcagccagtgtgcgagttgtgcacttaccancttcgcagtaagcgactcctcgattagctaggtcgctatctaaaacacagacagcagcatgataacctagtaattgaccccatttagagtgggtcgtgcaatggttaagcatcgcatgcaaagtcactattgacgccaatggtcccacacgatcgaacaacaccaacgctagntctcaaagaaatagggccctgtccggagtaacggggcaatgaagtcccctatgtgtactgtgaccctcgagcacaaggtatctattgtatccttcgtccaggggattattatcttggcagccgtattctactctagcgtccaggcgcgtagacacgcactagcctcccctcaaattcaaggaaggggcgacgtgcgttgcccccaagaacaggagcattcgatcctctgcctagaatcacccacttaggaaggtcccacatacactaaatgagcatcgcggtagttacctcgcagtccatggaggttttcaattgtcactcttgaagctccgaccatatgtctaactagacaacacaaaccgaaaacccaaattaattcaagcactgtctttatttacacctttttactgggggtcctctaattttacccttcctaaaagcctcagagtacctttcgagtctcccttccaccattttcccgacggcatctaacgggttcaacattttttggtagcccacaggccttccacggactttcccgttccttatgtggtccaactttccctcaataatatgggtcaattccggccaactaatatttccactttacatcccacacatccaatttggcgttcgaaaagcccgacgccgaaaaacgggcaactttggacaacgcgacgggaggagacaaccaggagggaaccacaccatggaagagggcgtcgcacaaaccaccacaagcgaagcagacgagaacacgaaagactagcagcaaatgaccagggcggggcagatacacagcagcacggacaaccgacccataataagccgacaagacgtataacatgcacgagccagaaacggacgtagtagatgcgagtgacacacgatactcagcctctactacctacatagaccaatg

SEQ ID NO: 550287 - DNA, 214 bp, Homo sapiens
  misc_feature (22)..(22): n is a, c, g, or t
  misc_feature (45)..(45): n is a, c, g, or t
  misc_feature (78)..(78): n is a, c, g, or t
  misc_feature (105)..(105): n is a, c, g, or t
  misc_feature (157)..(157): n is a, c, g, or t
aggttaaacccgatgatgattntggctgctggaactgtttgaatnagatagaaccgttgtagaccacctgcccgtgcnccgaccaggggtgggggagacggtggnaggtgaaattgtccgtgttcatgaagtcaaccatggaacttgtactacacgnacgaaagcggttgttgtgaatagccgtcccatgtaaccacacccggtttatcgacct

SEQ ID NO: 550288 - DNA, 378 bp, Homo sapiens
  misc_feature (7)..(7): n is a, c, g, or t
tgccaanggaaaatttaaaggataagtaaattgcctatggaaaaaaaagaaaacttggagcacaggctaaaaagaccccagggatgggggtcaggccatgatggttcacacctgcaatcccgacactttgggaggcccaaggtgggaggatcacttgagtcccaggagtttgagaccagccctgggcaacagagcaagacctcatccctacaaaaaaatttaaaaactagccaggcacggtggcatgtgcctatagtcccagctacttgggaggctagggcaggaggatcacttgagcctgggaggtggaggctgcagtgaactgattgttccactgcactccagcctgagcgacagggcaagataaaatccctgaag

SEQ ID NO: 550289 - DNA, 522 bp, Homo sapiens
  misc_feature (3)..(3): n is a, c, g, or t
  misc_feature (10)..(10): n is a, c, g, or t
  misc_feature (36)..(36): n is a, c, g, or t
  misc_feature (46)..(46): n is a, c, g, or t
  misc_feature (184)..(184): n is a, c, g, or t
  misc_feature (190)..(190): n is a, c, g, or t
  misc_feature (248)..(248): n is a, c, g, or t
  misc_feature (421)..(421): n is a, c, g, or t
  misc_feature (477)..(477): n is a, c, g, or t
tgncataaantttctgtgtcctgctttaaataaagncagatccttnatgccagtggagctgcccatcccttaatccctgccacacggggccaaggaggaggttactgggaattagctccaggcttagaatgcccaaccaaatccaagtgccctaactgagattttagaatttctttaagaaaangtgtcntcaacttgttgttttggttaatctccgaagtgctttaaatggttgtttggggccaggnctggtggctcacacttgtaatcccagcacttttgggaggccgaggtgggtggatcacgaggtcgggagattgacaccatcctggctaacacggtgaaactccatctctactaaaaatacaaaaaattagccaggcgtggtggcgggtgcctgtagtcccagctactcgggagntgaagcaggagaatgtcgtgaacccgggaggcggagcttgcagtgagccgagattngccactgcactccagcctgggcgacagagcggctctgtctcaaaa

SEQ ID NO: 550290 - DNA, 408 bp, Homo sapiens
gttcacatgccccggtcgatctcatgaccgtctcttgattggaaaaccccttgcggccccaggccctcaatagttcactttagagacttcaggattgcaccacacagaattgattaaacaatataccacacagaataagactggattagtaccaccccttccctttgccctcttgactccagataactccctagagtattacaggcagggtagatctaactatatgggaaggaatccctcacacttttccggggttaaaattctggctagtccaaaaggggtcctctctttaagggtttggagaaactagacactgcaacttataagtatcggcaacgttggttgggggcaaattcagttccaggagctgcacggttgattgcaggaggagtccaccaatggccccac

SEQ ID NO: 550291 - DNA, 835 bp, Homo sapiens
gagagtgtggtcaggcggctcggatgagcaggatttccttatcccagttgatgtgcagaatacactggctgtctgttgtctctatccaccatgtcttctctgatatccaggtgaaagaactgagaagcgtgcctcaggccaggcttggagctgattctcagccctcggtcaaaagaatctgttccagagattccccttttcccctccaagagatagaaggatctttcccgtgaggaaattcagagcgaacataagaagctgcagaagaaagacgcaggtcccttgtgccgctgaggtcttgaagcagctggttgagcaaagcgagagcgcgagaaagaagggtttcagaagcggcatatagaagagaaccacgaagtttcgagtaatactgcgcagaggaagagagtggacctacaaaagtggcgggcagtacggacgaaaccgagaaggcctcaaattggtgccacattgaacgtgttgcgaagacgaggggatacagccgcttgacacgctgtcgggacagacacaggtgaatccaaagaccctggtgggcggaggactggaaagctgacgctacttgtgtgctgagcaagtggaccttttttccccaaatcgtcctttctaaaatattccagggacgtgtacctgccaggtgctcaaatttaatttttcccttcctggaaaagtattttaagaggcaatggacggactggacttgcttggcccccagtccgactgtaaatgcggaaaagggcaaagggacacccggacggttactccttgcacagggtgggtccaaggaaccatttttgtgcgcttttcctcgcccttgggg

SEQ ID NO: 550292 - DNA, 185 bp, Homo sapiens
  misc_feature (120)..(120): n is a, c, g, or t
  misc_feature (171)..(171): n is a, c, g, or t
tgatattacagcacaactgcctgtagtgggtaaatggtcagagcctcccggtcagttccaggctgcagctgtccaaatgacaagaggaccctcactctactcagtgtcacaagggaatanaacacaggaccctatgaagtgtgaaactaccagacacaccagtgggtgccnagctacagctgacc

SEQ ID NO: 550293 - DNA, 305 bp, Homo sapiens
cggtatatcggcgcacggtacgcatcaatcggcgctatccgcaacgacgtcaaattatttagctgagtcgcctctctctcagcggatgcaatatgaattgatctgcatgacagtgctctgtagaccctagagattcatctgtctcttcaccgaaggtagccagactggcattgtattatcaaactcatcactagacatcgttactacacgacacgtactactttatagcccacttccactatttcctatcaataagagctgtatttgccatacataggaagcttcattcactgatttcccctatt

SEQ ID NO: 550294 - DNA, 532 bp, Homo sapiens
ggggggcccgctcctcttttctttccctccgtctcctatccccccgcaaccttccccccctttctttgtgcttttttcccgcttcccctaaccgtgctcttttcttcggacaaaaaaaaaaactctctcccttttcttcccccctggcccttattcttccatcgctccctctttcggtaattgtcccccgccctcctattcttcaagtccctttttcttttttcgcctcttttccctcccaaacccccgccgtgctttatctccccggtttctccccgtcttattctccttgctgcgggggggcgggtgcacattcagtcctctctgatcattttgcgttcttcgcccccctcttcctctgtttatctccctcacctgcctctttgtttttttttgctgccccccctacttttctccccacactactctttccgtttttctctccctcggtgaacccggttcttctcctttccaatctggtccctaccatactcttctcctcccccccgcttttgtgttctccttccctccg

SEQ ID NO: 550295 - DNA, 866 bp, Homo sapiens
  misc_feature (477)..(477): n is a, c, g, or t
cgtggcgaaatcccatctctagctttattttaaggatatagtatataatacacaaaatgtgttttaatcgacttttatgtttatattattgataagtcttctggtcaacaataggctatgagtagtcagtttgggggagtcagaagttatacatgggccaggtgcagtggctcgcaccagcaatcctagctctttgggaggccaaggcatgaggatcacttgagtccaggagtgcgagaccagccagggcaacgtggcgaaatcccatctctactaaaaaaaaaaaaaaaattagctggacttggtggcttgcacctgtggtcccagctacgcgggaggctgaggttgggggatcacctgagtttggggaggttgagactgcggtgagccaagattggtgccactgcacaccagcctgggcgacgcaagtgagactctgtctccaaaagttatacatagattcttaactgcttctgntggggttcagaaccccaaaccccattggttcaagggccagctgtatagtaataaaaactgacgtcaaaaaacaaaacaacaacaaaatccaacatgtaatagaacagacaggataaaagctaacgcagaacacaaatgatcaataagagaccagaagcagggggcgggggcgccctagtaataacatacgcacgaggaggggcaaccataggagcaacacacccccttttttgttagaaaggggccccccagagagcggtggtaaaaaaaacacgacgcgcggcgcgttaacaaccgcgaggatagaaaaaaagctcgatcttgatctctggagaacacccctcttggtggttgaacagatgggaacacaccgagcagttatggctgca

SEQ ID NO: 550296 - DNA, 389 bp, Homo sapiens
ccatataaattacatgtcataatattagacttccaaaagcaccatgactctgtatttttaaaatacctcttgaatgatagatgcatgaaatgaaatactaggtttttataccaagatattcaacgcttatttccttcttttgccactggttaaaaaatgtatgtaatatgctcttttataagatttcaattgaaagtggccaactttaaatttattttatagcataactaaaagttctataataataccatgttcctttttaacattttaaaatattttcagaagtctgtggaagatttttttgcagtgaatcatgccactaatcattggattagtgggtgctattgtaatgggctttaaaatttcgtataaagatttagtctaaggca

SEQ ID NO: 550297 - DNA, 219 bp, Homo sapiens
cagtcgcaaatcgaggatttgaaagatctcgcagcgattgtgatggatcagattgaattgcagctttccgcccggcgggcggtctccgaggccaaactgatggcgaaggagattgaccatcgcgtaatgaacagcctgcaattcgtgtcgggcctgctcgcgatgcaaagtcgatcgcttgaggatgctgacgctgtcgcccaccttcagcttgccgcc

SEQ ID NO: 550298 - DNA, 455 bp, Homo sapiens
acagataccaaccacaggaggtcttgaaagtacaagctccacacgaacaattgaatctttaaatatacacaagtatttccatcaaatgaagggtcacgcttacatccaaatagacctaagcgcctaaaaacataagaaaaataagagctattagctatgtattaactgagaaaccacatacaaaccaaagaatatggaagagagaaagaagggctgaaaggccaaaggttgaaggggtagggagatgtaaaagagttgaaaacaaagcccatcacacttgatgtactaatagctccaatccatttaaatgttgaccagttaaacttagaccttaaaatgcaggatgtgggtagagtttaatctggttggtcataactttcacctaagacgtagctccttcagaataaaatgaatacagacacagcttcatgttcttcaccttgcttttcataact

SEQ ID NO: 550299 - DNA, 890 bp, Homo sapiens
ggagagaactgtctcatttttttccttggtttgtaaatctgaatttatctttattaaagataccatgaatggaggggaccatcagataacgggattttgggtcagggtgcaatgaaacaacaagaattcaaagcacccaagatcgatcaagaaagacaccgtgtgattccgtggacttccgtatgtatacgacagtgagtggtgcactagacgaaacaaggcgtgttgagtccgtgttaggttcgtgtctagcagcaacacaaggtcgtggcccgtgaggagccccgaccccaataggaggcagcctccgtggaagagacaaaattctaacaggcagtgacgtggaaagacgtgcctcccgtgaaaagggcatgaaaactgcgagaatgggcgcgaggagcctgtgccgggaaaacgcatcccaagtgcacgtggacacacctttagaaagcgtgtgtgaaaggaggacgttgttccccttaagaaaaagtttccatagttcaccaaagcgagggctccttcagggacggaccagaagttctcggacaggtccgtgggcgtgtatgggagtgccatatagtggtgcacaaagtgctcagtggcgcgtgaaccaacatcttcgtgaaagaaaaagttccccgcctgtggtaacaagtgcatttccatccagaaaggcgtgattttccaaaaaattcccagtggtgttcctccacattcagggacgggacgtgccgtgaataacccttaatttcctctaagatactcagtgtagcccaacaagcgggggctgggccccggaactatttggggactcacccaatcaaacatccattgtgggacatctaacagaaggcttgggcctttgaagctgggggaaattgtggggaaga

SEQ ID NO: 550300 - DNA, 270 bp, Homo sapiens
  misc_feature (77)..(77): n is a, c, g, or t
cgcaactgatgcttcagaggtttgtgcgatgctgtggtgtgggtcggaacatgtccgtctaaatgtgcttttcagancgactctgtgcgcgggcgtgaagatgtggcctctacggaaatgattggaatgaggtaagaaatcgagcgagaccaatacgtgtttagtgtgctataaagccggacctgtggtgcgttatgataatggatgtaacgcaggggcctggcgggaacaaactacatactttaaccagtgcggagatgctgttatcta

SEQ ID NO: 550301 - DNA, 339 bp, Homo sapiens
ttctcccgacaacttcactatcagcgggaatgcgagaaaaaccgttatcccctcaccttgtacctcaaaccatgcgctgtcggggatccgtctacattcgacgtgtgagccctacatgtgttcggactggacgtcttcttcaacgacgtgattgctagatcctttctggcctgtcgtctcctgcttggttcccggctgtggggacagtctggtcacgcagtgcgttgcgctgcgcgacccccgctcagcgcgaggctgagaaacatggctaaaccggttacggcatgtttcccaggatgcgcactccaggcacctcctcggacctggtcgaagctctgg

SEQ ID NO: 550302 - DNA, 683 bp, Homo sapiens
ttttgagacagaggctcactctgtcacccaagctggagtgtggagtagcacttttaatttccttcaagaacttttcctttgcattcacaacttggctaactggggaaagaggcgtggcttttagcctatcttggcttctgacacgccttcctcactagcttcatttcttgcttatgatttaaagtgagagacatgctacttttcctttcacttgaacacttaccggccactgcagggttattaactggcttaagttcaatattgttgtgcctcataaaatagggagaccccaggagagagaaagaggcacggaagggacagtcagtggagcactcagaacacacagcatttatcaattcaggttatcctttcatatgggtacgggtccgggccccaaaaacaattacaatagttacctctaagatcactgatcacagatcactataacagatattataataatgaaaaggtttgaaatgtttcaagaattaccaaaatttgacacaaagacactgtcctgttggaaaaatggcaccaaatgacttactcaacagggttgccgcaaaccttcaaatttttaaaaaactagatatatatgaagtgcaggaaaaaccaagtgcatttaaatgaggcaattttggtattctaaaaattgaaatgcttggccggccacacctataaaa

SEQ ID NO: 550303 - DNA, 977 bp, Homo sapiens
gccggagccgagctcagccgagcgtacgcgcatgcccgtgcgcctctgcgcctcgcgccatggccggcctcaactccctggaggcggtgaaactgcaaggatccaggccctgcagcagcaggatgggacgaggctgtgaagaccgctgcgcattggtctgcagacgggagctggatggagtagacgcgagacggcgcggacaaaacgtctgaacggtgatagtggccgcccctcaacccgagagcatccagactcgttgaggtagggagttggacagcgcgactcaggaacggactggccacgggccttgcaggcaaggctggagcgtgggcagaaaaagtctgccagaataaagcacgtgaggagagtcaactgaacgtgtgattagaaaggaccggggcccattggaacgggattgacgcgaggaaaggcattgggcgattcatcggggagcagtgcgacgctcaaacgacgggccaatccagcgttttgcggggacaggatgggctagaaccggcaatatacgaagggaggcctatagctccgataaaagcttaggctcatccgtggatcgggagatggacgcgtggcagcagtcggacacggaagaggaccgccggttgccgcgagccgttgcttttcgacctttagcgccagtgttggttgaccgcgttgggaaagaaacggaaagcgtccagcgaaacttgtttacctaagagcagattcctggacaaagtctcgtgggaggggcctgccctctttgccgcaatgcttctgcttgacaagaggggagggacccaaatactgaacgaaagggcaaattagagcttttcttgctctgtacaacacgtgcacaagaagggatgaagaccccggtggctggactttgcaggaggagcagccgggttgccaaaacgctgggacggcagacacattgagtgacctgggaaggagaaactttgccccgggccaagaag

SEQ ID NO: 550304 - DNA, 206 bp, Homo sapiens
attgctgggattaccaggcatgagccaccgcgcccagacaaggaaaacaatttctggagtctgagcaggtatcctgtcttctcatgtttgggacgtttttttgttgctgagatagagtctcactctgttgccaggctggggtgccaatcccactcacagggagatgacagtaatgtgtacttcgcaccctagcacggtggcggtgc

SEQ ID NO: 550305 - DNA, 716 bp, Homo sapiens
  misc_feature (255)..(255): n is a, c, g, or t
  misc_feature (257)..(257): n is a, c, g, or t
  misc_feature (263)..(263): n is a, c, g, or t
  misc_feature (267)..(268): n is a, c, g, or t
  misc_feature (271)..(272): n is a, c, g, or t
  misc_feature (293)..(293): n is a, c, g, or t
  misc_feature (301)..(301): n is a, c, g, or t
  misc_feature (303)..(303): n is a, c, g, or t
  misc_feature (307)..(311): n is a, c, g, or t
  misc_feature (314)..(315): n is a, c, g, or t
  misc_feature (317)..(317): n is a, c, g, or t
  misc_feature (321)..(322): n is a, c, g, or t
  misc_feature (324)..(324): n is a, c, g, or t
  misc_feature (327)..(328): n is a, c, g, or t
  misc_feature (332)..(333): n is a, c, g, or t
  misc_feature (337)..(337): n is a, c, g, or t
  misc_feature (339)..(339): n is a, c, g, or t
  misc_feature (341)..(341): n is a, c, g, or t
  misc_feature (343)..(343): n is a, c, g, or t
  misc_feature (348)..(348): n is a, c, g, or t
  misc_feature (355)..(355): n is a, c, g, or t
  misc_feature (363)..(363): n is a, c, g, or t
  misc_feature (366)..(366): n is a, c, g, or t
  misc_feature (369)..(371): n is a, c, g, or t
  misc_feature (373)..(374): n is a, c, g, or t
  misc_feature (378)..(379): n is a, c, g, or t
  misc_feature (382)..(384): n is a, c, g, or t
  misc_feature (394)..(395): n is a, c, g, or t
  misc_feature (397)..(401): n is a, c, g, or t
  misc_feature (403)..(403): n is a, c, g, or t
  misc_feature (405)..(405): n is a, c, g, or t
  misc_feature (408)..(408): n is a, c, g, or t
  misc_feature (412)..(414): n is a, c, g, or t
  misc_feature (417)..(417): n is a, c, g, or t
  misc_feature (419)..(420): n is a, c, g, or t
  misc_feature (422)..(422): n is a, c, g, or t
  misc_feature (428)..(428): n is a, c, g, or t
  misc_feature (431)..(434): n is a, c, g, or t
  misc_feature (439)..(439): n is a, c, g, or t
  misc_feature (443)..(443): n is a, c, g, or t
  misc_feature (450)..(450): n is a, c, g, or t
  misc_feature (452)..(452): n is a, c, g, or t
  misc_feature (455)..(456): n is a, c, g, or t
  misc_feature (460)..(460): n is a, c, g, or t
  misc_feature (463)..(463): n is a, c, g, or t
  misc_feature (470)..(470): n is a, c, g, or t
  misc_feature (473)..(474): n is a, c, g, or t
  misc_feature (479)..(480): n is a, c, g, or t
  misc_feature (482)..(482): n is a, c, g, or t
  misc_feature (484)..(484): n is a, c, g, or t
  misc_feature (488)..(489): n is a, c, g, or t
  misc_feature (491)..(492): n is a, c, g, or t
  misc_feature (496)..(497): n is a, c, g, or t
  misc_feature (500)..(501): n is a, c, g, or t
  misc_feature (504)..(504): n is a, c, g, or t
  misc_feature (515)..(518): n is a, c, g, or t
  misc_feature (522)..(523): n is a, c, g, or t
  misc_feature (527)..(528): n is a, c, g, or t
  misc_feature (530)..(530): n is a, c, g, or t
  misc_feature (533)..(534): n is a, c, g, or t
  misc_feature (536)..(538): n is a, c, g, or t
  misc_feature (542)..(543): n is a, c, g, or t
  misc_feature (545)..(546): n is a, c, g, or t
  misc_feature (549)..(549): n is a, c, g, or t
  misc_feature (553)..(554): n is a, c, g, or t
  misc_feature (557)..(560): n is a, c, g, or t
  misc_feature (563)..(563): n is a, c, g, or t
  misc_feature (565)..(565): n is a, c, g, or t
  misc_feature (567)..(567): n is a, c, g, or t
  misc_feature (648)..(648): n is a, c, g, or t
  misc_feature (716)..(716): n is a, c, g, or t
agccaggctcgcccaccttgtagaaggagcgccttgagtcccctctcaccctcggttgcaaagagccgaccgcttgatctggacaccccctcgcccagattgcatgatctcccgggaccctcttgagttgcacgtttctgcaccgaggacctcaaatccccgtcgctcctaggatttgcagcgttctggatactggagggttgcaggctacactcgcccgcccctgggcagacactcgtccaaaccactggagtntnctggtnactnncannccagcccttcgcctctccatnaacccgtnancctnnnnncanntnccanncnatnncgcnncccngnancnacagnaccccgncccccccnccnctnnncnncccnnccnnnacaccccccnncnnnnnancnctncctnnnttncnnancatcancannnnaccancaancccaaananccnnccanctntcaccanaannaaaannancncaanncnncccnnccnncanccacaaccccnnnnccanncctnnanacnncnnncccnncnnatncccnnctnnnncantntntttcttattttcccctctttttctcccttttccttttccctccccttttctttattctccacatcatttttatctcactcntcctttcttctatttttattacttatacctttactccttccttctttatcactttctccctcccatcn

SEQ ID NO: 550306 - DNA, 404 bp, Homo sapiens
cacgaggggctggatcaccgtgtcggactgcatcaacggccagcggcacgtggtgagcagctgccgcatgcgccggcggtgttccgccagacgcgcacgccgctcgacgccctccctgatcaagcgcaggctcgccagcaccgcacaggcggtcgctgtgggcgctgcggtggtgtagcgataactgcgtccggtctgcatcatccattcgatcgcgtccgcgtcgccagcgacgaaagcaccggtgacaccggccgccttgcccagcgtgccgatgtatatcagacgcgacgacgcgatgccgaagtgcgacagtacgccgcgcccctgttcgcccagcacgcctaattcgtgcgcgtcgtcgaccaccatcagtgtgtcgtggcgctcgcagagcgccagca

SEQ ID NO: 550307 - DNA, 118 bp, Homo sapiens
cccgcgttgccgttccatttatagatcatttgccagaaacaactcattaggtagtactcaaggaaaaggctgccatgttggaatccatcatctctcccttcaatttgatcttcgataa

SEQ ID NO: 550308 - DNA, 749 bp, Homo sapiens
tactgggttttttgttgttgtttgtttggagacagagttttgctcttgttgcctgagctggggtgcaatggcgcaatctcagctcactgcaacctccgcctcccaggttcaagcgattctcctgcctcaccctcccgagtagctgagattacgggcgtggtggcgggcacctgtagtcccagctacttgggaggctgaggcaggagaatggcgtgaaccgaggaggcagagcttgcagtgagccaagatcgcaccactgcactccagcctgggcgacagagcaagactccatctcaaaaaaaaaaaataaaaaaaaaaagaaagtttttttaaatttttatatgggcgggcgagaggggggttaaccccttgtattcccaggcctttgggaaggcgccaggccaacacgggtttttggaaaccgcgcttgtgcccaactgggttcttaaaatttccaaaatttgcgctgggccttgggggcttgccctctgttattccccagcctattggggagaggcggaggccgaggagaatttctcctgtgtaccgctggcgagtattttggtctcccctgaagccaagagagcggagatccccttctcaaaacgggtcgtgttgccacttttgcgggctcccattagtgactcttgctaggtcttgggccttctggctggattgtaccctttgcgctgggtgaggcacaacttagggaaagccacttgcaatctcaggggtgcgccggaggccgc

SEQ ID NO: 550309 - DNA, 421 bp, Homo sapiens
ggcgctcgccttgcggcgcgagcactgcccccacctagggctctggttccccaaccttcactcggtcctgccacacctcccagccccttctcccttcagaactttccttcttgttgtccccaacactgggacacaaaaccctccttatcaaccctccttatctggctgactcttacaagatcagaaacctgtgtaatgctctcatggcacgctccccttgtcttcgtggatttctcagatgggaaggaattatccatgcaatcacacataaacttctacctaccctcccctagtagctgtctgctgctaaggatggggaccattctcacttactcactgttctgtccctctgcccagtccagatgtgttgaaggatggaaatatacagagtagtggtaaaatataaaccgttcagacatac

SEQ ID NO: 550310 - DNA, 103 bp, Homo sapiens
ggcacgagtctagacttcgagcaggagatggccactgcgcatccgcttccgcccgggagaagagctatgagcggcctgacggccatggcatcactattggcaa

SEQ ID NO: 550311 - DNA, 120 bp, Homo sapiens
cttcgtggagaatccagttcctccttcatggtctgctgcctgttctccgtatccacccgccgcactgtctcctcctggagttgctccttggactcatctaggcgctatagtgcgcctata

SEQ ID NO: 550312 - DNA, 703 bp, Homo sapiens
  misc_feature (146)..(146): n is a, c, g, or t
  misc_feature (162)..(162): n is a, c, g, or t
  misc_feature (216)..(217): n is a, c, g, or t
  misc_feature (324)..(324): n is a, c, g, or t
  misc_feature (328)..(328): n is a, c, g, or t
ggctgcctgagcccctggagagtgtggaggtccctcccaggccccaagcccttacatgatggcccccgggaacacagcaagagtgccagcctcctgtttggcatgcggaacagtgcagccagtgatgaggactcaagctgggctancttatcccagggcagnccctcctatggctccccagaggacacagattccttctggaaccccaacgccttnngagacggattcctgacctgccggctggatggatgagggtccaggacacctcagggacctattactggcacatcccaacagggaccacccagtgggaaccccccggcngggnctccccctcacaggggagcagcccccaagaggagtcccagctcacctggacaggttttcgtaatcggaacggctctcgagtgatggcgcattttctcgaaggaatcgacccatgtgatgaggccccaatggagctgggactgaatggaacctgaggatggggactgtttgaccttcccagctcagagcctcagcccagagccgttgccccaatgaggatggagaagcttcccccactggaataccaacccagggatcaatgtgtttctgccgtgcgctccctaggctgggtagagatgaccgaggaggagctggcccctggacgcagcagtgtggcagtcaacaattgcatccgtcagctctcttaccacaaaag

SEQ ID NO: 550313 - DNA, 201 bp, Homo sapiens
atcatccagcaggtgttcgacactggcagcatctacaaccctgtaagtgcttgatatcacagaggacactctgcattctcgcttcctggagggtgcccgcaatgttgccagtgtctgtctgcagatgggctacccaactgtagcatcagtaccccattctatcatcaacgggataccacacgagcacttggccttgccgcc

SEQ ID NO: 550314 - DNA, 226 bp, Homo sapiens
tgctgctgtcagctcgccaggagaatgtgtgcaggcggcagagtgcaggtccggtggccttctcggtgctctgcctcagccggccaagcaggctgcccacggccgccattcctccttacagcctcagtggcacgtgaaggtggtcagtacaggccttggcgtgcaaccagcacaggagcctggggctggtccaggagggtcttagggaaaagctccctctcctttc

SEQ ID NO: 550315 - DNA, 903 bp, Homo sapiens
ggtgatcaataacacgagaggcgtgctgattacctggggaaaacagtgcaagttgtccctcacattactgatgctgtccagtgagtgggttatgaatcaagccaaggtgccggtggtatggtaataaggaagagccccaaatatgcgttattgagtctgggaggcaccattggagacatcgaagtgactgccgtgttgtggaggcgtttacacaatttccagttttaatggctgaaacatgagtagacatttcctgtatatagtccatcgtatagcgctatgtgcccatcacgcttcagtggctaaccgggtagaagcaaacagaatccaaaatcccagcctcaaagacatgcgtacacgcgacacttgaaggcggtttgagggccttggtctcccaggattgctggatatggtctagaccggaagtttccaagcagcccgattgcagcattggccggtagaacggacgacagactttcctatggttgtcgctcactgtcgaacccgtgagacacggtcagtatgctatccagtgactgctttctctccaacatactcgacgttccctggtggcttgttacgcagggaatcgaaacgcattcgtcgaagactactttcaacggacgcagacttgcaccgtgccgcgatcggctgaattctagcaacgtaattctgctcttctaacgtggcagacaatatggcgtgacacggtattgaacacggtttacaggaatacattattgctccagtagtcccctggtatgagcaacatgacagccaagactcaggagactagctacggccatactgtgcttcaacagccctaggaaccactcacggcctgtgccatcaacgcagaagcttgaatctgatgtacatagacctccattgaatctggagaac

SEQ ID NO: 550316 - DNA, 976 bp, Homo sapiens
tggctacatctatccagcctggtataccgtacggccagctactaatcccgctcccaaggtaccgacgctcccgtgctctcccaaattcggcaccgagcctgacccagcatcccagggccggcttgggcatagatacaagcgacccttacgactaggcggcatcaaaagggacccaaagaacgctaacgtggattgatccattttctaagaaagacttggtatgatgttgaaagcaccctgccatgttcaatataagaaatatcggaaagacgctcgtcaccagggacccaaggaaccgaaccttgcatctgatggtctcaagggtcgtgtgtttgaagtgtagtcttgctggattcgcagaatgatgaacgttgcattctagaacaattcatagctgattactgaagatgttccagggtatacaaactgcctgactaacttccatggcatggatcttacccgtgacaaaatgtgttccatggtcaaagaaactggcagacaatgattgaagctcacgttgatcgtcaagactacccgactggttacttgctttcgtcatagttcatgtgatctgcgttactactacgaaactgcaacaatcagatactggaagacctcttatgcatcagcatccaacaggtccgaccaaatcctggatagaacgatgatggacaatcatgagcccgagaggtgtcagacaatatgacttgcaaagaagtggtccaccacattgattccagacagcattggaatatagacatagaaaaggcttgtccaatctatttatccgtcgtccatgatgtctttcgttagaaatagtgataaatggcgatagcagcccaatgtttgatattgggacaaagctcatggagactttatggccccccccagtagttctggaaaagccactggggacgagacaggtgccttaaggtgaacgagtctgatgcatatgaaccaccagtgccaagatctg

SEQ ID NO: 550317 - DNA, 152 bp, Homo sapiens
gagagagagagagaactagtctcgagtatctatttcttttttattcctttcttctacttttatggaaccagtattcacggggtctctttcaaccttctttggtggtattacatcaaaaggcgccgaaaaaagtaaagaaatacttgggttgc

SEQ ID NO: 550318 - DNA, 146 bp, Homo sapiens
gcagcatagagaggctagtctggaagcctgggcccatgcccccagcagcccccagcccagggggcccccaaggctgaacagcaagctcaggatcatcttggtggtggggcaggctcagctcacactcagccttggcaagtagctcc

SEQ ID NO: 550319 - DNA, 566 bp, Homo sapiens
gcaggaattggcaccaggctgaccgtgaacagggagccgcctctgcctgagggtgtcttcatttgcatactaatggtagatgcactgtgcaccactgaacctgtgtctctgctggaatgcggtatcatggaggagagagagatgtctcgatttacagaagcagatgacacaattgaggaccggcctgctaccacttgagctccaagctcctagctgaatcctgtgtggtgtataccagatgcacatacaaccgtgcgctaaggccatttacctcttctctgcctcgagcaccactgcatcccatgtatttgtcatcctggggaccaatggtgtaacttatgcagccaacagctttcctgagatcgaggatgctctgaacccacacaaataccagatgctcatggccacggtggatgtgatgtttgttagtgagggccagacactaccagatccgattgtgggcctgaatgacacaccttccttcataatggcggacatcttggatttgcataccggccagtgcattgactccacaaccttaacctggacatgtttctccggagggg

SEQ ID NO: 550320 - DNA, 144 bp, Homo sapiens
tgcgggaagagcttttccagggcgatgccttccatcagtcggatacacacatattcatcatcatgggtgcatcgggtgacctggccaagaagaagatctaccccacatatgaaggtcgttccggggtggtcttctgcccgaaaa

SEQ ID NO: 550321 - DNA, 159 bp, Homo sapiens
  misc_feature (63)..(63): n is a, c, g, or t
tgtctgtccatttgtgttttttgggttgtgtcattggatataatcttcagaaataatgcacantagcctttgacaaccatgaagcaaaaatccgttacatgtgggtttgaacttgtagactcggtcacagtatcaaataaaatctataacagaaaaaaa

SEQ ID NO: 550322 - DNA, 953 bp, Homo sapiens
  misc_feature (184)..(184): n is a, c, g, or t
ggagcgcggggagccagacgctgaccacgttcctctcctcggtctcctccgcctccagctccgcgctgcccggagccgggagcatgcgaccccaggccgccgccgctccccgcaggcggctccgcgggcctccgtgctgctcctgtggcttgcagttgcccgcgccgtcgagcgccctctgagnatccccaggggggagcaaaagggcgcacctcccgggcaggaaggcgcagttgggtgggcccctggtattatgggactttgttgtttaaccaggggggcccagcgggattttccttgtttcggaaacggggactccccttgggcccccatgtggcattcccgggttaccaccctgggtcatccccaggtgtcccgcgaacttggacttcacaacgcccgaacacacgccgcggcacttgtcctgcaagggccacgcgccttgtgaagggaagttccctggagacaccccaaattaacagcaagggggtcaccttggcatgttcactttggcctttactgcgcataggcattctggggacccattggcgcaggttgtccattttaaccacaagtatggcgttcaaataggtgcctcaacgacgttgttgctgcaggggggcctcccttccggctcaaccgatcgccgccattgccttgctcgacacgcgttgggcgatttccacaatcaaggggccgttgatgtccaggaccttctcccagtgaagctataattcaatggcaccaggaagcactgtaattgattcacacttatatcatcgacactccttctgtggagcacttgccacgcattgcggcgacttaggggcatgctcgctacgggtggcactggttcacgatacccaaggaattccccgcgggagaaccactctcgctttttgcaacaccaaagtttatatggcccttatagcggagcacaagacaaaaggtac

SEQ ID NO: 550323 - DNA, 154 bp, Homo sapiens
tctatagatcagttttatttactatcaaacacattctacaaaagaaccaagacttttttattatctttaaggaacaaaggcagcttattttccaatgtgcacaatgtcattcaatattgtcacatcactattcgtgtttcaatgggccatcact

SEQ ID NO: 550324 - DNA, 384 bp, Homo sapiens
acgacaggcgactccaaactgatcttgggctatctggaaacataaactctttatccttgaacacacctcatatatccaccctgatttcctaacacatccccactccattcatttacacacagtatgtgactctctatagaatttactattcaagtcctagtcaagaaacttcttggattgcaagtcagggccactgatcttcctgacttagaactcacagaggggcgaactatttatggtgctatttagctttttctgtatttatgttatttgcccatctctaacacataccatttgaaaataaagactatatttttatacagtcttgtgtgtcatcaattagaactagaaccaggcttaaggttatcagaggctgagaaccca

SEQ ID NO: 550325 - DNA, 180 bp, Homo sapiens
caagaggagctgtgatagtgaataggtaggtagtcagatgagagtaaaaatgtagtattatccctagattgcaaatgttccaaataagacagtgccataactacacgagagagaacaaaaaaaaaatcatataagtggggttagttcctctaatccaacaactcaagtctgtttccttgg

SEQ ID NO: 550326 - DNA, 104 bp, Homo sapiens
ctcactgttaggaatagtcctggactatcggtagtaaagggtagcgattgaggagttcaagggtaaaatcaggactagtcgagatttaacagcatattctagcg

SEQ ID NO: 550327 - DNA, 213 bp, Homo sapiens
caccgttcgaccggtggcaaaggctacgcccacggcgacacgttcggccgcatcggccagttgttcagcaggttcatggacgacgccagcgcgcactacgtggagaacctggccgacgccatcgaggatcccgagcgccagcttgatgtgtcgttcgaactgccggcgcgccttaaatgacctccctccttcaattcatcgccggcggcctgg

SEQ ID NO: 550328 - DNA, 211 bp, Homo sapiens
attctaggttgttttatgttgaatgttctatatcttactagttaatttgtatattttattagtatttcggaaatagcatatctgagactgaagagaacccgacaattcacttatttgtggtttttttctcagctattctgacgcttacttacttatttgtatgttctaatggctaaacatttacattaaatgttttttttcccaaaaaaaa

SEQ ID NO: 550329 - DNA, 334 bp, Homo sapiens
agcattttcattcttcccatggcagctgattttttggggccagttttcatgttttttccataggccttgtgcagaaaggttttttcattgcatccatactgtgagaataaactgcagactgaaaaaaacatgcctgcagggtcaggaactgggcccctgttcccagaacgggttgggcctcaaaaatttattttttttttaaatgttgaaccctgaaaaaactaaaatgatatttcaaaaaagttgggtgccttttttggaaacaaggaaaacccaataattccgaggaacattgggggtttaataccaaaaataaaaattggtttttttttta

SEQ ID NO: 550330 - DNA, 1608 bp, Homo sapiens
  misc_feature (46)..(46): n is a, c, g, or t
  misc_feature (979)..(979): n is a, c, g, or t
  misc_feature (1191)..(1191): n is a, c, g, or t
ctattctgtcctgtgtggagtgggtccccaccagctcctccgtctntttttgttggagacccgccctgtgtcgtatcaaaaaaggggggtgtgttgtttgcagaccgggcgtgctacgttcgctctcccctctcgccgctcctctgtgtggctgtgctcttccacctggggatataataactctccggcggatgtttgttggtgtgggtttgttctcccatgcgtgtggtcgccctccgttgtcagaagatgggttgtctctgtggcgcgtctgtctcttgattagtgtgcgccctcttctcagctatggtgggacgaaggtttgttgtcgccgcctcaattttctctcttgggggggggcgcccatcctctgggtgctttaccaaccccagagggggtttttgtgcctctggtggaaaaggtgtgttcctccaacgcgcacacgaggtggagccaccgaccgcccctcccccccccccttgggagtagcggaggataaatgatgttggggaaaatgtagtgggtatatgtcctccccacaggatggtcctccactccttattccccccgtggagaatatgagattatggataaccccaccggctgcttcactactagagaagggggttatcccggcgggataacacaccacggccccccacggagatgataggggaccctcgtggtgagaagatagtggagaaaaatatttttgagcccacacgagaggtagtccccaccacagaagagggggtctccctctctcctacagaggctccccccccctcgtgacgactcttctcttctgtgggttttcttgagagccgcccccctatatttattaaggagcacccggtggtgtaagattgttcttctttctacatggttctcggttgtgtctcgctggtctccacgctgtcctccctctcacactttgttgtgttgtcccccccctgtgaggaagtgtgtactcgcggcnaagaccctcacagcggtccacagcacacctcacgctctccacagcgggtgtctcacacacacgggcgacaccccccacctgtgagacgacacactacagagagaagcctctgtgtgagacacacacagagagataagaggggtgtttgtatgtgtctacctctgtctctctctctccgacgaagagtgtgtctctgtgatatagcgcacacnctctgggagagagaatttgtgtgccacgcgtggttcactcgttatattctatgtgagcccacatataggagaagaggcacaccccgctgtttctcatatagagagtgagaaagggagagccccgcaaagagactgagattggagagggccgccatatttctgtgagagtggggcgcacttctcgttggaactcttccaccctcggtgcacaataactctctgccacgctcgttaagaaagtcccacagcacctctggggaccacccactcgaagctcttctcgttgtaaccccgggatttttctaagaaacccacaaataaactgggaaaaagccaccccccaagggttaccccgcctcccccctgctccctcccccgtattttataatccacgaaatataattgccttttaaaaaa

SEQ ID NO: 550331 - DNA, 502 bp, Homo sapiens
gacaaccccatagtttcgaaattttgtttctgcaatccgcagctttgggaagcactgaattacaaaacctgaaaaccctcatatatgtggcggcttaaaggccggcctaggctggagcggaggtcttgggaagcgctgggccgctcgtaaagtcaatggtgagtctcccggctttcggctttcggctttcggcggcagccgggtgtgaggttccacgggcaaagccagccagagggttgacagaaataactggataaatctgggccccctgcccctgccggctcacaagggtgcaacccacggctggagccaaaaaaaaccgcccaattgacgcccacggtttctttagcgtcttgctggaaaacaatgactttttaaagcccctgtcccggccttccaatccccactaactggggaagcccaccgggttccacccccgggagcttcgggaaacccaagggcccggcaaaagacaccttttacgagggaacaagcttccggg

SEQ ID NO: 550332 - DNA, 173 bp, Homo sapiens
cccgttttgtggaaatgacccgtgctcattatattcactttaaaaacataactttttgctttattacaacaagtatatatctctgttgttgaaacatctagaaaatacaaataagccagataacaaatccacctataatcttatcatcatagatagctattttctaagcctcg

SEQ ID NO: 550333 - DNA, 240 bp, Homo sapiens
tatggtattatcacacagtaaatagcaagttggcatcactgtagcagtcttggatcttagcatgctctatagcagaaggatgtcatttatatcaccttgtggatgtctctaagtgcagctattatttgtccaccatcattgtggtattataacacagtaaatagcaagttggatcactgtagcagacttggatccttagcatgctctatagcagaaggatgacggtaacagcaccgtacg

SEQ ID NO: 550334 - DNA, 324 bp, Homo sapiens
gtcgacctctcttaactaacaataaaaaacagcaacaatgcagctgggcacagtggcttatgcctgtaatcccagcactttgggaggcccaggcaggtggatcaactgaggtcaggagtttaagaccagcctggccaacatgtgaaaccctgtctctacgaaaaatacaaaaaattagccggatgttgtgttgcacacccgtagtcccacctactggggaggctgacgcaggagaattgcttaaacccaggaggcagagcttgcattgagctgaaatcgtaccacagcactccagcctgggcaacagagtgagactccatatcc

SEQ ID NO: 550335 - DNA, 127 bp, Homo sapiens
agataactgtgcagataagtacggcatgctgcaggagacaggctcactgggggctaggaaatggtgcaggtgcaggtccaagccccccacccaggctccagccttcaacttgggtcccactggcagt

SEQ ID NO: 550336 - DNA, 182 bp, Homo sapiens
ctgcgaagactgctccatctcaaggtgaggggcttgggcagaccctcttgctgcacatggcgggtgtatctctgctcctgtctagaaggcaccaccacagacgctcacttctggaaggtcccatcccctgcaggcttggtctccacgagctccgtgtcctgggtctggtcctctctatccct

SEQ ID NO: 550337 - DNA, 572 bp, Homo sapiens
agcggggaacaatcacttcagtgagtgaggctggagttccacttgagtccaggagttcaagactgcagtgtgctgtgatcttgccactgcactccagcctgggtgacagaaggagacctgtctctgattgcatgaatgactgaatgaatggcccatgatgctagaaaccaccaaatctgtgtgcctctcgtttaaacaaataaccgtactgttgaaatacatacacctatgtatttctctaccccaaaaacgctataaacagtagtggggatccagaaaggagaataataaataacagattaaactttttttttttaagttaaagggttacagtgaaggaactaagagggggtatggtggtggctgctgtggtggtggtttggtgtaaatttaaaaatgggggatctgggaaatttaagggtcagaggaatacaagagagagaagatggagaaatacactttatgaaatgccaggattcaggaagaagagccaaaggagatgtcagaagtagtcaaataagtatatggtcaacagggtcagatggaagtatattctacataaaagtttaaaa

SEQ ID NO: 550338 - DNA, 707 bp, Homo sapiens
  misc_feature (2)..(2): n is a, c, g, or t
  misc_feature (57)..(57): n is a, c, g, or t
  misc_feature (201)..(201): n is a, c, g, or t
  misc_feature (303)..(303): n is a, c, g, or t
  misc_feature (322)..(322): n is a, c, g, or t
  misc_feature (341)..(341): n is a, c, g, or t
  misc_feature (375)..(376): n is a, c, g, or t
  misc_feature (382)..(382): n is a, c, g, or t
  misc_feature (387)..(387): n is a, c, g, or t
  misc_feature (390)..(390): n is a, c, g, or t
  misc_feature (416)..(417): n is a, c, g, or t
  misc_feature (425)..(426): n is a, c, g, or t
  misc_feature (437)..(437): n is a, c, g, or t
  misc_feature (459)..(459): n is a, c, g, or t
  misc_feature (495)..(495): n is a, c, g, or t
  misc_feature (502)..(502): n is a, c, g, or t
  misc_feature (510)..(510): n is a, c, g, or t
  misc_feature (514)..(514): n is a, c, g, or t
  misc_feature (535)..(535): n is a, c, g, or t
  misc_feature (549)..(549): n is a, c, g, or t
  misc_feature (551)..(551): n is a, c, g, or t
  misc_feature (556)..(556): n is a, c, g, or t
  misc_feature (582)..(582): n is a, c, g, or t
  misc_feature (587)..(587): n is a, c, g, or t
  misc_feature (592)..(592): n is a, c, g, or t
  misc_feature (594)..(594): n is a, c, g, or t
  misc_feature (599)..(599): n is a, c, g, or t
  misc_feature (601)..(603): n is a, c, g, or t
  misc_feature (607)..(607): n is a, c, g, or t
  misc_feature (611)..(612): n is a, c, g, or t
  misc_feature (615)..(615): n is a, c, g, or t
  misc_feature (617)..(617): n is a, c, g, or t
  misc_feature (623)..(623): n is a, c, g, or t
  misc_feature (642)..(642): n is a, c, g, or t
  misc_feature (645)..(645): n is a, c, g, or t
  misc_feature (657)..(657): n is a, c, g, or t
cngccccgaaccccccctgaaaaaatcggcccagcgctgttgcccccggagcggacntttctgcagctattctgagaacaacttgacgtaggctgagggagagggacagggtcagtggcgaaggaggcaggccccgcgcggggatttcggaagccctgcggtgcataatgaagtttcagtaaaaggaggacaatctttttnagtatcggaaaaaggaaggagaaaagattcggaagaaatattcggaaagggttccgtgattgtagagaaggctccaaaagcaagggatgcctgatttagganaagaggaagtaaatagtgncttatgaatttattgttgncaagttttattttttaatacggaagagaatttanntgaganttgangangaattatttttttttgtaaaaaaaannattcctcnnaaaagtgttanaatgggccaactgtatgagganaataatgaggaagattattttttgtatgtggcttanagtgatnagagtgtntatnggaaataagtggttgcgaaancagtagatgggagnantgganttggggcgtaggcgcgcaggcgcgtntgctntgccncnaaatncnnnaaanagcnntgncntcccancgccaagcagcacagcaanctnaagcacatctanaaaacattacaccaaacacaccgctcatcacattttcacatgctcaattc

SEQ ID NO: 550339 - DNA, 312 bp, Homo sapiens
  misc_feature (249)..(249): n is a, c, g, or t
  misc_feature (277)..(277): n is a, c, g, or t
  misc_feature (307)..(307): n is a, c, g, or t
ggcacgagaacacatacaaagacaagacagacagaagggcttccaaatcagatccctaaccaagaactccaagagtatcccttccaaactatcctcctgttctctgtctgagaaatctccccaaaatcttcctgattgagaagtctcccaaaccaagactcttcctactaattagagagagccaaccgagaatctcaaatgaaccaaactgagaaagatgcccctcagtgggcttacagaccgacaccncaccatggggcaacagaaaaaccaagancccctccccaaaggaattcaaaaccaatcnggaaa

SEQ ID NO: 550340 - DNA, 163 bp, Homo sapiens
tcatagttggatacatttttttctcacttatatgattagtatcagtgggctttcgtattggcagtttgtcttgggtcatgactgtagttctgtgcaaacaccactctttacatgcaaacaacctatgaatagatattttccccaaatgcaaggaaaattaatc

SEQ ID NO: 550341 - DNA, 378 bp, Homo sapiens
ctactaaattcgcgcccgcgtcgaccggcgttggccggtaatctgctggtgcaatcggcggacccgacgtcgttgatccatatcgtgctcaagggcggcaccttgccggtgacccacaccgcacattcgaacttcaccacgccggcgtctgcctggcgattgtcggaccaggaagtggcggacgtggtcggtttcattcgcggcagttggggtaatcagggcggcgcagtacaggccaccgatgtggcggcgttgcgcaaggaggatatgccggccaaaccgtaggctggcgcctgccagacggtgctaggcagattcgcctgactccattactgtatataaatacagtaatggagcctttccaatgttcgtcgacgc

SEQ ID NO: 550342 - DNA, 862 bp, Homo sapiens
  misc_feature (184)..(184): n is a, c, g, or t
agcgggtggaacgaggaacggacggcgatggcgacggtcgcagcaatatccatggtgctggtgcggcggctgtggcggcggcagcggtggtgactgacgatgtagacgcagccagcagccgacgcaggagctgccaggccatgggacagcccaggtggacagccaagatacgaaagagcggcgnatagtgggcgaagaatcgatccactgtgggaccggcgaaagtcctggttcccttgctggagaaggcgctggtagtaactcactgggaaggcatacgatgcgagggagggggatccatggtactccgatgcagccttcccgcatgagactgcgagtcagagcagatggcaccacacatctgtatcaacgactggagagtagtacgtgagctgccctccaagggaaggggactggatgcgaacgtgcccagggactttatcggtagcctgccgtacccagttacgccgtgacttgaggcagattaaaccataggtacacgcttaggctaatggctcctacgacgccagtcggacccaaggcccatcgtccatgtatgaaacgccaaaaggaaccaatacgatgccattgccgcaaacagtccaggaaagggctcgagaactggtagccccaagataggaacctgcgtgccgtatgtcccggtccaacaggtgaagttagtgggccaagagtcatgcaacacgtggttcacacgttccagcccaagtgaccggaaatgcgtagtggggccgtagataatgggcgccatcagcgtcgggcgagtcgggccaccctggggtggtcagacgccccagggatacgacgacctcggggattccggcgacagggacagtcaaaaagg

SEQ ID NO: 550343 - DNA, 159 bp, Homo sapiens
cagcccgtcctataggcgctaggtgggcagactataggagggactggttaggagtcagcattgctttccctgtcacctggagcccatgtttgggccgcacagctttcctactaaaaacgtcatcatcttccttctttttgaaaattcagcatttgcttg

SEQ ID NO: 550344 - DNA, 429 bp, Homo sapiens
cgagaacaacacgctccagttacaacagctcagttacaacagctacgtggacgactatggacaccaaggcccgcctggccgatctcgaaagtcgtgcgaaagcgctgaacgttccggtcggcagcgacccggatgatgagcttgagcggcaaatcgcatcgggatactcaagcctccgaggcactgtcgagcgcgccatacgcgaggtttttttgaacaataccgtccagccgttcagcgatgtggtgagcgtagaagcatttggtgctgtcattggccaccccgcagaggagtgggagcagttgctggcagtgtatgcgcgggcctgcgaagctaccgaggcccacgacaccccaggcgagcgccaactaccgctttccgcgcgtgaggagttgctcggcgatatcgcccaggtcctggaattaatca

SEQ ID NO: 550345 - DNA, 743 bp, Homo sapiens
accagcgtcaccgacggactatgagggccctgggagcccaggggcttcggatccccctacctccgatagacgttgatcgagtcacggaggctgtggtatgaccgcgaatctggtgcaagttgcccagtagcccatgattagcagtgtggacctcacgtactcgcggaccgagattgtggtactaagaatacagcactgagggttacgccgatatgacccttaggtgaagagtcctcgcaggggggatgtaacctcgtgtgaacgacagcgggcagatccgccctcgcaagaagaccgcacatgaaatcggggcccgacagggcgccccgcgcactgccgaacaaaagcgccgggcggcacggaggacatcgcaacccagagtaagacgaagcggacagcagacccgcgcggggtagaggcgcacaacaacagagagggagcactagagctggaacaaaggtacccgatcaactagggtcgcatgtgcaaggaacaacgacacgagacacaagaaaccgaccaccaagcaaaggacaggaggcagacgacacccagtgagcgaaagacaggcagaaaacatgctcatgggcaatcaggagacacaacgaagcctaagggcaacgagacaggcagaccaagagtcacacaatgaccaggacggcatgctgaccagggcgcagcacaacaacacacagcaaaagggaaaagcgtgaagcacgaactggagcgaggacagagcaacg

SEQ ID NO: 550346 - DNA, 1004 bp, Homo sapiens
tcgctcgctcggctcgctgactcgccggagcgctctgtggcggtcggcggcaggtcggtcgcgagagcgggctctgtggaagggggcgaggctatgtcgcggtggcagccctggatgggccggcaggcgccgggagtaacgggacgtcgccgcggagcttcttccccctggtaatcagtgcggccctgagctggagtgcctgatggctgccgccctcccgatcttgaagagccctgcgcttgcgccggagccttgccccccgggcttgcgcaactgggcacgcgaggccaggtagcggagcagcgccagccgagacccgggcccgggcggcggggtggatctaaccccagccaagggagggcaaataacttaaggccccctcttggaggccagggggaagctcctttccccccaaaaagacatgaacgctttatgggagaacgtcgagctttgaagggcgaatcaacttcacaagcttgacttgtgggagaaccgggagattgcccacaattcatttgcgccggattgagaagctactccttggtaaggatgggcacgggatgactgacaaacaaactgtggtcaagcaaggttcctgccacgggagggggccaggcccccactgttgctgaaagggcaatttctccaccgcaagaacttcagagactgtaggccgcaggcaaggacttcgagcaaaagatcccaatggtgggtgcagggaaggagggcgcccctcagtgaagatgttgccgccggaagaaccctttttttatccttgatttgccccgcccagagtgaggtccttcagggctgtataataacttaggccaccagccccggagccattgagtttcagccgggggagcccagccctatgttgtgctgtgtaattcacccaccatgggggtgtttaatgactgggggggggggcgtctggttgtttaacccaccgtgtgtcccgcgggcagagaactgtccggtgggatcaacggtgtttatcccag

SEQ ID NO: 550347 - DNA, 343 bp, Homo sapiens
gagtattaatatcatcattatagaagtaactcttaaatgagttgagtgtaaatcaaaacatcatcaaattgcttaagcagtgaagaaacatggaagctcatgcactgcctctctgtgattgtatctcattcactaaatgatcctcccaccaactgtaagaactgctgggcaattttcatatgatcccttgaacccatttcctggccaaaggctgcattgaccactcctttgagaatatactcctgaggagtagtaggttccagatccttaattaagttatacgcttcttgtacatcatcttgacgaaggtagtaaatcaccaagtttagcctagcttcaggaa

SEQ ID NO: 550348 - DNA, 154 bp, Homo sapiens
tttggtgggaaaatgtccccccccttttttcctagttttatgttttttgggaaaaaatccctttgtattttctgtccagggcttcaaattttttgcccgatttttaaaacatggcaataaatggctggtgggttttggccccctgggcccccca

SEQ ID NO: 550349 - DNA, 166 bp, Homo sapiens
tctgtctcatcttatcatgtgaatgagtgcgtatcactgtactgcaacttgaactccctggcccagcgatctcctgcttcagcctcctgagtagctgggattagaggtgctgccaccacgcttgtgaatttttctttctttctttctcttttttttttttgggaat

SEQ ID NO: 550350 - DNA, 847 bp, Homo sapiens
agaccggcgtgtatgcgagcattctttgtcgggaacacctgcgatacaccgacgtctgctaaaatgggtgatgcatctgtcatgcatgaagtaggaccttgtcggaagatcaacagtgacatcgtcttttcacttcactagtggactaaacgcatggttggaatgtgaaaacctcatcggattacacgataagggagactttggcggagtccatgggtttgatggacgcatcgtcgtcgggcagccagtcctcatataatccattcgtaactaggtatctgtctttctgcaaagtatatgctcggagggctaatggacccgatattggcaatttcacctgtcgcaaattctcattggactcaatgcattgtgcaatcggatcgaattgtaggcgtacatcagcgaaatgatgcacatgagaggaaatatagcacgcacgcatgttcatcctccgtgtagtcccgataaggggatacgcgccaaggggcatcatcatcatgtagcattgcaggacatgcctgtcctattgtctgcattttgacaaaccatttgtagggcagcacaggttctacaagtactgtaatgaccgttcgtctgcatcctcgtactactgagggacgctcgagctcattcgtctgtgcacatctgctcaagtctttattactgtcatagcccggtcacgtcaggtgagtgagaatgtcaaaagtgaaagcacagttgatcgcagaaaatgctgtaacagtatcttccgttaaatacccagcaatagtgttgcccttactatgcagttcgtaccggttactaggcttaaagtgttccttctcttaatggtaacctatttatgtct

SEQ ID NO: 550351 - DNA, 180 bp, Homo sapiens
gatgtgatcaggccccacccatgtaatcaggcaaggaggaggagtcagatgaggcagtgcaccttacacaaggaaccgaccagtgcaggtattaagaaggagaaggctggagaaggacattagatcagggcctaccactgggattcacagcctcacccctgcactgtggacctcatcctt

SEQ ID NO: 550352 - DNA, 868 bp, Homo sapiens
ggtcacattccccctttagtaggcaccttcgagttttgggagatctgttgaacgtgcaacggggacgaaggaagccaaggaacgcattcctgtgttctcatcttcaagtcttaaatttgtcctttctcatgatcaagcgtataggcacaactcatggcatcttgtgctacaggccctccctctactgttcctgtcctgattatagggtcccttttcttacacacctcccagagagatgagggactgtcacactgctgctgagtgacctggtgctgctgggcgtctgttctttaccgaaaccatccatccctagaagagcacagagccctgaggggctgggctggactgggctgagcccctggtcttcctcaacagttcacagaggtctttcagctaagtttaatcgcacaggaaagaggcatcaaagctatgaatgtgaatataacttttgtggaccaatactaagcaataaggaagaagtcccagttggtagaggaaagtgcgttctcccagcactgctctcctgttttctccctctcatgtaccctccagggaaaatgactttattgcctaatttctgccttttcccccctcacacatgcactttttgggcctttttttatagactggaaaaaaccaacataccaccctacaaacctgtactgttaaaatacgatacacgaaatgaccacgtgaaaatttgcctctgtccaaacatttcatccgtgtgtatcgtgtatgtgatgtgaagtgtagtgaagctcgccagttcatctttgtatatgggtttagttgtctcattttggtctgcttatggtcccctccctcgtgggcattgtgctcgggatcaaacctttctggcccgtta

SEQ ID NO: 550353 - DNA, 431 bp, Homo sapiens
gtgtatttgtgtgtatctttatgtgcggagtgcatgtgaatgcagaaccttgcagaagccagagatgtgagatccctctgggtggagctgcaggcaggtgtgaaccacacaacatgcatgctggactctggaaacgcagtacaggctctttctgctggaccatctcttcaggccccatgtaatgtttttaaattcctgatctatgactctagaaccggctcatgaacaaaggggaagggggcaatacaaagactgtctatgtatgtggtagagagcaagactttcagaaagccaagaagaacaagtggaaaaataaactttgaggaaatgaattcaaacagatcattaattgcaataaatattaataaattaaattcacatactgtaagactactagatctaatttaaaggtcgacgcggccgcgaattta

SEQ ID NO: 550354 - DNA, 1580 bp, Homo sapiens
atgaccctgatggagctgcctatcaaggtgactgagctggcagcggacttagacctacgactcgggtatccatttcggtgcgctgaacaccgtgcgtgccctccgatcagcaggcaacgtgtgcatccattggcatcgccacggattgcaggcctgctgtgtgcgcctagttactacggctctacagcagatagaccatcctacttaactacccaagggtgtgtgccccccaagctcgaagtgtagaccttgggagtaccactagtgtccacacattagctctagtggccaacacgggctgcttggaggccatcgtagctctagtgtcgcttgtcacgagctgatgtgaccatgcatacgctttgcatagcgtgagcaccaaccatgtgttgtgaagttgcgtgcatgagccatggcaacgcgtagcaggagctgacctttggcactatgccgtgtccacaagcttagctcatatgagttcgcgccgactttagttgccatcttattctaatctaccagtggaggaatagaaccgagaagtcttgcgacgcgtactacatcgatcgccatgctccccggtagacttcgagcccatagaatgtgatctgcataacgccagcgaaaggccacccccgggttgcgtgggtgttaccacaggggtggcggacaatgcattgtggtgtgcacagcccagggcttggtgcgacacaggcatagccgaagatgcgattcgcggtcgtggacgtgggtccccattggaattagtgtagcttccggagcacctcgaagagccatcgagtttggagcccgtgccttgagtcgggataggccggttcatcccaacttgacgcagagaaagtatacccaatagaccagtgaaggcccgtttggaaatcaaacactgggtcccccaggcggtagtaacacccagacctaattctatttcgcgttgacaaaacatagagtcgttcgttccccccaaagcgaacccagggggaaggggaggcttagcatgcaggcacaagagtccatattccaaaggatccggagaggttggcgaattcagcacttagtcggtccctcgcgcgttccaggacaaattggccttccacagagagatcccccacgcatggctaggactagttccggcggtacgcgtctggatgcctaatttcgccgcaacttcagcccgagtcaggcgttgagcatctaaatacgattgggctccaccttggctagcccaaagcggaaagggggaccggccaacaaggggaaatccggccacctgtacttgcgtggacccgttgtgaaccggatcgtcgtggacattgccacctaaaacgaagttgtgtatggccccccatgtgcgctgtgagtcaacaggcatatcgacaatgcccgcgcgatcgtgttttacacatgtggtcccagcttcataccgagctcggaatcgcttggacgcttgtgagagagtataccgctgtggtgcacttaaccaggcgcgagcgcaagtgcaggagctgaacaaacggctagacgacactactactgtggcacagaatgtggtggatgagccccca

SEQ ID NO: 550355 - DNA, 137 bp, Homo sapiens
ggcgacattaacttactgacctggcctgggctgctctgggacatggaggaaggcagtgaaggtggaggaaatgctcgtgtgcggaaccatgcaaagtgaggtggagggagtaaagaatataatgacccagaatgtgg

SEQ ID NO: 550356 - DNA, 219 bp, Homo sapiens
tcgactctagagatcccggagtagtcagatgtgtaactctcacatgtatttcttaataacctgacggcatgtcttatggcctttctctggcttaagtgcaaaacatgacataatattcattgatagtacatctcctctaagcagagtgtcaatccttggcttcctggctacaccagaagaagaatttcttgagccaccaataactgatagctatcatta

SEQ ID NO: 550357 - DNA, 467 bp, Homo sapiens
atatgggagactggtttcagtattatttatagttgcacttgattaccgttctctgaggcactggagccttcatacacctcaccctgccttggcaagcctatttttgtgacctggcagcacagatttaacactattcgttaaaagcactttttttttaatgcgtttaatcccttataaagaatgccaattaagttttattacctgtcatcaatttatcctagtatctcagtgttcattcttcttgccttcatatttttttcaaagaaacagctgtgctaatgtctttggtttcccgatgagtgtacactactgtataatttatgtttaccatatgagtcttgaaacactacagatattttgaatatcagtcatgatggcaatttctgtataaaagagccttaaatggaacattgttttgagatcaaactccctaccctcacaaaagtggccacgttgcaataaaaatt

SEQ ID NO: 550358 - DNA, 417 bp, Homo sapiens
  misc_feature (414)..(414): n is a, c, g, or t
ctaatggttagcgcccacctgtgaagagtcgggggtcggggagggggtctcgctaagaaggaggtttgcagaccatggcaaagactggagctagagattcgctggccttgaagaagcaagctgtcatgttgcgaactgcctatggagaaaactaaatggcagggaactgcagacggcttctagaacttgagcgcagcctgcagctgacaaccagtaagaagccagggccctcagtcacacaaccacaaggaaatgaattctgccaacaacctgagaggtggcctccagatgagaagacagcctgacttaaaccttgatagcagttttgtgagaccctgagcaaagaaaacagataaactgtgcgtagactcctggtctacagaaactgtgagataataaatgtgtcttaagatncta

SEQ ID NO: 550359 - DNA, 1362 bp, Homo sapiens
ggcatgtcaggaaatccctacagaagagaggccacatccatatgacatgggctcagacagtgagccagcacagatgtagagaccataaactggtcatgagggggttcacacagctggaaagtccactgcatatgtcatgacgtgtgggacaaccttccaagggcgaatcctgaccgttatacagcagtccaagtagtccacactggggaggcttccgttgagtgtagtgatgattgtgggacaaaccttcagccagaactcagttcttaacaaaccgacatcgactctcatatgagtgacgacacgcttaccagtgcagcgaatgtgggaaagccttccgagggcactcagcctttctcggcatcagagtcaccacagcagtgagaggcctaataatgtgtacctgactgtggcacagccttcagccagacctcgagccttcaacaagcaccaagaagtacacacactgacgctgacgaagcccctactgacgtgcaatgcaaagtagggacaggctaacaaggcaggacgcacacaaacgtccaaccaactactcacacggaatccaaccagcgcgacgacaacgaaagagcagcagcgcagcaggcgcggaaccaggcacaacagagcagacagccctccacaaccctacaatccacaccacaccacagcgacatcaccaaagtgacagacgcaaccccccagcgaaccagagggcgcacacacgacccgcacaacaacccactcaacacacgacggacacaccacatgcacagcacgaccaccccacgacagagcctccccccaccccaggacacgacaagaaagcaccacaccgaagcctggtaccacgcaaccgcacagcaaaccgacgctaacaacgagcacggcataccaacccacacaacaacacaccaccaaaagatgataccccaccggcgaccaaagacgcgccaaagacagacgccagcccactggcagagaaacacacaacaaaccaccacccccacaccaacaacaacacgaaaccagccccccactccaaccgagccaaacgcgcaccaccctcgcgcacgcgacggcgacacacgccagcgacgagcacagcgagcacaagacagcgccaaccaacccaccgcgcacaccgacaacaccacagcacagacgagcagaccacacaagcaccccaccagcccagcgcacacaaggcgaactcaacccaccaggtcaccacaccgtccacggagaaagacaaaaaatgaagaagagacagacagcgaacacccagccgcacagaccgacaaaccacacaacacaccaccggccagagccaccagctacgcacacacaccgagcgccgcg

SEQ ID NO: 550360 - DNA, 236 bp, Homo sapiens
cggtaccagccttacccttactgggatctccgaacttgactgacagaggaggctgcagtttgctgtgtatgagccttattatagagatggtgcagccctggcaggctcggggctcgcacctgtaatcccagtacttccggagaccaaggcaggtgatcacgaggtcaggagttcaagaccagcctggccaacagagtgaaaccccttctctactaaaatacaaaaaaaattagccg

SEQ ID NO: 550361 - DNA, 241 bp, Homo sapiens
ccccccgggtttacccctttagcttccgggttgttttttggggggaattgtggggggatacccatttccccccgggaaccggtttggcctggtttgggattttattcgcccccccttaggggatttggcccccggggcccaaaatttgggccgggggccattaaaaccctggggtttgtttgggcccccccgggggggggccttttgggggggccccttttttaacctttttttttcccca

SEQ ID NO: 550362 - DNA, 219 bp, Homo sapiens
  misc_feature (170)..(170): n is a, c, g, or t
  misc_feature (194)..(194): n is a, c, g, or t
  misc_feature (216)..(216): n is a, c, g, or t
agaaacgctgtttcttccctccaatattctataacataataatgtttcacatttctacagaactgtcttttcagcatgttttcgcattatgcttaatttcgtaagagtttctcagccccacataacgacacagttcaatgcaaaatcagatataaatctagcttaagggnctctcaacaggggttttcactttnaaactgtaaaatgtttaaaggntct

SEQ ID NO: 550363 - DNA, 304 bp, Homo sapiens
tgtggtcgtctctagcaggatcccctcacacgcctcttacagaactgtgcttggggaaactccatttgttgactgccactgaaggctattttgctacactgctgctccaggttttttgtttggaccatctatcacagtggggcacagctgtttattggatgagccgaatcgaccgatatgcttgtggcccccagagtgttttacggtctttcacgttgtatctaatggacctgctgaaccgtttaatgtcttctcaggatgccaagttggagcttaaatgtgacatcaaaccagttgcgaatag

SEQ ID NO: 550364 - DNA, 164 bp, Homo sapiens
atgcagttacaggatacaacagttcataagaactgagtatctatgcgcacaaattgcttaatacagtcaccttaagagaacatgcacagatcttggtggacaaaactgtatctacactgaaactactacgggactccatcaatgagtccaactttccaactccc

SEQ ID NO: 550365 - DNA, 1476 bp, Homo sapiens
gatggcgtgatgtctcacagaaatgttctccgtctcccagacatgggtccctcggcttcctgacctcggaagcgcagcagcaggtatcgtgggaaggtgaatagcttacccataaggatgacctctgtccaagtcgctgtgtccacctctacagactcttccctgggatacaaggctggcatgactcgacatcgtgctgggaagtcggactaggccggtggatccaaaggtgaacaaggaaggaggtgtgttggagtgctgtgaccattgtagagataccaaccaatggtggatgctggagcatttgtgggacatacgtgtgaaacatccctcgtcgagaggccatccgaggaccgtgttcgaagcacttggtcattgtgcgtagtagccaacaatcaacgttgaatgcaaatgcaaacgtagggcgttttcttatcatgatattggccatacaatcataagaacgataggcgcttttaacactagagttaactggccaatgaacgtggtcagggactgcatgtgaatagcgctatatgcaacgctaggcctagtgaggtaacgcgatctttgcatgccacgacattgacatgcacaggtatcgtgccgaagatcatcgcgtggtcagtgtgcacagcaacccatgattgcgacctgtttacctctgaggtcccaagaaagtaaagggtaccactcttgaaactggagagatcactagggtttgaaacagagaatgtggcgacctggtgagcaccgcatgagatgcttgggagcgtaggagacccccggccgaagacagggcttttgtaagccattgccagcgcttacccctggatgaatagctcacaagtgtgtagtaggtgcgccaggcattcgccgaacttgagtccgcgacaccggtgcattccagcgcggttaacccttagatggggggcacaaggtggtaacataaaggggggatcagccctaagggatccagtttaggggcacacaaggcatactgagaatgcttagtctcgcccacgaagaaaacccaccacccgtagggggccccttggcagcactactggatgggggtcataggtaattcggggcgggccatggcccaggttcactagagatcaagttgtagctccttgtcttccattggcttgcgaatagccggacatggtgtcccagagaacacagggcacttaaacaccacggttcgcaaaccgggctagcctctcgtatgaagtccacgacagcggcagagaaatctcaatacatcgcaattttgtgccccagaggttcttcacctttaatactacaagggacgcgagcataagcattgcatctcaatcgtatcaccaaatttgcctcttccacgcatagccgattttatcccctacatattgtgccaaggtgatccattcatagccagcctcctttgagtaggcatctgtggtccagatataggtaattagacattgtaca

SEQ ID NO: 550366 - DNA, 229 bp, Homo sapiens
gacaaatatctggtacactaaacccccacaacatgcaatttacccatgtaacaaactcgtatatgtaccccatgaacctaaaaataaaagtgggaaagaaaaaaaagtaaaaaactttggaggatgattaaaaaaaaaaagagaaaaggggtggaatcaaagaacacaagcttttctactattgggctcagggctctttcggaaatcaaaaccacctccttatactctg

SEQ ID NO: 550367 - DNA, 832 bp, Homo sapiens
  misc_feature (214)..(214): n is a, c, g, or t
aggttgcctcccgctctcagatggcacagggacctatcagatggcaggatttaatctggggagcaaattgccagactcatgcaaatggagttctcacaccgtatctagggacagaggcatctggatgcagaacgtcgtggcgttagtggtagtgcggcggaatcccgagggtggtgtgggggatgctccgttccgggcatgttggctgtctggntcctggtccttgacttcatgattttctgcctgttcttgagctctggccacgttttgtcgtggtaacgttgagcttcgtctccgaggttgtcgcggtccggtaccgttggttgcctgctcatttcagagggaccccggggactgccggatgagggtccagggtgccacctccgttggtccaggtcttgcccggttgtccctgtgcattgagtcttatacctggttggcacaaaagtccatgcagcttgtactacggtaatgacgactaccgcgtgatcacgtgccccatccatttcactagttccttcgccctaagaggacattggtcaaggatttgccacatcgctcgcggggaagtgaccagaaaggtcagcaaatttactggaactccagagcaaaccatacttacgcaggtggtcggtgtagacccatgtggcagtggtctaggcccaattcagggaccaggtccaacgaagccctggggagtccccccgggccgtcccctgaagaggttcccaggggggaggcttacactggccatttaggcttgtgagggtttacgctgtcgaaggttgtgactgtcacgaaagggcaggtcttccaggttgccgaaaaaagg

SEQ ID NO: 550368 - DNA, 286 bp, Homo sapiens
accttgtacctaccccttacttagtgcactaacttataacaaagcccatcttgcctacaacaaacgagacgctcaaatagctcattgcactactccttcaatcagccacatgccctcgctactaacagccattctcatccaaaccccctgaagctacaccggcgcagttcgttcttcataatcgcccaccggctatcgtcctctttactattctgcctggcgcactcgaactacgaacgctctctacagtcgcatcataatcctctctctaggaggctcaccgtct

SEQ ID NO: 550369 - DNA, 629 bp, Homo sapiens
caggctgatgcgcacccgctttggcattaatgctgcagcaagcatggttaagactgaagggaacacgattccttgcgggagtaagatagcaaggctacaaatgaagacctggcggctcatgccaggtcagggtaggcctcacactgaacgcttaacagaattcactgggttctaccggccatccaggtgtttttttctcgagcagctaaacaagcactggtcgccgtagtacaacatgttaaagcaaaatcccagcttgtcctgatccagatgctgactcagtgacccctgctccaccggcgctaactgcagctttgactgacgagaggctgatttcacaacttcctcctgatggcagaccctgaccacggactgctgctggctgttctagagaggctgggcactctgcagcattcacagctcctcctggaacctgctgaggacgcgtgctccgcacaagctcctgccctacccttcctcctctgaggtgcttccgggcctgtcaggctggccagcctgcaggctgcaaccctataaggataaggaatagtctcctttctaaatgtgcagatcttatgattcaccaattgagcacccgaggttaaaaccacacagtgtccttattacaa

SEQ ID NO: 550370 - DNA, 264 bp, Homo sapiens
cctgcgtacctgcttcacacgtcatctattttctgtcgaatatactcacttacccaccttattggctagtctggggcttctccaatcttacactcaactgaaaacagatctgcttataatacaccaatgatagaactagttatatataatctcagattctgccttgtcaagtacccgacggaacatttcttttaactgagcagactctatcttccagccgtcttttctctatcttctgcatcaatcaacttctgtatggtcatc

SEQ ID NO: 550371 - DNA, 353 bp, Homo sapiens
ggtcgacctagtccatgttctaggctctgggggtagaatggtgaacaagacagaaaaaaatggagctggccgggcgcggtggctcacacccgtaatcctagcactttgggaggccgaggtgggtggatcacttgaggtcaggagttcgagaccagcctggccaacatggcgaaaccccgactctactaaaagtacagaaattggctgggcatggcggcaggccctgtaatcccacctactcaggaggctgaggcaggataatctcttgaacccaggaggtggaggttgttgcagtgagccaataccacaccactgcattccagcctggatgacagagcgagactctgtctcaa

SEQ ID NO: 550372 - DNA, 282 bp, Homo sapiens
tgggtcgttctgtgagtggttcttcggtgggtgagtgagccccattgtgttgtggtgaatatgtatagggagcatagggctgtgactagtatgttgagtcctgttagtacgagagcgatatttgatcaggacaacgtggttactatcacatagagttctgccagcaggttaatatgtggggggtaacgcgaggttagcgaggcttgctagaagtcatcatgaggctattagtgggagcagagtttgaagtccttgatagaagattatgatgctactgtgagt

SEQ ID NO: 550373 - DNA, 402 bp, Homo sapiens
tatctgcagctggcttgctgtgtctccgtcacacagaggtttctcttttctattgcattgtcaggctgcgctcgtcctgagctttttagctctgcttcccatttatgctttggcttcgatcctgtgcatctctttgtgagtcccttcgtgtgactggttttacggtcagccaggttacttcttgaacaatcttgctggtttagaaatttcttctgctagagtaccctatttcatctctctcacgtactatatatctcgtagggcaggggcaaaatgctaccagtctctttgtaaagcatagcaagagccaactttattccagttcccaacaaattcctcatctccatctgagaccacctcagcctggacttcatttaccattatcactatcagcattttggt

SEQ ID NO: 550374 - DNA, 215 bp, Homo sapiens
tgactagcaggatccgtgggaatcctcctgctgctgtcagtggtcttctgaccccacagttgtagaaagagaaaagtgtgtgagagggtgcacatgtgtctgtgtgtgtctgcatgcatgtggctgggcatccatgtgtgcctgtgtgtgtatatgtagtctatttagtgtgactgtgtgtacatgtagtgcatacttatgcatgtagtgtacat

SEQ ID NO: 550375 - DNA, 431 bp, Homo sapiens
gtcactagtttatgtatttactatactttttactgttatttttgagtatactccttccaccaattaaaaaaagttaactgtaaaagagcctcacacaggtcctttaggaggtattctagaaggcattgttacagtaagatgacagctctctgtgtttattgtccctaaagaccttccagtgggacaaaaatgtagaggcagaagacagtgatattgatcttgaccctgtgtatgggcaggttaatgtgtgtatttgtatctttgtttttaactaaaaagtttaaaaaaagccccccccaaaatagaaaaaagcttataggttataaataaaatatttttatacagctgtattatgtattttatgctgttattacaaaagagtaaaaatttaaaaaattaaaaagtttataaagtaaaagtttacagttatt

SEQ ID NO: 550376 - DNA, 1231 bp, Homo sapiens
  misc_feature (292)..(292): n is a, c, g, or t
  misc_feature (1231)..(1231): n is a, c, g, or t
gccgagtcccggaggccagatgagcggacgcagccccacgcgcggggccttgcaggtggccgtgaacggtaaggcccggaaagaggcggtgctagactgctggctaaggaacttcctcaagttcagtggtaactcggagtcgctctctctttccagtgctgtggctgagtgcactggaaccgcacttctccaggctggcgttcagctgaacttcagaggatacctgcagtaacatggaactattaagcccgagagcaggtacttcatgaccaggaactcctcgaccactcantcagcgtattcgcgtgtagggggcctaggtacggttcctggcaagtggcattcagctcgtcactcagggtgccacgagcacggagcacgtcgcctgttctccgggtgaaaccgtcgggtctcgccggcaggcctatggtggggctgtccgagtcaaggtcggtgtggaggacctatggttggtgggatctggagcacctggtgtgaccgtgacctgagtctggctgagacggcgtcagttgtctaagtgcccatacctcaggtcggcgtggagcagctagcgtgtgtgcacgtggagcggaccattcttcggatccgagagctggccatccatctgcagcgaaatatcaacgagaactttgggcccaacacagagatgcatctagtccccattcttgccacagcatccaggaggagctggagaaggggactcctgagccaggggctctcaatgctgtgggtgagcggcacaattcggtgctcatgtcctgctctgtgcccatctgggggctgagcccaggcactcgtgggattggagctttgcctggagaaacccaggcctgcggcgtggggtggggccaatgatagagggtcacccttgggcgccctggggtggcagaactggtccaggtggtcttttgtgtcccccttgtggcgcctgttttgagaaccctgggtaggccccgttgtccttggctgcgcaaacactccctgtgtggctgtggtgtcgcctctgtcacacacagggtgggggtcttcagctgcgcaggcagcccccttgtgttgttaccaccgttgggtgctgtcctgtctactcagccgagccccgcgtggggcgcatcgaactgcttgtttcgggctagttctagtctctgcgggctggcactctgtcgctgcgtcgtttcactgagtccagttgaggtcttcctactagtgtggn

SEQ ID NO: 550377 - DNA, 101 bp, Homo sapiens
aggttgactagaggatccccaaaactcccgtgctgaagtagtgggatcgcgcctgtgactagccactgcactccagcctgggcaacatagctgagacccct

SEQ ID NO: 550378 - DNA, 449 bp, Homo sapiens
tctcgtctatgggtagaagtggtacacaaaaggatgcccagcaagccccatcaacaccttgaacagctacagacctcacccatggagtctcatgtagtcctcacaggagccaagtcccagctgagggacctgcctgaagtccacatagccgtgcttccccaagaaaaagagcaaccagtgtgacctgccctctgtggcctgcgcagctactgcgctatgccgtcttggaaatggagctttggctggagtgtctcttgctctgggagtgcatagctatgacactccatcactaaggctaagctaccgttgaaccacccgaacccagtggcccgacatccccaagccgagctgccagcaactgttccactcttccccatgggcccaggtgaaggtagagtcacttaatctacctttcaccctccccttcaggccagtgctgaagcagtacc

SEQ ID NO: 550379 - DNA, 101 bp, Homo sapiens
tacgagcttcagtggaggagaccgcaagttgagtggaggaggcggcggtggggccccggaccagtgtgcctccatggcaggctctgaagagctggggctcc

SEQ ID NO: 550380 - DNA, 580 bp, Homo sapiens
ctaaaacaatgtggcctctgctcgcttgtccagcttcctttcctcccagactccattcctgctctaacttcacaagaattccctccttcccccaaaatgacagattcttccagcctcaaggcctttggcatgcttaccctcttgccaggaactcaccccttttcctagttcactcttgtggttctctgagtttctgcttcgttgtacccctcaaggagccttaggagtttagctcgcggtaggaactccgcgctccaagagcccccacaccagatcaaaactggatcatccccaccccatacacacaccctcttaggactggtggcactcactcaaggcctgaccgccaaggccctgctcaggaccttatacactcagcagcaccaacatgggtcattagtggcttcatgtaatgactgttcgggaccagcctggactttgacaacctcaaggtcccaggcctcgcttttcctttgcggcccggttttcttgggggcctcacactgatttctggacttacactaagaggggttagccttttcccgggacccgtgttggagttttcgcgttcaaacggatc

SEQ ID NO: 550381 - DNA, 288 bp, Homo sapiens
aacggatcccctactgtacgatgggcgtaaactacagcggacaacttgcacggcgctgtcgtacttacagcggtcactatcactatacacgttggaggcggtcacaactctctcggtacctccaaattatagagatataatggtccgtcatatctggtataaggggcattttaaaagcaattatatggtcctcccctattttaagacgtgaatgtctcagcgaggtgtaaagtatgtacgccggcgttgcaaggtgagtgtgtcggtgtgctatgaaagcagcaaaga

SEQ ID NO: 550382 - DNA, 535 bp, Homo sapiens
  misc_feature (21)..(21): n is a, c, g, or t
  misc_feature (168)..(168): n is a, c, g, or t
  misc_feature (425)..(425): n is a, c, g, or t
  misc_feature (468)..(468): n is a, c, g, or t
  misc_feature (529)..(529): n is a, c, g, or t
ggggactgaacacagtcaggntcttctaaacactggcagggacctcccccacagccacccccacagggttctctgtttcccaagtcctgatggattcaggcaagaccttcacacattcacccactacctgctggagaggagggtcatgaggcagcctgtggtgcccanctcagtgtgacacactgccaatgtgccgcctcccccagcctctgatggggccgggccttgaccacgtgacaggctcaagctgccgtgcacatcccccaggaaaggggaagagctgctaaggtgtagaagtgaaaaaaaaaataagaaatgataatgtggaggttaaaaagatgattatttggtttttaaaaaaataaaaaaaaaaagaaagaaagagggaaaagggtgattgaaggtgggggaggagagggaatatnatatgtaaagtgattttaaagaaaaaggaaaataatagtatanaatggaaaaaaaatgtaaataagaaaggtaaggataagggtggagatggaatgaaattacnaaaaaa

SEQ ID NO: 550383 - DNA, 768 bp, Homo sapiens
aatatttatgatttaagtcaaggtagacctaaaatatcaaaaccaaagtgtattactgtaaagagaattctgtagcaaattgaattagtatatagtatgtatttttgtatgtgtgacttcatctttgtggtagatgtattgaatttagttactagttttcagagcattctcttagttttgtcaaatacattaaatctctaaatgtttttcttctttcctaaaacgtgatctatctacttggacttttcatgaagaccctataaggcagctatagaagttagagtatctgctctattggattgtctagcagaagttcgcgtttgcactgtacatctgctgcgtgcaaatctcgcgtcggtatattactactaattctatttaatattccgcttatatattactgtgtaggaaatgaatttattaattaaattaggatgtttgtaatctgttcatgagctactgagagacttataagtagtcgataatatgggcagtcatcttaaagtatatcattgattccataagaaatcatctccaaatgcaaagagttttcagtacttatgtcagtatcctagaggaggtgacgtataactctacggacaagctcggaagtatgttacaatgtactgtgaattctgtctataaagatatttataacttgtctttaagtaaattgtaattacaggccaggcatgagccaccatgcctcgccctttttcacgttacttgatagtgtcctctgataccccacgagcgctcatctctgac

SEQ ID NO: 550384 - DNA, 1365 bp, Homo sapiens
agcgggttggagcgcctgcgcagcttttccgcacgcgcctcgccggacgcgcggctctctcagcgtcccaagagccacatttctcgccagtacgatgcgtgcagcaggttttccggtatattccgcattcccattcagtcgtcagcatcccgatactcagttttatagccacgtgcttgccggatttattactatccgttcatcccttcatgcattcgtgatgcctggcgacacaacagaacggcatgacaacacgcggactgattagaccgacctacacttcctatccgggaacggaccctatctgtgccggacggacgttcgcggacacgctgatgatccaacgacacgcaggtggacgcccaatcagacgcggggatgaacgcttgactgcatggccaggatgccacggcggtcgctccgaaggcaagctcagcacccgacgagccgcggatacaacacaggcaactgcgtgggaactggcactggatagccgggaatacccaatcagccgcagacacagggctggcgatccaagagaccagagccaggacccacgaacacgacactacatccacgggccgccccatacgctaccagacttaccccccagcagcaaccaccggccgtggcctatgggccaagcgcgggcacatgaacttcggatggggacccccccaacaaaacaccaccaggacataaccaggcctggctccgtgcagccactgacaactccacgccttaccacttcaccccccatttcgcagacacactctcaccgcctcctccctcgcaaccccctccaccccgcagacctcactggccgtctccaacccaccagcggaccccagccgacaccagcggccccccttggaacccccacaacgactccccctgggaataaccccgggtgcggcacagaaaccacaaccatagcacctcgtccactccttaccagacgcacatacaaccattcttgggccagccggccccactaaacacaccctatggcacgcccacacttgtgaccacacccggcaccagaactggcaccacccgcgcgagacacagtcccaagcaatattgccggcacaacacccccaccacgccacccctggccaacacaccaccagcgcccccaaccgatgcgccacacaccacactccgcggcgatagcaaccacccccagcacacgacacaccgccacgcgcccgcacccaacgcaacaccccgccccacgcccaccaaccatccaccctaccgcgcacaacaaccgagcctaccacagaacgcaccaaccgccgcaacccgaacgagcccgacaccaaacatacgcagcccaacactcaccccagccgacctgcc

SEQ ID NO: 550385 - DNA, 324 bp, Homo sapiens
cacagtatatctgcatgcatgtgtgtctctctggctctccatgtatagaaatacccgcgcctctatctgcactcagtgtgcaccaactgagccgatcgtgtgacctgccgcccgctccggcaccaatgacctgtgccccagaacccctttcatctatcacaccaacttctgctctccagaagtaaccagttctgaccgtgaacaccagacagtactagtagaatgggtatttactagcgttgctgatacatctgtggcctcacacggtatttactcctgtgttactggctccattctcgtcgccatttcgtcagtggcaggttt

SEQ ID NO: 550386 - DNA, 611 bp, Homo sapiens
  misc_feature (593)..(593): n is a, c, g, or t
gttaggaaccactatgggagaccgatggccttgggaagcccgagaattggtgcctactgatccagttcctgacataattccagtccagaagacttctgggtcttgaaaacctctattactgaacaatactgcatagctagggaatgaaaagacttcaccatccctgtaggaaggctcaattgtctaggacagaggtctaggacagaggctgtataacggcacaacagggacagtcacctggtggggtctaaaccatactgaaaagtatgtaaatttccttcattacattccttcagtaaatttcctaaattacagattgcttggcccatccacaatctcatcgagactggacggctcctactggactatactggatatgtaggcacagagtctacactcagttacctgatcaatggccaggtagttgtgtcattggcaccagtaagccatccgttttcctactgcccgttagaacaggtgagcctcttaggtttccctgtctatgtctcccgagaaaagaggagcatagctataggaaattgggaaaggtggatgagtggcccccccccggaaagggatccacacagtactantaggccctgcccacatgg

SEQ ID NO: 550387 - DNA, 1003 bp, Homo sapiens
  misc_feature (1003)..(1003): n is a, c, g, or t
gttacaacgttgctaaagaagagaggggacgaactttaatggactgtgaatttcacaaaaaaaaaaacagacctgtcaacttgaccttttacagaattgctttacaaaaaaacacacaacccccgggtgtggtcccacaacccaccctgtccaccttatccactctggggtcattcaacacagggaaacatcaagctcaattatgtcacttttgtgtgtgcgaccacaatatttctggcacaaacactcctggcatcaaaacctgtctgaccttttcacgggcgacaattgtggaacacaaccaattcgaccaaacaccgtcgtaccaagaatgctaacaggactcactctgtctcgattctccaccagatgtttcataaacaagcgagtcacccgtgagtgcctcatacatagaatcccactcttcaatacgccagtgagttatcaacattatgctacgtgagagtctcaactctttgctcaagtgagggtcgtccgccaacaaaccaacatcacatatatactaccaagtggtgtggtgttacctcactataaaagatagaacaggtcattgagacgaaccacataacaccatcctgcaggcgagcacatacttactactaagagcaacaacagctgtgtgtgagatatactcaacgaatatgaacagacaacaaccaacatcatgtcttgatgtcctactcctgcgaacaaacgacaaacacgatgtcacacaatcacgactcgtgatgactgatccccagtcggagacagacaatcctactcctcaccgatcatgaggagcacagccgacactaccgatacaacgatcgcatatttaaagcaacaacacgaggagggcacaaccgctcctcacacagagacagcaactctcgagatgcggagctactcaccatgacccacacttattatacacacaatgacatggggtgacttgaccacgcacacacaataaatatatctcattaggacgagtggaacn

SEQ ID NO: 550388 - DNA, 449 bp, Homo sapiens
cacccaggcgcacttctgctgttcctgccaccgctgctgctgctgcttgacgtccccacggctgcggcgcaggcatcccctctgcaagcgttagacttctttgggcatgggccaccacttgactacaacacaggccatctatacctgcgggggcccctgaagaagtcccatgcaccgcttgtccatgtgaccctctactattaagcactgtgcggtggctgccaagccttcctgatccgggagctcttcccaacatggcttttggtccttcagatcctcaatgtcacgctagtgccctacggaaacgcacaggaaacaaaatgtccgtggcaggtgggagttcaagtgccatcatggagaacaggagtgcaaattccacaaggtgaagacctgcgtgttggataaactttacatggagctagccttcctgaccattgtctgcatcgaaa

SEQ ID NO: 550389 - DNA, 675 bp, Homo sapiens
ggcatttaagatgattttctttgcaggatgctgtccacagaaatatcagtcttacatgccggtgtccggtttcataaacaagccaaagcccatgaaacctctcacgctctcgcttgcacgggtggacaggggcactcggtgcaggggctttccggtgctagccaaaggaattcattcggcacgaaggaaactatttgtacagaggtgagtggtgtccttggaaaccgggtggaatcgtagtgttctcaccgctggttcctgtgtgagccagcactttggcaagcttctcccagcgagtgctttccaattagctattcatcctttgtaaccaaaggggatcccatgtttcacgacgttccgtgggattctcgaggggcatagcgtggaggtgtggctggtggctgcagggatccagtgcttgtccattactttctggactggaatagattgggcgtactttagggaattggccagtttgccagggggcccttccacttaaaggaattgcccaattctccacatggccccttttgtcccgttcaggaagccttattttaacttgaaccccttggggtcctggggcattttaggcagagatcgctccctttaaacccaaagaagatagggcccaaactcggtttgccatctattctctcgttctagggcaaaaattgg

SEQ ID NO: 550390 - DNA, 116 bp, Homo sapiens
  misc_feature (70)..(70): n is a, c, g, or t
gcatctaaagtgatgtttggatgtaagtgaaatattagttggcggatgaagcagatagtgacggagaagnttgagctaatatgacgtgaagggggtccagtggaagcctgtgctac

SEQ ID NO: 550391 - DNA, 419 bp, Homo sapiens
  misc_feature (8)..(8): n is a, c, g, or t
  misc_feature (19)..(19): n is a, c, g, or t
  misc_feature (25)..(25): n is a, c, g, or t
  misc_feature (41)..(41): n is a, c, g, or t
  misc_feature (46)..(46): n is a, c, g, or t
  misc_feature (56)..(56): n is a, c, g, or t
  misc_feature (61)..(61): n is a, c, g, or t
  misc_feature (78)..(78): n is a, c, g, or t
  misc_feature (80)..(80): n is a, c, g, or t
  misc_feature (87)..(87): n is a, c, g, or t
  misc_feature (90)..(90): n is a, c, g, or t
  misc_feature (105)..(105): n is a, c, g, or t
  misc_feature (109)..(109): n is a, c, g, or t
  misc_feature (111)..(111): n is a, c, g, or t
  misc_feature (127)..(127): n is a, c, g, or t
  misc_feature (143)..(143): n is a, c, g, or t
  misc_feature (151)..(151): n is a, c, g, or t
  misc_feature (159)..(159): n is a, c, g, or t
  misc_feature (167)..(167): n is a, c, g, or t
  misc_feature (175)..(175): n is a, c, g, or t
  misc_feature (190)..(190): n is a, c, g, or t
  misc_feature (204)..(204): n is a, c, g, or t
  misc_feature (217)..(217): n is a, c, g, or t
  misc_feature (237)..(237): n is a, c, g, or t
  misc_feature (248)..(248): n is a, c, g, or t
  misc_feature (257)..(257): n is a, c, g, or t
  misc_feature (264)..(264): n is a, c, g, or t
  misc_feature (303)..(303): n is a, c, g, or t
  misc_feature (320)..(320): n is a, c, g, or t
  misc_feature (343)..(343): n is a, c, g, or t
  misc_feature (348)..(348): n is a, c, g, or t
  misc_feature (389)..(389): n is a, c, g, or t
  misc_feature (417)..(417): n is a, c, g, or t
aagaagcngagggctcttnggagcngcaaggggccaagtgncaaanaggatgggcntgagntgggaaagggtggcatngnggaccanctngcattctcctgtggnaagncnagtgcctttgctcctntgtcctgcctctactncaaccccnactacctntgggaacnacagctcnaaaaggggaagaggnagctgggccaaacngaggtaacagccnctccaagtcctgccctgccnccctcggcctntgtcctggnagccccncccctttcctcctgtacataatgtaactggcttgttggnaattttaatttatcttnactcagcacaaagggcccccganactcnactcctgctgcccctgagctgagaagagtcattattggagngttttgtttttaaaacatttctttttcngt

SEQ ID NO: 550392 - DNA, 129 bp, Homo sapiens
gtggtgtactacttggcttgggctctggtgatgaccctggaatctctgcgagcagttctggattgtgggcggatgtcatggagaggactctggtacttgctgcttccttcagtgcgaagggcctctgcc

SEQ ID NO: 550393 - DNA, 295 bp, Homo sapiens
tgctcgtgatagtgagtgagttctcccaagattgatggtttacagggggctcttccccttaccctcctcactctctcgcacctgccgccatgatctgtttcctgaggcctccccagccatgtggaactgagtcaattcaacctcttttctttataaactgcccaatcttgagcagttctttataacagtgtgacaacagactaatacacccacctactcgggaggctgaggcaggaggattgcttgagcccagcagtttgagactgcagtgagccatgatcatgccactgcactc

SEQ ID NO: 550394 - DNA, 175 bp, Homo sapiens
aaggacagcacgcttgatctgtcacgaacacatttagcacacatagcagcaccatagagccctgactgacatgtatactctgttaatggaccaatctcataagaactttaggtcttacagcacgaacccctacgaagtctgcctgggaacacaccaaatgcagatttaaggtgct

SEQ ID NO: 550395 - DNA, 100 bp, Homo sapiens
tgctaagtgtctggtagtggaattaaaccagattggacataaaaatcacctctggacaaaggcaaagaatggggactttcactttttgctatcatatgtt

SEQ ID NO: 550396 - DNA, 339 bp, Homo sapiens
  misc_feature (279)..(279): n is a, c, g, or t
  misc_feature (322)..(322): n is a, c, g, or t
tgaacttcgcgcccctggagcgggagatgcctgtgcagttccaggtggtggagctgccgagcggccaccacctgtgcaaagtcagagctctgaataaaggggatgccaactctgaagtcactgtgtactaccagtcaggtacgaggagtctgagagaatatactcttatggagctgcttgtgatgcacatggaagagccctgctttgacttccttcgcaccaagcagacccttgggtaccatgtctacccaacctgtaggaacacatctggaattctanggattttctgtaactgttgggactcaggcaaccaaatacaacntccggaaacttgtttga

SEQ ID NO: 550397 - DNA, 110 bp, Homo sapiens
acgacaacactcacactcttcacgacaacggtacgacgccgacgggggactcctcgacgacgtcgacccggcacgggactgcaacgctgtggcacctgggccggtcgttt

SEQ ID NO: 550398 - DNA, 442 bp, Homo sapiens
atgtgggcgacctagaggaccctacctaaatggctgtccatattccctatgaccttaccacaagatgtccagagcatattcagcagtccgttgcagctgagcctaatttttgctggctcatccttgtgcctttgacagtaaggttaattgatagacccaccatctcttgcactcttgcttcgggagcacgttgcattaactatttcgagtctctatattgtccaagaaaagtagaactaataaatttactttccctttttctgtcaccttatgtcctctaccattttctccttcctcccttcccttattttctccttttcgtaccctgcgtcctccctgatttacctttcgtttcttctttatataatcccattctctgttacttgactcagtgctcccttcctctcctctccttctagtggatgcatacagccatttaggt

SEQ ID NO: 550399 - DNA, 508 bp, Homo sapiens
tgagagtccagttcagagttctggagtacgtgtagcagcacaccggctaattgtttgttggtatttgaagtagagacaggttgcatcaggtgggccaggctggtctggaactccggacctcgggtgatccacccatttgggcctctcaggtgcggggattacgggcgtcagccatggtgcccgacccctaaaaatttggctttttaaaacagtgatttttcacagaagtgttaaagatagtgctatgggacaaaactataacttctactcgggaagaggtgacttcccaaagtagggtgatggagggggagtagataaggcgttaggtagaagtagaggttaagggaggtgtgatggtgggttatgatggtggggagatagatgaggctatggtttttggtgaatccttcgataatggcccattggggcaaaaaagcgggttagggggggcaggcctcctagggaagaggagggtggatggaatcaaggggtgtaagtcatgtcagct

SEQ ID NO: 550400 - DNA, 423 bp, Homo sapiens
  misc_feature (318)..(318): n is a, c, g, or t
  misc_feature (396)..(396): n is a, c, g, or t
aaatttcatgtcgaattgtaatttccacagttcccacctttcatgggagaaacccagtgggaggtgatgaattatgggggcaggtctttcctgcactgttctcgtgatagtgaataaatctcatgagatcagatggttttaaaaaatgagtgtttccctgcacaagttctcactttgccagctgccatccatggtaagatgtgacttgctcctccttgccttccaccatgattgtgaggcctccccagccatgtgaaactgtatgtccattaaacctaattttcttcgagtctcgtagatgtctttgtcagcactatnaaaaatgggacttaattacaggagggctgtttgttcttactttaacttcgtttcaggaaaaatggcagcttttggatnaaaattttggaactaaaattgggagat

SEQ ID NO: 550401 - DNA, 332 bp, Homo sapiens
gccattctggagaatgaagactggaagagatgcctcgggtttcatgtcccactgcattgccatcttgaagatttgtcacactctgacagagaagcttgttgacatgacattggctctggggcaagatgaagacttcagccagtgtcagctacatcattgtggtggccaagcggatcagccccagggtggatgatgttgtgaagtcgatgtacctccgttggacccaaactcctggacgcagggacgattgccctgctcctgtctgtcagtacctggtgctggtgacaaggaatgcctgccatttatcgggaggcctggactggatttaccag

SEQ ID NO: 550402 - DNA, 1164 bp, Homo sapiens
  misc_feature (621)..(621): n is a, c, g, or t
agcggaaggcagcggatccacgggctggcacaggtaaggagagtagatcccctacccgcgttcgtcgtccctcgcgccgctatcgtgggcgctaagcgggagcaagttggtgacggcggtgtcgacctggggtggcgctgtgcgtgctggcacacgtgtggaggcggcgttagggggagacgcatggcgtctctcctggttggcggtcccgtggggacatctcgcgcgcagatggccctggttgggcgtcgaatggcactggtgtcaggtgggtgcacggagcgatgagcccgtcgtcaccggagagtgcgtggagagcttcttcgtggttactccggtaaggagactcctcgtaagctgcgtgcaggcggactaggctggccaggacggataggacgagatagacgtgaagtcagggaattggccgggacctacgcgacaccttgtaccagtcctgacccccaatgtggtacccagctgttagtcctttcgaggagacgctactcgccaagtgggccattgatgcgttcttggcaatgggacactagtcgggagttgggagcaatcgcgtatctgttaaaaaactcggttagcattaactagcatttacttcacgtacanttttccacagcgaggatggacgccacaatatgatagaacacgagagttatttagtagcatacacgcgtgttggcatcgacaaacagttcgtcgagaaagcaggaatattgcggggaacggcctccgaaagggcgcatttggttcgaggtaccttggctgacagccaattatcctgtggccgccggcactccttagtttggcgataccaaagggttggttccaagccggtttggctaccaaaaatttttgctatgccactacataacaggtacttggggaacgcgaaagcctggaaggaacgcgttggttgaaattcgagggtggtccccaatactaggacgaatgtgcttgggcaattggaggatttccggggacatgtgaggggcaccaaggaaaggaaaagggaaccagggggttcgaatagtggccacaaaaggttttaacttgtatgggccttgtggggcatcctttggtaaccttttttgaattctgggtaaacaaaaaaaggcaaggttttttatagaaaggaaaccgaacgcatta

SEQ ID NO: 550403 - DNA, 196 bp, Homo sapiens
agaaagggaagggaaggaacaatcaagtagtccatcagacatcaccaggtcccacagttaggacaatcaactcttgtgcacctgatttttcccactccttacgcctgtcattaccgtgtgagatgcccccattatccctctaataaatgcccttttttcatatagttagtatgacgcggtgtttctagctcctact

SEQ ID NO: 550404 - DNA, 167 bp, Homo sapiens
cctggcgacctggatgtctccgaatgttaagaggggcacagatagtccacaactattgttcacaggatcacatacatcacaatattatacagtccttttagaccatatggatcagagccaccaacgatgatataacttataccattcagaagcacacactcctagca

SEQ ID NO: 550405 - DNA, 101 bp, Homo sapiens
gcaggcggtagagcagctggcgataggttcatcgttttcgcggggccgtgcatgaaattccagaggatgtgatcgccctggatgtcgacgatcactagcag

SEQ ID NO: 550406 - DNA, 212 bp, Homo sapiens
ctcctgcccatgttgggctccttcatgttcagagtaacggtcccaagcagtgctgttgtccctgtgtgcccgggtacgtggtccagattctctttattcatcttctgtagccaagttggacagtgtgattcacatgagcggtttatggaactaagagtatgtgttaccagtctccccaggggaaacggcttggttcctgtatgccggagatg

SEQ ID NO: 550407 - DNA, 401 bp, Homo sapiens
  misc_feature (11)..(11): n is a, c, g, or t
  misc_feature (107)..(107): n is a, c, g, or t
gggaacttggnagttcagggggcttccacccatttcccagaactgatcaaagtaagcttactatatctaaactgtaaaacaatatagtttctcctgaacacctgctnttccttctgggagtctggaattttggtatgtgccaggcagagactacctttgtgaccagctcccagtaaaaaccccaggcactcagtctctaacaagcttttctggttgacagtgtttcacaagtgctgttacaactggttgctgggagaattaagctcatcctctgtgattccactggcggaggattcttggaagcttgcacttagtttcccctgacttcaccccatgtgtcttttttcctttgctgattttgttttgtatcctttcactgtaataaatcatggccgtgagca

SEQ ID NO: 550408 - DNA, 363 bp, Homo sapiens
  misc_feature (255)..(255): n is a, c, g, or t
tgactcccattttgaagggagtctccatgtggtccgagtgaggtgagacgcccttcgtcctggtgctcctgatcatcttgatagggtcttctggaactcctgtccccttagtcatgagatcagaaagtccaatatttcctttcacctgtgcaggggaggggggatttatttctgaaaggaaaatatagagacagatcctctacagtcatacttttaatcttctgatgaagacactgtccgatattcccttgcctnatgagctcttgcagcagtcgccgtttccactactttaagagaaactacaggtcttgataaagaacgagactgattcattaaaagctttagtcaacttgaaaaaaaaaa

SEQ ID NO: 550409 - DNA, 292 bp, Homo sapiens
ctgctagaaggaaggcagtgactaggctagtgccacacccggactcgcggagaactagtaggctcccgtcaggtccgtttgtataaactgatcgaaggggagggcaaccggcgagggtgaattctagtattcctcatcatacgtggaagtacatttggcttgaggacgggccaaggaaagtgtcattcttgatgccggaagactctgttgaggaccaggaaagccagcatactcgcagagactcctccccagtgctccataatatcatcctcctctttcgaggggactctca

SEQ ID NO: 550410 - DNA, 394 bp, Homo sapiens
cagttccatggccaggtgtaaagagaaattataaaatgaagatgtaatctgtaatactactaccttcacgccacaagataacagtttctatattccctgccggatcgttggcccacaaatacttaaaaattatatttatttaatacatttatttttatgtttatttaattttactgtgttttgaaattgaatttgtcagtaagggacacagcattactctaaatattaacaatttctagtggtggaattttaggtctccacaaaaagtctgagaaagacatttggggaatggggagatcttttcagaattttctgtcaaactaatacaaggccagtgtccacatatagctaatcttttatgatttaaatcataggatcttcagttgtagaaggg

SEQ ID NO: 550411 - DNA, 150 bp, Homo sapiens
catggttatgagccagctgagggctaagacgatggtccctaccctcagcattctgcatgaagtcatggagctctgcgcattcacctgcgtcattgacttcgcattacgcatagttttaatatagtgcttcgcgttgttgtccacttgttg

SEQ ID NO: 550412 - DNA, 150 bp, Homo sapiens
gttctcctctttgcaggatagtctcgaatcctcaactcacccctatcacggaaatctcgatcatagccatgctctcgatttcttgcgtctgctccatctatcatcccgatatctatccaaaggtgggagaggtgggaggggcggtaaagg

SEQ ID NO: 550413 - DNA, 399 bp, Homo sapiens
  misc_feature (35)..(35): n is a, c, g, or t
atacgaactgagttcggtaccgtctcatcttctgnaatcccgagggaggtgtgacatcatcatcatctctggccggaaagaagagtgtgaggctgccagggtagatctctgggatggcagttggttccgtgtcatccattgaacgttgaggtgacctttgaccttcacacgttacgttattgggcagaaaggaagtgggatccgcaagatgatggatgagtttgaggtgaacatacatgtcccggcacctgagctgcagtctgacatcatagccatcacgggcctcgctgcaaatttggaccgggccaaggctggactgctggagcgtgtgaaggagccacaggccgagcaggaggaccgggctttaaggagttttaagctgagtgtcactgtagaccc

SEQ ID NO: 550414 - DNA, 119 bp, Homo sapiens
gatcacatcgagtctgtggaggaaccccggaggccacattatcatatgaaagaggcgaggcgacatgcgagtgctggagaggaaggccggacgccacatttcaatggaagaggcaggga

SEQ ID NO: 550415 - DNA, 396 bp, Homo sapiens
ccattgcagtttaataaattctgatactattgatacaataccattgcaatttaataaactatattgagttaggctggatcaataaggctgtataaaaaggagcaaggccggcgccgggtgcagcagctcacgcctgtaatcccagcactttgggaggccgaggcgggtggatcactaggtcaagagttcgagaccagcctgaccaacatactgaaaccctgtctctactaaaaatacaaaaattagctgggtgtagtggcgcgcgtctgtaatcccagctacttgggaggctggggcaggagaatcacttgaacctgggaggcagaggttgcagtgagccgagatcgcaccactgcgttccagcttgggtgacggggcgagactccgtctccaaaa

SEQ ID NO: 550416 - DNA, 333 bp, Homo sapiens
accggacggctttttgcccaatatggccattatcgaagaattcacaaaaaaacaatagcctcatccatcccaccatcatagccacgagtggacctccattaacctctacttctacctagcgcctaatctactccacctcaatcacactactccccatatctaacaacgtaaaaataaaatgacagtttgaacatacaaaacccaccgcattcctactactcaacttaaactccagcgggacgaccctactactatctcgcacctgaaacaagctaacatgactaacacccttaattccatccaccctcctcatcctaggaggcctggcccccg

SEQ ID NO: 550417 - DNA, 868 bp, Homo sapiens
atcatccttcaaaaaaaatgcaaaccaagatttcactttctaccctgagtgcgattgcaactccaagaattatagagcttgcccacccaaggatcaagttagagggtctgtgctatgaaagacaaagaagtgaactgcccatccgtcctgtacctcctgctgccatgatagctaaacctagcccccgaacaatagctctagcgaagtccaagtctgttcatcaagattatctacctgaccgtgatgcccattggccagtatcttatgctactactcattccaaagcatcacctaggattcaggaactagctaatccaaataagagaggggtaataccacatagcagttttgaacttgagtttggaatcagatagaacctgaagttgtctctgtcatggattatttaccaggtatgtgatcttaaacaaatttcctaactccctgtgctgcagtttctttatgtagaaaatgggttcctgcagcattcttgtaaagattagatgataaaatgtatatataaagtatatatttgaaacaaaaatttttatttagaaatttagcttgtggctaggcacagtggctcatgcctgtaatcctagcactttggaggccgaggcagatggatcacgaggtcaggggttcaagaccagctgaccaacatggtgaaacccgtctctattaaaaatacaaaatagctggggggtggtccacctgtaccccgttatcaggaggtgggcggggatccatgaccgggggaggggctgagccggatggcctgtccccggggagagaccggaaaaaaaaaaattgggggccggaataaatggggggaaaaggacgaggcaggtcaacgggcaaagtatagacg

SEQ ID NO: 550418 - DNA, 435 bp, Homo sapiens
atcttgaggtagtgaatgggtctcatgagatctgatggttttaaaaatgggagtttccctgcacagtttctctcttttgcctgctgccattcatgtaagacgtgacttgctcctccttgccttctgccatgattgtgaggcttcccctgccatgtggagttgtaactacaattaaacctcttctgtaaattgcccagtcttaggtatgtctttatcagtagtgaaaatggactaatataccatatacaaaaattaatgcaaaacgaatcaaagacctaaatgtaagaggtagtatgttataaacatactagaagaaaacttgggactaaacaatagtttcttagatatgacaccaaaagcataaatgaccaaaggaaaaataggtaaattgggtttcatcagaattaaagacttttgtgctaaaaatgataccct

SEQ ID NO: 550419 - DNA, 157 bp, Homo sapiens
  misc_feature (15)..(15): n is a, c, g, or t
aatagatggggttgntatcagagcagtagctatagaagtaagtgatcagtgagcctgaagacaacaatagaaaatatcctaaatgaaaaataaaaagtaaaaatacttgatacaaagtgaacctgagggacgaagatggctgatgggagaagactgg

SEQ ID NO: 550420 - DNA, 1328 bp, Homo sapiens
  misc_feature (886)..(886): n is a, c, g, or t
  misc_feature (995)..(995): n is a, c, g, or t
  misc_feature (1041)..(1041): n is a, c, g, or t
cgcactgtggtcgatgaaatgccatgtcaacacgtactgtggaacaacgtgtccgctgcaggtggaagacttctacttagtagtgatggtcgattgaatggcacagttcgctcgaatgctattggagatcgaaatgtcgcgaggcaatggaccagttcaccactcatggtaggagaatcaaattcaggctagtgatgccaggacttggacgagtgccgcatagacaaagatgtagtaggttgaccgtgacatctgagagtaatatgtgcgcatgggggcatgagctctatacaacagcattcggggaagtgaacacaacgtaactttatatgacagatggaataggctttactgaagaaattcctgtggctctcaggaaagtagttgcaaggctgtgacccgaaaaaactcagtctagtgagcatcagttctaaaagggacatagagttgtgatgagtgcttattgcaacaagaacgaagtacaccgaggaaacgattaacaagaagccattgtcgcccacggtagtcttcttgaattactgaccgtaactgtttgtatatttaactggacgcaacaccactgttcgtcattatggatagtcaaccgctacccccaggggcatgccatagctgcatatggccgtgaaaggaactcgtaagacccagaagtttgtctggaacacgtcggcacacttggaggtgcccatcatgcaggcttgtgggagacggatgaagtttcacagcacaaccaacctgtttcctccctgttgttgcacgttgccctcttacatggacaaggtgttaaacacagtcctaccctggtggttgccacgcagtcgggacacatgcgctctaattcaattaaactagggttcattcaccatgntcccgaaaccccggtaactacatctcaaaaacggggggctattcatttggacattctcgaacgctgacgagggatgcccaagcacggcggtaaacctgggttaataggngcaatgcggaggaaaacaagccagctagggggcatggggcagacanaaccgtgagcatggccttgtcccgtgcacggccattactaaacatggaacaggctcacatacatcagagctcgggcagcagcgggctcaaaaacgcaaggagaccgccgactacataaaacggagaccaacagcacgcgagagaaagagataaagccagcggaacggcgcagcacatagagggtcaacaaagcgacacaaaggacaaaacaagaggcaagagagcggcccacgagcggaacacgacgcggcgcaccaacgcctccgcgagcacagacacaacagccg

SEQ ID NO: 550421 - DNA, 766 bp, Homo sapiens
gaactcggtggtggccactggcagaccagattcgctcgtactcgtgcgcctcgcttccgcttttcctccgcaaccatgttgacaaacccgatatggtgagatcgagaaattggataagtcgaaactgaagaagacagagaggcaagagaaaaatccaggtgccttccaaagaaaggattggaccaggagaagcaagcaggggaatcgttaatgaggcgtgggcggccaaattatgcatgtgtacatttccaacaagcatgggccttctatattaacttcttttaagctgtaaaaccttgtgtaaggatgcacaagaggtgggatcaacgttttaaatgactgtgtctgcccttttcacattcaaagaacttagtgaccaagcgaagggcggggccttggcttttcccatctgtcctatctatctggaggggcaggggacaggaaaaggacttgtgcttgtggggtgaagggaagaagttggggcttgacaaaagttgcggtgtggaaacggaccaggtgacaacattctacgagtaaagacaccaaaggtgtgacccaaaatggggtggtccccttggcagggctggctaagtggccggctttcaacatccagaagtgacccaatttctcgactcggggctcacacagtgccattcacattacgtgtggaagtgcaccacacttttttatcatgtttgccgtcttcaccgaggttttacaaaaccttccaaagcacaacgaccaaccttaacaaacacacacacgc

SEQ ID NO: 550422 - DNA, 152 bp, Homo sapiens
tatgtaagggagtcagggctgagtaggggtagtgttttcacggcggatactgcctccaatgaaagggctgtaggcattgtccgtgaaactagtagatctatgtcgagcttcagccttgcatgctagccagatcggaattatggtgaggggtc

SEQ ID NO: 550423 - DNA, 154 bp, Homo sapiens
  misc_feature (71)..(72): n is a, c, g, or t
gcttcaagcataagggagagctctggacagtttgagcagcatttttagagcctctggttacacttttcatnntttgttaactttcttcatttttacagaggattagtttaccaacggaggctttttaacctggtgaaagagagcctcttcattt

SEQ ID NO: 550424 - DNA, 572 bp, Homo sapiens
ctaagttagatcttagaggtaaatcatccccatgcttacatataactaggatatttgactccatctatccgtctataaaaaacaactgtagcaggcataagggcactataataaacagtagtagctagtatccaggaattattcctacaaattattcacttggagattctaaacggcacacgggataagttccacatcatcacaaattacatctttatcattaatctccaagcaatgcctagtagtctactcattacttttacttacgatttccactttcgcgttgtactgccttcattaagatgcaccaaccgatctacaaatgtctagttgtgcagccagcaaagaacgcataactctgacagacttatcacccttcaacaatgcttggatgaatcttactcattacgttcaagtacatctcatgggtctttggatctctctgctgaataatcttgatcttcacattccactatcacatacccgtataaataattagccagtgtagagttaaagcaggatctcgatatcaagaaggtacagaaatcttgtgccagattttcgccatctgg

SEQ ID NO: 550425 - DNA, 527 bp, Homo sapiens
  misc_feature (239)..(239): n is a, c, g, or t
  misc_feature (376)..(376): n is a, c, g, or t
ttctcctcctttccaccaagtgcccagcctcttttggaaaaaggcccaggggttccggaggaacctatttttgttttgtttggcacacaggcttggccttggaggtggggggtgagccccttacacccttgcccctccccaagggtgggaacctgccttccattgcccaaaaaaaagggaagggaacaggttcttgtccttccctgtggaattgccgagaaatttagccccttgcatgntggatttggggtggggggaggttttttttttccctggcctccagggccccccaggaggatttggggcgggtgaccagccccccagagcacacagccttttatttagtgggcaaaatttgggctggggttgtgccctnaaagatttttccccaggcaggggttttgtggaggaggccaaattcccctagttggcccttggggccccccccctgaccccccctgtgcccctcattttttttgccttttgaaaaaaaaaatgattaaacctttgggggtggggttgggtga

SEQ ID NO: 550426 - DNA, 162 bp, Homo sapiens
cctagaggacttcatttttgcgttcgcgtcacgattcagaaggttcatccagctatccagcaatttacagagcatgaaatttgcagatcaaagtccattaaatcctgtagctcttctagaagaactctacactagtcaacttatagatgcaacaacatgtat

SEQ ID NO: 550427 - DNA, 1662 bp, Homo sapiens
gaactcggtggtggccactacgcagaccagacttcgctcgtactcgtgcgcctcgcttcgcttttcctccgcaaccatgtctgatcaaagcccgatatggctgaggatcgagaaagttcgagtaagtcgaatactgatagaatgacagatgacgcaagagaaaaatccactgccttccaaagaaacgattgaacatggagaagcaaggcaggcgaactcgtaatgaggcgtgcgccgccaatatgcactgtacattccacaagcatgggcttcttattttgacttcttttagctgtataactttgtaagatgcaaagaggttggatcaagtgtaaatgactgtgctgcccctttacacatcaaagaactactgacaacgaaggccgtgcatgcttttcccatctgtctatctatctggctggcacgggaaggaaagaaactcgcatgtttggtcgaccggaagaagtggggtggaaagcaagtggggtgggaccgacagtgaactctacgagtagaacaagctggccaaggtgttctgcaggccgtaatgcagttaatcagaagtgcctgttttttgagtccacgtgactttacacttgtcgcactgcccacttcttgcaatttgcacattaagagggtttacacacccacagaaatataataacaacaacaaacggttgtgtgcccccgccaggaaaattccaaacactgtggggggggccccaggatatgacgggtagtgcaaacacgcgcacggggtggtccccaaaaagcgggcgggtacaaaaatgtgtgttatgcacgcactcgcacagcacatacaggcttcccagcagttgcgcgtgcgaggcacgtacgaaggagaggaggggagagggaaggggaagaggagagaggggagaggggggggaggagccgccagcggagacgcggccgacgggagacagagacagcgaaggaggagcgacgcaagacgaaagagacgagcgcacacagcaaccgacacgacaaagacgacaaacaaaggacgggcccagcggaagcagggagcgacaaacgaggcagggatgagaccaagacgggaggcggaacggagaacacgagcgcaggagacgaaccaagaaaagcagagagaggggagacgactggcggcagacggcagagagacaagacagagaagcgagaagcgaagagagaagcaggacagaagaaaggaaacagaagaacaagagcagcacagaggagagagagcgaaggcacgaacgagaaaagacgcgacgagaggcggaagcagaacacagacaggcaatacgacagacccacaggcagaacggacacgaaacagcacgcactgcagaaccagacaaggacaacaacagacacggacacaagaggacacacctcagcacgacgcgagccgcaccggccgaccaggcgacgacggaagacgagcgcacaagccgacagcggacgacgagcaccgcaacaggcgagagcaccaacagcagcacgcgagccacaacagcgccggggacagccaggccggaagccggacgccgcccggccggagcggcgggaagcaggcagaccggcgccacgcccagggcacgagcgcagcccgcacgagcagccgagcaacgcagcagcaccagggcgcacagc

SEQ ID NO: 550428 - DNA, 387 bp, Homo sapiens
gagacagagtccgctctgtcactcaggctagagtgcagtggcacagtctcggctcactgtaagctccgcctcctgggttcatgccattctcctgcctcagcctcctgagtagctgggactacaggcgcccgcaccacgcccagctaatttttttgtgtattttttgtagagacggggtttcaccatgttagccaggctggtcttgatctcctgacctcatgatctgcccgcctcggcctcccaaagtcttgggattacaggcatgagcaccgtgcccggccgcagttacctacttttataacatatttgtggaccagatttggcccctgaatgaaaatcaaatgattaaggaaatcaatgactattttcagcaatatggtaagtcag

SEQ ID NO: 550429 - DNA, 194 bp, Homo sapiens
taacggatttagactctgtctgacatatgcaccatgaagctttgagtgaagctctacctggggacaatgtggccttcaatgtcaagaatgtgtctgtcagggatgtactgtcgtgactagggtaagacagtgacgggactaaatgacccaccaatggacagcagctaggctatacacttgctacaggtagatat

SEQ ID NO: 550430 - DNA, 1132 bp, Homo sapiens
cacaggtgtcgtgaaaactacccctaaacagccataatgggaaaggaaaagactcatgatcaaccagttgtcaatcatatggtacacgtagattcggagcaagttccaccactactggccatctgatctatcaatgcggtggccattgacacataagaacctttgaaaaatttgagaaggaggctggctgaggatgggacaagggctccttcaagtatgcctgggtcttggataaactgaaagctgagcgatgaacgtggtatcatcgctattgatatctccttgatggaaaatttgagaccagcaagtactatgtgactatcattgatgccccaggacacagaaaactattatcaaaaacatgattacagggacatctcaaggctgactgtgctgtctctgattgtctactgcgtggatgtccgagtgaagttatgaaggctggtatctccaagaatgggcagatccgagaagcatgcccttctggcttacacactgggtgtgaaacaactaattgtacggtgttaaacaagaatggattccactgagccaacctacagccagacagagatatgaggaaatctgttacaggaagtcagcgacttacattatgaacctagtgtacaaactcgtacacagtagcatttgtgccaatctctggtctggcactgttgaccagcatgctggacgccaagtgctactagtgccttggctccacgggcattgcgtacgtctcccgtaaggattgggcattgcccgtgggagcccacgcttggttgaagggctctgggactggcgtgctagccaccaattcgttccagtggccacgccctgtggcctgcctcttccagggatgtcttcccaccttgtggcgtcgggcactgatcctgtctgaccacactggggacagggggtttccaaaacccggaatgtgtgacgaccttgggtcacaacaccgttctacccggagatacactcgtgtaactggacaaaaaccttctgtgacacactgtggacaaacacgggcgtcctgtgcacatgtctgtacgaatatgagcaacatctctgactaacaaaccacccactcagctgcttgctaggaataacactcggaaagaaccactgcattgat

SEQ ID NO: 550431 - DNA, 802 bp, Homo sapiens
ggtcacgtacgggctagtgagtgggccaagcctgaagagccacccaggccacagttcctgtgcctgccttccccatcccagcagtggccctccccatcccctccctctgttctgtcccgtttgatagaagacggctgtttacttggtgtgtggcggtggccgagctgcggcttgacgcggggctcagagacataagtgctatcaggggcccaacgtcagggagaagtgaccaaagtgtacgccagttcctctgagcttacccgctgtgctaccactggcccacgcaagacgcaggcgtctgcggcgccatggatcactcggaccacctactactccctgataacctgggcacacatatcgtcaccttcacctcccccgatcccacgctcgtggctaatcgacgacgcacgggtgcctgtatctgcatgtcaaccccatacagcgcaaacggaggagagacacacgattacacactgacatggctcttcccactccgctttatttaccctaataccctggcacgattcgactgccccacactctaacgacgcgtatgcgccagcatccatccctatggccagtggagcacccacggcaaccaagtccgcaacacaaaagacgacccacgcggccccagccgcgaagccaccacctcccaccctgcccaaacccccgaccccatcccgaccagccatagacacacgcaggaccccccagccgcacagcatggacacgcgcccatggcggagcaggcagcgtagcgcagcaggaccacaccaaccgcacgcagtcgggaagcacc

SEQ ID NO: 550432 - DNA, 185 bp, Homo sapiens
ctcgtaagcacatttgaatcatccagtgcaagttaaacagtcactggccgggtgccgtggctcacgcctgtaatcctagcattttgggaggccgaggcgggcagatcacttgaggtcaggagttccagaccaacctggccaacatggtgaaaccccatctttactacaaatgcaaaaattagctg

SEQ ID NO: 550433 - DNA, 182 bp, Homo sapiens
agcaccttgatctttgacttctaatctccagaatagtgagaaataaatttctgttgttaagccgtccactgtgggaggccgacgcaggaggattgcttgaggccaggagttcaaggccagcctggacaacatagtaagaccctatctctacccccctaataaattaatttaaaaagcccccc

SEQ ID NO: 550434 - DNA, 972 bp, Homo sapiens
  misc_feature (20)..(20): n is a, c, g, or t
  misc_feature (233)..(233): n is a, c, g, or t
  misc_feature (260)..(260): n is a, c, g, or t
  misc_feature (285)..(287): n is a, c, g, or t
  misc_feature (311)..(311): n is a, c, g, or t
  misc_feature (314)..(314): n is a, c, g, or t
  misc_feature (324)..(324): n is a, c, g, or t
  misc_feature (332)..(332): n is a, c, g, or t
  misc_feature (336)..(336): n is a, c, g, or t
  misc_feature (347)..(348): n is a, c, g, or t
  misc_feature (352)..(352): n is a, c, g, or t
  misc_feature (360)..(360): n is a, c, g, or t
  misc_feature (376)..(377): n is a, c, g, or t
  misc_feature (402)..(402): n is a, c, g, or t
  misc_feature (418)..(418): n is a, c, g, or t
  misc_feature (421)..(422): n is a, c, g, or t
  misc_feature (475)..(475): n is a, c, g, or t
  misc_feature (480)..(480): n is a, c, g, or t
  misc_feature (540)..(540): n is a, c, g, or t
  misc_feature (560)..(564): n is a, c, g, or t
  misc_feature (589)..(589): n is a, c, g, or t
  misc_feature (593)..(593): n is a, c, g, or t
  misc_feature (646)..(646): n is a, c, g, or t
  misc_feature (817)..(817): n is a, c, g, or t
  misc_feature (880)..(881): n is a, c, g, or t
  misc_feature (883)..(883): n is a, c, g, or t
  misc_feature (946)..(946): n is a, c, g, or t
atcagtgataactgtttgancattaaattttttaaacagccatgtcttggcattagttaatattgtgcatattggcctctatggcactacaagttaacagatgaaaatattgcccattttcatgcacaggtattcagctataacaccatttacaaatcattatgaacaagataaattctgccataatattcatttggatggccacaattaaatgagtgttatatcaagaaatngcctatgttcaatatactccagatgtnagattgtaaaatgtaatgttatttnnnacttaattctttattttccttatnggntctccttttntgtttttnggtnctctaatggtnncttnggggtgcnttctttggccataatnncaaaattcacacaaaagaggttgtntgcttcctcctctaanagnngccatacatttgctcataatctctctctccaggtatcatttctcatattattnatganaatgcttaccagcgccaacaccaaaattctgtcttcaagggaaggttaccaagttaaaanagagtggttcattatataannnnngacaaatcgtggcaacactattgcnaaanatgacatcggttcagcttcttagcatccacgaagtatattatttccgtgagtnttctattatgtggagattttccttaagaagtaaaatgaagtttgaatagtacagtctgtggggtggtgacatcagcaaccgccagttcttgtccatcaacaagccccaattctttcaatgttttggagagatttggccttgttcgttcttcaatagaggttaccgactgtnagttaagtgttctattttttccctctagggtggctgtgatggctggagatttcatttgcagannancactattggttagataatccaaacctcctgtagtttagctgatggagaaactgaatattttgnggagctggctaaagctgggcgttttc

SEQ ID NO: 550435 - DNA, 596 bp, Homo sapiens
  misc_feature (562)..(562): n is a, c, g, or t
  misc_feature (596)..(596): n is a, c, g, or t
tatagttttcctgaagccctaattcgttccatttaattgctataaatattcaaaggacatggaacaggatctggtaaatcaactttattaataccattctaaatatctttcatatgcttattattctgcttgatcagcaaataatgaactaatcacttccaaactgctaggtactatacattcaatgatctgagatttgtatcggcttttacattgcttgatattatacgtttgcaaataaatattcatataaatgtctataggtcttatagatctgttgtaggctacacatgaacagcaaccaaaatgaggaaagatcttctttgtccccaagctgtttccttgaatgctgcacttttcatattaacattagcccttgctatgtgattcgcctatgctctattgtaccctgtcgtaatcttaaccttcccaaatataaccatacagggtgcacctctcctagacaacacacagtgcagagtgtgcttcccatgtattcaatcttcgtctctttgaaagagaggtgccctcattacatttcactgagacacaggataccccnggatttcttgtacaatgtgtcttgctggtgtctn

SEQ ID NO: 550436 - DNA, 519 bp, Homo sapiens
aaaaccggagtgttagtaaattccacgtgtagcccattcagactggagatctgcacacttgagtgcagctacatccagactagcgcctggctgggactttcggggattccgttttgtggtcacaggactgggagaggagtgaggtcctcaccgagtgattccatcttctcttttttttgagacagggtctctgtcacccaggctgggtgcaggggcacagtcatagttcactgcagccttgaactgctgggtcacgcaatcctcctgcctcagccttccgggtagccgagactacactatgcctggctaatttttaaattttttatagtgagaccccgtctctacaaaaagtaggaaaaaaaaaatagcgaggtgttgtggtacacgcccatagtcccagttactcggaaggctcaggcaggaggattgcttgagtccgggagttcaaggctgcagtgagttattattccaccactgcactccagcctgggtgactgagcgagaccctgtctcaaaacg

SEQ ID NO: 550437 - DNA, 200 bp, Homo sapiens
ggaggaactataggggcgaagagccacgcaggtctccagtgcagatctcacagggaggtactaccactccgtagctacttcaacatgccttcccaccagagcctgacagtaaacaagtcgtcactacacttccatacctagcatcaaaaactagcccttttactaatcatataattagcctactcctcaccactacaact

SEQ ID NO: 550438 - DNA, 381 bp, Homo sapiens
cctccctctccgcattttttccttggttcaggacaggtaaaacggtttccctcccttcctgcctttatggattaccaagtcacggacagggcgcttttcttttcttggggggggggggttatttaaggtaatttttttccccctctcccttttttttttgggcccccctccctcccttttttgccatggaactggaggatgtgctatgagtttgccaacagctgggctgtcagggtgctttttttccagatgttcctcctttgcctccccttcccctcctctcccctccttttccttccttccttcctttccttggagccctgagccccctttggaagcttgagagaaacccaaatttaagagagaaagagagggggggga

SEQ ID NO: 550439 - DNA, 618 bp, Homo sapiens
  misc_feature (49)..(49): n is a, c, g, or t
  misc_feature (56)..(56): n is a, c, g, or t
  misc_feature (59)..(59): n is a, c, g, or t
  misc_feature (376)..(376): n is a, c, g, or t
atcgactcgacggcttctcattgggtacttcacttggactgcttggtangttatgnttntgctggaaatattccatccaaaatggctgccaagaaacctgccataattctgcatttgatggcacatcatacttgtgcaagatagagccagtataatgccaaattctgtatccattattaacccgtaacctgggagcacatgtagctgttaaaatatgctcaccatccgggcaccaagcaaaatatgtagaatcagaagccaccggtttagaaataagtttgtagtttttcacatcccacacttccatttgtcccctcagatttccaaatccagctaatactaatatatgtccatgagggctatagtaggctgcatnacgaggaccagttccaaagtcaaatacaggatcacattccaagttgaaaattgtcgcgtttggcaggcataaaaccatagtacagcacgatactcagtagaactagaattccaaactacatcataactggggccatttttaggtacttgcactacagcactttctccattagttgcactgtagtgtagagttagtactccatagtaggaagctcctgtcttgtcaaaatctgtgctagctat

SEQ ID NO: 550440 - DNA, 282 bp, Homo sapiens
aagggattaaatgaaatttgagggattttttcatccaaagttttgtacatcatgttttctaacggaaaaaaatgttaatatggcttttttgtattactaaaaatagctttgggattaaggaaaaataaataacttttggccagttcagtattgtttattaaatttgtattggcggtatgtataatggcctttgctggggttccaaaatacttcctttgggttataataatcttttgatccaattcctattgcttgtaaaataaagttttccccgttgatata

SEQ ID NO: 550441 - DNA, 1047 bp, Homo sapiens
  misc_feature (49)..(49): n is a, c, g, or t
  misc_feature (56)..(56): n is a, c, g, or t
  misc_feature (59)..(59): n is a, c, g, or t
atcgactcgacggcttctcattgggtacttcacttggactgcttggtangttatgnttntgctggaaatattccatccaaaatggctgccaagaaacctgccataattctgcatttgatggcacatcatacttgtgcaagatagagccagtataatgccaaattctgtatccattattaacccgtaacctgggagcacatgtagctgttaaaatatgctcaccatccgggttaataatggatacaaaatttggaattatactggctctatcttgcacaagtatgatgtgccatcaaatgcagaattatggcaggtttctcggcagccatttattggatggaatatttccagcattacaaacaataacttaccaagtcagttccaagctgaagtacccaatgaggaagctaaagttgcatacagcgttatagacccccagctttaagaaataaaccaatcaccaattccgaattgcgatgaagaggaaccacctcagaatatgaaaacacaatcaggaaacgataagccattatcaaaaacagttcttgaaaaatcaaaggaagcatgaagctaagaaagctgcaagacaggagagcaagaagtgacaagagtccagatttggcagcctatgcctgccccgatagagcaacctagaaacagtgtctctcagtcaatttctggggaccctgagatagagcaaaataatcaagaggctatagaagaaatgagagcaatcgaacgaatgacaagaactaggcagcaactgggatcttacaggtcgaaaaaaatgagctggagaaaactcaagaaggaaacagcttttatgcaggagctgtaagatttggaatggtatttaaagaattggggaaagcaagtgattgacagaaaagcaggcaacacatctgctgttaaccatgtataacaggatatcctgtgccacattaagtcactataatttagcttcaacaaaagaggggggggctcgagatctgggggcactagtccggtttggtaagcctaggtgctagaggcggtaagcgagaagtt

SEQ ID NO: 550442 - DNA, 156 bp, Homo sapiens
tcctctgcgccccgacagttcttccttctttgggggcccaccgcggctcatgtgccacttcctccactgctgctgccactgctgctgccaccacagtccacgggagtcaggcgaatggccctcagccgggggatgatgctgggggcgggcagaggg

SEQ ID NO: 550443 - DNA, 187 bp, Homo sapiens
  misc_feature (36)..(36): n is a, c, g, or t
ccgtgttgcaatggctcatttctttttattttcctngtatctcttatgatcatttctctactttctctttgctccatgtttcagtctgtattttctactgacctaccttctagctctcttacgtttttttctttgtcataggcccatgtatggcattgcaacacggtcattgcaacacggtctctca

SEQ ID NO: 550444 - DNA, 101 bp, Homo sapiens
tggaggtcagggtggcaggggtggcgtaccgaggagcaggagggcttcgccgactggtttgtcaaagccctggacgatctgcacgagatgaaccatgtgac

SEQ ID NO: 550445 - DNA, 181 bp, Homo sapiens
  misc_feature (129)..(129): n is a, c, g, or t
  misc_feature (156)..(156): n is a, c, g, or t
cgggtgaatatggtgatctctggtggactattattactacacaagtaactattcccaaagatttggctggatctattattggcaaaggtggtcagcggattaacacaaatccgtcatgagtcggagagncatatcagactccaaaattgatgagcnctttagaaggatccgaagatcggat

SEQ ID NO: 550446 - DNA, 707 bp, Homo sapiens
aggatatgtgaccagcgtcggttcttccgtccgtgatacttggctcgggggctcgtcgctgccgagcgccgcaccaggacgtgcgccggctccgccgtacaaaccttccgaggccctcgctgcgcaagccgggagcctctcccccctccgcctcgccgggaaagttaagtttgaagaggggggaagaggggcacatggacattgacagaggaggatcacctggagctgaggaaccggaacccggagtgtctgaaacttgtttggacaatggcaaatcatatgatggcaaaaattgagggcttaacagctgaatttgtgaacttagagtgcctcagtttaataaatgtaggcttgatctcagtttcaaatctccccaagctgctatatgacaaagcttgaactcagtgacaatagaatctttggaggtctggacatgttagctgaaaaagttcccacactctcacacatcttaacacttaaggtggacactaacatctgaccaccatctcagccaaccttggcacccttctgaacaagttcgactgtctgaaaagcctggacctctcttacctgtgcaggttcccaacctgaatgactaccgagcagagtgccctcccatcctccgtgcccccgcttacctactcgcgactgggtacgcaccccaggacccggaccgccctgactcccatgccgcgctgctggctgtc

SEQ ID NO: 550447 - DNA, 509 bp, Homo sapiens
gctgtgctgacttggcctcctaaagtgctgggattactggtgtgagccaccactccgtggcttccttttactttctttaaacttgcctagttgacctaataacggtgtgtaaaattaatctgcatctctcccctcctccctaccaatcagaggaccttagaatgctttaatgttactacttttccagtattttagtatctccctttgtttgatacctcccaaatgagttgctagtattgttattgtattagttcgtttgtattttacaatcaatggttgcttccattttccaacatttatgctaatatctttgctcaccattgcttcttgtgtgaaattgattgcctttgatttctcttataatatctcttcacttagaatctatgggggattttaggatctgtgaggggcttgagttcgttagctaaatcaagtatttagctctgacttctgaaagacaaatcacctcgcatttccctgtgtcggttaatagcaatgtccatttcctt

SEQ ID NO: 550448 - DNA, 323 bp, Homo sapiens
  misc_feature (15)..(15): n is a, c, g, or t
  misc_feature (56)..(56): n is a, c, g, or t
  misc_feature (310)..(310): n is a, c, g, or t
gaattcggcacgagngacttcgtagaacatgtggcccagatttagaaagagtgcgnttcccagaaacagtaccttctccagtcaggtgagcctcttgctgctcacatgaatgaatgaatgaatgactcaacgagtcagtcactctccaaacccagcacggggccaacatggaatctcccagtgccttgttctacttgctaacacaatgcatgcaggaagagttcatgcatatgcatgtgtgtgtgctcagtcatgtccaactctttgcaaccatatgtactgtagcctgtacattatggtttctcttgtncataagatcctcc

SEQ ID NO: 550449 - DNA, 185 bp, Homo sapiens
tacaatcgagctcggtacctacatatctttgagctcaacctttatacgtgtggcttggcacttcggtggctaaggtaagaacgtgcttgtggaagacaagtctgtggcttggtgagtctgtgtggcctgcagaaccgacacgttaataccctgcacagatcagaggctgctggccacacagactc

SEQ ID NO: 550450 - DNA, 361 bp, Homo sapiens
tcagtttaagttgagcccatcaggtgttactctttgaaaaatccagggctggacacagtggctcatgcctgtaatcccagcctttgggaagctgtggtgggaggatcctttgagaccagaagttgaagaccagcgtgggcaacatagcaagaccatctctacaaatttctaaatttatcatctctaatttttaaatttagcctagcatggtggtgagcacctatagtcccagctactcaggaagctgaggcaagaggattgcttgagcccaggaatacaaggctgcagtaagctatgaactgcaccactgcactccagcctgggcaacagagtgagactctgtctctaaaaaataaaaatt

SEQ ID NO: 550451 - DNA, 655 bp, Homo sapiens
ggatggactacaacgtcgagtaccagtacagtgctcctccggccatcgccaaacccagtcccggaggcgtgcccacatgtcctcagttccatcgtccaactccaagcaccagggtgggggtccaggattccgcgatgctgggtcctagatgtatatccttctagtactcgcttgtcggtgataggcatgcggatatgctaaccgtgcgtgctccatggtgcagatgcccggtcgtcagactcaatgctccatgcagcagatgcccagcagctccggtcatgcgcgtgcgatcgcatgccttctttcgcaggaggccgcttgtacgccccgagacgagcacgaatgatggatccagcgctgcaagcccaagatcaaaattatagcgcacgtccaagtgggtatgtggaacacagtgcatacctgcacgtacgcaccgcatagcagacgtgagcttgcatttggccccgaaggttatactccgcggaccccgccatgatttgaggaaaccatgatcgggaagcaaacaaccatcgtacagggttgcgaacgtgtacaacaccaacatctgcgaatatatatccacgggtcggcccagacaacaaattgcacgactcaaacgaaacgcaatagacagctggcgcatagtgaggaccac

SEQ ID NO: 550452 - DNA, 162 bp, Homo sapiens
aggccgtcgccgacaaggccgtagtcagtgtgccttccacaaaggtccttattcaggggcccttgacggagttcccctggggaccataacccttaaaataacacacgtcgcttcctgaggagaatgttcttagcctctcaaagtgcaatgatcttcactgac

SEQ ID NO: 550453 - DNA, 282 bp, Homo sapiens
acgcctagagtcccatctactcgggaggctgaggcagaatcatgtgaatccagggggcaggggttgcagtgagcggaagatcatgtcactgcactccagcctaggtgacaaagcaagactccatctaaaaaaaaaaaaaaaaaaaaaaaaaaaaaaaaaaaaaaggggggggggggggggccaaccccggaaacccaaaaatttggggaggcaaaacccaaaaaaaaacctgggggggggagtttaaaacccccccaccaaaaaggaaaaaccccctttttt

SEQ ID NO: 550454 - DNA, 239 bp, Homo sapiens
tctcccatgcccaccactctccctctcatcctgccccatttctctgttgtctttcctctattcctctcttcattgttcacagcactataaaatctaccttcccctctatacttccctatattcttgtactgactctattcccaggtccagagaggcccagaatcttctctgctcctgctccacctcctgacccactgccccctgggagcccctggtcatcccagaagcctgtaagtgca

SEQ ID NO: 550455 - DNA, 646 bp, Homo sapiens
gaagatagttttgatgtggtggatatcacacactctcctcgaggggggacacacgagataggtgtcttcttatatgtgggtagaataatctttggtaaagatattcacgcggctctctgcttataagggatgtttcctcttttgctatagttagaatttgtagaatgtagagctttataaagacttataaatatagttctcgtcgagttgtggggctgtatatataattggagatgagatgtgtataatataaatatgttgcccgcccgatatttttctagatatacattatgtgttgttatatttcttctgtggggagcgcttatatatatgagagacacccgcttctaatacagaattttataacacagaatagttctacaccttccatagagccaagattatgtatatagttctgttaataaaccatgttgaggtctcgtgttacatctctccacacaagatgtcttctaacattctcagaattattacaatatatatatgagagtgatatttatatcaccacagtagccattatatcttattacacccttaccctttttggtttcaattagaaacaatttttttaaacccattttttgttttcccaaaaaaaaccctgaataaaaaaaatttgtgttaacta

SEQ ID NO: 550456 - DNA, 933 bp, Homo sapiens
ggagaccagagaactagtcgtcggaaatcgtgctgtgtggagagattgctagcctctgatgaggcgaatccgtgctggtgtatcagagccatcagaagcgcaccatgacggagggcaagagcagcaggatgctgagcatatcgatgacgggatgaggtgcatcctggcaggcaaccggcgccatcttcatcggcaccttcaaggactaaagacaagcgcagtgaattatgatcctctgtgactgtgatgatgttcccgagagagatcaaaggccaccagaactccaacacagagcgaggagagagggaagacgcaagcgagtcctcggtctggtgctgctgcgagcgcgcgaagaagtctggtctcaaatgagcgaggtgcggagggaccctccctcccaaagatacctgagatattgcatcgaggttccacattgcttggaagcatgtccgggggagacccactcggaagtcagaggcacggtgcgttgctgggcaacgactgtgaactccgcagcgtgtgggtttccgcactgccccaaggcatccgtgcacaggaccttgctgggccaagatccgatgcggcttggggggggccaatccccaaacagggtgaagtgagccccacaaatggagagaggtaactagtatagcagggcggctgacacgctggctgccaacatggcagtatttggccggggggcctcccaaagcccagatacccaccctggggcgatggagggtccgtccccccacctacatgggcgcggagtgagcactccccatccaggcatgattggtgcccacctcctggtatgagaaccttcctatgggatcccccccaattggttgatccccccccctggaaagaagggactccacatgggcatgccccccatcccggggaaatgcgggcttctcttccccccatgag

SEQ ID NO: 550457 - DNA, 1400 bp, Homo sapiens
acggactattattgttgtagttttaaacttaagctcttagggcttaactatttgcggtttgctattgcggtgtccggctcccgtctccctggctcccccgcccagccatgcggtcccagagcccctcactctccatccagaccgcgagactgcaggactagataccgacctatataaatgcgagagcccagtgaagcagaggcagagatgacgtggtacgatgaaccgagcctctgcaatcagtaccctactaatgctcagcatagtggctcccaggactactcattacctcagatgcgtgacggagcaaacgaacagacgagatcagtacctacgagatatgaccagacatcaccataactacccgataacatcgaagacataacactaaataaccaaaatataacgtactcataaacacaaccaacaaaaataaccgagactactacaacattgtatcactcaaataacacctcacattatatctatacactactaaacagtcacttattaccatctacacctgaatactatagatatcacatcttatgtcatacaccacatcacacacatactataaacaacaacaccaatcagatccatagaacacgaaaattaaaacaagacaacacaattcaattaatgtttaaactaaatacattacatatcaatacccatatatccacataataataaaaacaaaaacaaattatcaaatataaatcaatacatcccaataccatttacaaaacaataaagtaccacacctatacataaagccacatcaacatatagaaacaatcataatactaatacaatatcaattataatcaatatagtatattatctcataatattataagatcactaacctaaacataataacattaaaaaaataatcacgaacttccaaattcacaccaaataataaaacaaaaaatatataacacatcaaaacaccaacaacaacatcaaaacataacaattacattaaaatcctaaaataccctcacgttcaataaaatatacaaaaaacgtatatataccacatgatctacccataactaacaataaatgacaccatcaccacaatatctacaagtctaacatccaccatactatgcaatactaccatctaatcacacatatacacaatcttatacataaaataacataacaacaagataccacaatgaacatacatatactaacaccgaatcagcataccaacaccacccatctcactcacaaaccaaccaataccactcaccactacatcaaagacactcaaacacacatcaattaccatctaactcatctacaccaccactaattcaaaaccaaaataaacaaaaccaaacacccaaaccaacagattcactatttctccattaccacta

SEQ ID NO: 550458 - DNA, 281 bp, Homo sapiens
ttgacattgatgtgttgggtgttggtgttccccttccctcacatcgtgcatcgccctcacgtttttagttaacttttttggtatccctcttgacattcaaaacagttacttaagattcagttttcccacttgttggtaatatatatagtgctgtgaatcatactgtgttgtttgtaaaaagaaattcagttggttaagctaataaggtgatgttttctaaggccctttttcctagtggtgtcatttgtgaatgcctcgtaaattaatgattgtgaagctta

SEQ ID NO: 550459 - DNA, 347 bp, Homo sapiens
gaaactgatgcaggttcttatagccttcttatggtagaagcatagaattgtgtaatttaaacctttccactgggcacggtggctcatgcctgtaatcccagcacttggggaggccgaggagggaggattgcttgaggccaggagtttgagaccagcctgggcaatatagcgagatcctgtcgctacaaaaaataaaattagccaggcatgttgacacatacctgtagtcccagctactcaagagggtgaggcaggagaatcacttgaacccaagaggcagaggttgcagtgagctgagaacatgccattgcactccagcctgggtgacaagagtgaaactctgtctc

SEQ ID NO: 550460 - DNA, 81 bp, Homo sapiens
ggatttgctggtgcagtacaactaggcttaatagggacatgttcattttagaaaaaatgagatgggaactgtgtaaaaaaa

SEQ ID NO: 550461 - DNA, 116 bp, Homo sapiens
tcacaggatctccttaaatactagactaaacggctcagacaggcagatttgaggtttccccctgtctccttattcggcagccttatgattaaacttccttctctgctggatacctt

SEQ ID NO: 550462 - DNA, 106 bp, Homo sapiens
ccttaacccccgaataagaggtcattcatttgttctcttagtctgtctagctttttcaactttcgagagtctttcattatcatcatctggaattgtcaccttaatg

SEQ ID NO: 550463 - DNA, 1120 bp, Homo sapiens
  misc_feature (8)..(8): n is a, c, g, or t
ccacgcgntcgaaaaaaaaaaaagagtcaaaaagttaataaaaaagtaaaagttcttgggggcagcccccgcccggtccatgccgccccgtccgggagggaggtggtggggcagcccccgacccggccatgccgccccgttccgggaggtggggggctgcctctgcccggccgccccgtctgggaagtgaggagcccctctgcccggccgccaccccatctgggaaggtatacccaacagctcatggtgaacgggccatgatgacgatggcggaattggtcgaatagcaaaagggggaaatgtggggaaacagagagagaaatcagatgggtgctgagtctgtgtagcagggaagtagacgtaggagactccattgggttctgagcattagggagtcataaccaatccctaatctcaagtacccagggacacaaacactagcggcaggccgcagcgtcctctgcctaggaaaaccagagacccttgtacacttggtaatactgctgaccttccctccatatggtcctatgacctagcaaatccccctctccgagaaaacccaagaatgatcactaaatactaacaaaaaccacacaccaaaacaacaggggcgcgcaggacaaaaaaaaatcccataagggggcccaaagaaaggaggaaaccaggaataccgagccgcaagacggggtcccaaaaagcacagcagaaaacaaaaaataagcaatgaccaaagaaaacaacacatagagccacggacacacgcagacccaggcacctgcgcaacagacacccaaacccgaggaggaacacaatgggcacacaccccacagagaaacacacggccacagaaaacacaaagatacaaggggacacgcggacaaccacaccccatagcgaaaaaggaaacaatgcaacaggaagaacacagacaaatacaggagcgacacagaaacacgaagcccgagcaaaaacccgccacccaaccaccgacgagacgtccgcgcacaacgacacaacgcacaccgccacaacaagcaacaccacacaccaaacgcagccccgaacaacaaagacaagaacacagcgacagcaaacaacacgaaagcaaacaacaacccac

SEQ ID NO: 550464 - DNA, 173 bp, Homo sapiens
catataggttggcgactgaaatggaacccttggcgcgatagatatagtaccgcgaagggaaagatgacagattagtaaccagagcagttatatagcaaggactaacccctataccttctgcataattgaattaatctagaaataacgtttgcaaggtagagccaaaggctaag

SEQ ID NO: 550465 - DNA, 756 bp, Homo sapiens
taaataatatttggctatgggggaggggaatatcaaagggacaagatcacttttaaatggtagttttataagatgttataaactggtatctttttaccattaaagtgcagggtatgttcaaaaaaaaaaaaaaaaaaaaaaaaaaaaaaaaaaaaaaaaaaaaaaaaaaaagaaacaaaaaaaaaaaaaaaagagaaaaaaaaaaaacaacagaaggatggcaacaagacacgaaagaagaatacgccagcaagaacgagcctcacacaatgagacggcactccacaacacgccaggccgacagatacgcgcagcaagacgggagtgagggagagagagagctgcgccaccgcgtcgccgtgcccggctccagcgcgaggcaggcgcgcgaggatggggcaagacagcgccgttcaccgcccaccccccactcagcacacagcgccaggccggacgcgcagagaccgaggagcagcgagaacagaggagaaagagtgaagagggcaaacataagggaagcacctgtcgtaagcacacaacgacgaagttaatcaagcgacagagcgcacgtcaggcgagcagtttggtctcattaggagggggagaacagaaatagcacatagcagcatcctcccatcgtcatctgcttcctagtctcgtaacgatggtgcagtttagaaaaaagagcgtcgtgctcgcgactgccacgggttcacgtgccacccatcgctccttgctccagctgcgaacgcgggt

SEQ ID NO: 550466 - DNA, 334 bp, Homo sapiens
  misc_feature (46)..(47): n is a, c, g, or t
  misc_feature (277)..(277): n is a, c, g, or t
  misc_feature (326)..(326): n is a, c, g, or t
tgagacagggtctcagtctgccaccccagctggagtgcagtggcanntagtcagctcactgcaacctctgtcagcctccaggttcaggtgattctcccacctcagcctcatgagtagctggggttacaggcgcatgtcacaatgcctggctaatttttgtatttttgggggtagagatggtttcgccatgttggccaggctcgtctggaactcctgacctcaagtgatctgcctgcctcggcctcccaaaatgctgggattacaggcgcgacagctngcacccagcctgacttgagcactttttcatgtatctgttgggccatttngtatgtgc

SEQ ID NO: 550467 - DNA, 90 bp, Homo sapiens
atgacctggaggtggctgagctcctgtctagagagggaggcaagcccctgttgacacagttctatcctaattaacacagtgggctgtgcc

SEQ ID NO: 550468 - DNA, 430 bp, Homo sapiens
  misc_feature (6)..(6): n is a, c, g, or t
  misc_feature (83)..(83): n is a, c, g, or t
  misc_feature (92)..(92): n is a, c, g, or t
  misc_feature (123)..(123): n is a, c, g, or t
  misc_feature (127)..(127): n is a, c, g, or t
  misc_feature (129)..(129): n is a, c, g, or t
  misc_feature (133)..(133): n is a, c, g, or t
  misc_feature (135)..(135): n is a, c, g, or t
  misc_feature (151)..(151): n is a, c, g, or t
  misc_feature (155)..(155): n is a, c, g, or t
  misc_feature (207)..(207): n is a, c, g, or t
  misc_feature (229)..(229): n is a, c, g, or t
  misc_feature (236)..(237): n is a, c, g, or t
  misc_feature (239)..(239): n is a, c, g, or t
  misc_feature (244)..(244): n is a, c, g, or t
  misc_feature (250)..(250): n is a, c, g, or t
  misc_feature (263)..(263): n is a, c, g, or t
  misc_feature (267)..(267): n is a, c, g, or t
  misc_feature (270)..(270): n is a, c, g, or t
  misc_feature (272)..(277): n is a, c, g, or t
  misc_feature (288)..(288): n is a, c, g, or t
  misc_feature (307)..(307): n is a, c, g, or t
  misc_feature (331)..(331): n is a, c, g, or t
  misc_feature (364)..(364): n is a, c, g, or t
  misc_feature (388)..(388): n is a, c, g, or t
tctgcngtgtcaaatggaaagcagcacacaagaattcccttgcagaccttgatctttcgcagaaatgccaagacgcctgagtnatacaactngcaattattattttctagacagaactgccantctngntgcntnccagtgtatcagtggntgcnacatctccttccttgtctccgggcttcatggcaggaaacagaagtaattccntgatgttgttggagtccgtganaaacatnncnactcnatcaangcccatgccccanccanctntnnnnnncagcccatatnccagggcagtacagaagtnttcatctatgaacatggcctcatnatcacctgcagccttggccttggcctgttcttnaaaaagctgccgctgccgcatggnatcattcagctcagtatacgcattgcatatctctttcttcat

SEQ ID NO: 550469 - DNA, 233 bp, Homo sapiens
cccggggggttttccggggcaccaattaaaccccccccccggggggccggggggtattccccccaaaaccctttttttttttgggaattggggggaccaaggcccctttttttttttttaagggggggaaaaaaaaatttttttttttttttttgccaagggggggggggtttggtgttggggcccccctttattttttttttaaaaaattgttttttggtggaccctgttta

SEQ ID NO: 550470 - DNA, 293 bp, Homo sapiens
atggaaggaaggaaggaaaaagaaagagaaagagagagagagagaaagaaaaagaaagaaaagtaagaaagaaaaaaagaaaaagaaagaaagtaagtcctggctaacacggtgaaaccctgtctctactaaaaatacaaaaaattagccaggcgaggtggcaggcgcctgtagtcccagctactcgggaggctgaggcaggagaatggcgtgaaccccggtgggggcggagcctgcaatgagccgagatcgcgccactgcatccaacctgggtgacagcaagactccgtctc

SEQ ID NO: 550471 - DNA, 124 bp, Homo sapiens
tttgagctgatgtggtgtagatgttgtccttcgatcgattgatttagagggtgaactcactggaacggggatgcttgttggtgtatcttactaagagctaatagaaaggccagccgcttagact

SEQ ID NO: 550472 - DNA, 571 bp, Homo sapiens
  misc_feature (52)..(52): n is a, c, g, or t
  misc_feature (221)..(221): n is a, c, g, or t
  misc_feature (257)..(257): n is a, c, g, or t
  misc_feature (365)..(365): n is a, c, g, or t
  misc_feature (384)..(385): n is a, c, g, or t
  misc_feature (427)..(427): n is a, c, g, or t
  misc_feature (510)..(510): n is a, c, g, or t
cgctgcggattatttgttgagatgcatgaatttttttctctatgctgcttgnaaaatttacaaatgtgtcttcgaacaatctacagtcaaaaagtgcactcccgatttcttcatagctctagattctgaaggtagtctcatccatgaggtttttctaggaattgagatgaactttgtctatatatttcttcaagatatgtaattagagaagtcctgcttcncttgctatttctatagagaaagaggaactttcacangttgcactctgtgtgtctgcacgtgctctctctttcacttgtctatatgaagtgtattactatttcatgtgtctgcgggtggcgtgtactatgattgcctgaagaggnggtttctctccttcctctnnttttcttttcactccctgaaaaatttacgctaaaatatatanaaccatttaaaatattggatatccattaaaggaaacagattacgtgttgtgactactatgaaaatatacaaactcaatatgcncaaaagtttttacaagagtcaaagagatattggcaaatcttcaacaatatagtcagcagca

SEQ ID NO: 550473 - DNA, 392 bp, Homo sapiens
  misc_feature (10)..(12): n is a, c, g, or t
  misc_feature (373)..(373): n is a, c, g, or t
tctgactttnnngcctaggctggattgcagtggcacaatcttggctcactacaacctctgcctcctgggctcaagccttcctcccacctcagcctcccaggtagctgagactacaggcacacaccaccacacccagctaatttttgtattttttgtagacgggattccgccatgttgcccaggctggtctcaaactcctgagctaaagcaatccacccgtctcggcctcctgaagtgctgaggttacaggtgtgaaccaccacgcctgggccaagcccaccattttaaaatgtattattggctccttgatgaggaaaggggcatattcatagttttaggagcctaggcaaaagttgttaagttagcatatggntttgaaaagtaactttaaa

SEQ ID NO: 550474 - DNA, 121 bp, Homo sapiens
tcgacggtaccaacatacaatcagagaagatgttagacacatgccaaaaaaatcatctacagaaatcttttcagtattgttttcaatactttatattcactttggtagagaaccttaggga

SEQ ID NO: 550475 - DNA, 649 bp, Homo sapiens
  misc_feature (630)..(630): n is a, c, g, or t
gcttggcatgacacgattattgcaaatcacagctccatcaaagaagaatctgctaaaaaatcacaattccattggaaatgctgcaaaaagcgaggattggtttaggaagaataaacacagttttatgtagctagtatattattcttcaattcaccagtgtcagatattgatgaaggccctttcacaaatgtcttcatgttagtgaatggaagcacagtgtctgacactcacagccatgagtagaaaagacaacaataacaagatgcatttggggtgataactgtcagaaagcttacacttgtgtgaaaagaaagaactctttgttaagaccatcttttctgagcatcaaatttagtcactgtgccacctaacaagccatcacagacttctatgagactaactttggctaaatggggaattgtttaatgagttagaagttattcttccaatgggccttcaagtaggtgaaatctgacatcaaagtcctcaagtcaagaattcacacatctagaattaaagtgagcagaaagatttacgttggaggaagatctagcatcattcactaaagcaagaaggtgatcaaaatcctagctgtctttcctttatatggtaagctacctttcgcacgcnaacatcaggggtaccgagc

SEQ ID NO: 550476 - DNA, 607 bp, Homo sapiens
  misc_feature (4)..(4): n is a, c, g, or t
  misc_feature (120)..(120): n is a, c, g, or t
  misc_feature (132)..(132): n is a, c, g, or t
  misc_feature (248)..(248): n is a, c, g, or t
  misc_feature (299)..(299): n is a, c, g, or t
  misc_feature (311)..(311): n is a, c, g, or t
  misc_feature (343)..(343): n is a, c, g, or t
  misc_feature (346)..(346): n is a, c, g, or t
  misc_feature (364)..(364): n is a, c, g, or t
  misc_feature (366)..(366): n is a, c, g, or t
  misc_feature (368)..(368): n is a, c, g, or t
  misc_feature (395)..(397): n is a, c, g, or t
  misc_feature (419)..(419): n is a, c, g, or t
  misc_feature (424)..(424): n is a, c, g, or t
  misc_feature (427)..(427): n is a, c, g, or t
  misc_feature (452)..(452): n is a, c, g, or t
  misc_feature (476)..(476): n is a, c, g, or t
  misc_feature (479)..(480): n is a, c, g, or t
  misc_feature (503)..(503): n is a, c, g, or t
  misc_feature (523)..(523): n is a, c, g, or t
  misc_feature (525)..(525): n is a, c, g, or t
  misc_feature (528)..(528): n is a, c, g, or t
  misc_feature (532)..(532): n is a, c, g, or t
  misc_feature (535)..(535): n is a, c, g, or t
  misc_feature (543)..(543): n is a, c, g, or t
  misc_feature (547)..(547): n is a, c, g, or t
  misc_feature (587)..(587): n is a, c, g, or t
tttntcacccaggctgcagtgcagtgctgtgaatcatggctcactgcagccttgacctcctaggctcaaatgatcctcccacctcagcctcctgagtagctgggaccacagggacatgcngccacatctggntaatttttgcattttttgtagagacgaggtctcaccatgttgtccaggctggtcctagactcctgggctcaagtgatccccttgccttggcctcccacagtgttaagattacaggngtgagccatggcacccaacgatatcccttttttttattggcaagaaagatntttccccttgtnaacaacttccaggcccatcaaggaaaacaggnggnaagactacctcaaatgantntnaacactcctcctggagtgtggcccttnnngggaggtgactgattttaactngaggnggnaccctggcatgcagacctgattggngtgataaggtaaggttcccacacnttnnggaaggtggtctggatctagganccagggaggaccagggggcntnccntgtngantagctcanaaancagccactgacaccaaagcacatcatgttagtttcgaggnttgctccccagggagaaatt

SEQ ID NO: 550477 - DNA, 546 bp, Homo sapiens
  misc_feature (303)..(303): n is a, c, g, or t
  misc_feature (316)..(316): n is a, c, g, or t
  misc_feature (336)..(336): n is a, c, g, or t
cgtgaagtatgagtccacaaagttacttactataggaacggatggttcctgaaaacacagatcccacagaagtaaaacaggcaaccctagcttcttcagagatgacattggggttagggtgggaacaattcagaacaggaaaaggtattttcctagcctgaaaatctgaactcaacatggagtaatgcgaatattgggagacggtgagtctgaaaggggggggtccgggtcacaccatctccggggttgggggcctcagtcatcttaccatcgatgtgtcagaatcctacacggcctcgagtntctaatcacggtnacgggcatcattcttccggnctctgagaacactcgggagacgccggttcaagctataccaggagctaagaaaagccggtccggcaccgtgcaaatgcatttctccctgcgaggttgtgtccgggcgcgggggggcatacgcctttagtgccaggtggggagtttgactggggcggtacacctgtcaacaggtaacgcatgtgtcctaaggcgagctcagggaggacagaa

SEQ ID NO: 550478 - DNA, 212 bp, Homo sapiens
taaagtgcagtgcactgagcacaaggactctctgtggggcccaggagcaatggagtcaacccttatggagcccacaacacccggctatccccagactacgtgtacagagaagatacgtgtagagggccctgagaggacatgcagcggcagtggatgccttgagcatggacaacggcaccccggacgtccaagcagacatcctagatgattca

SEQ ID NO: 550479 - DNA, 1197 bp, Homo sapiens
agcgggctggagcgctccctggcgagtggcgcagtgtaacatgaccgcatggcgcacagacaggcgggccgggaggaggatggcgctgtacggtgctgcgcttggggctagatgctcctgggcagctgaccttcgcaggctctgctggatccctcacatagtggtctagttgtgcaaaatcatagaacgccgaaacttgcgtctcgagtcatagattaccatggatgtctccagacactttaagccctgtgtgtggcacgtgaacatgtccacttatgccaattgaactgtactctgttgcatgaactcatccgggaccgcgttgcgtcactacactattaccacagtcacttctcacaactgggacccatgtcttgatcggcggcacgcttatacagacgacacccaagactggtcgcaggacacatccttccacctggacccgacctactcaatcaacttttggcatgttccgcacttagatagtctacatatgtctcccttgctggtattccgtgtttacctataggcaggatgtttacgttcacagccaccaccgatatttgtccttggcgcaaaccacgtgtgattgggacacgaactagaccacataattgatactctcggaatgggcattcaaatttccaacatgcaacaaacacagtgaaatccctgctgtataatcattaggcgtcccaacttaggactcccctgggaaccatgcacaggcctccaccgtgggccgccaacggtgtgcacctttggatggcacataggccatcctcactcttcaagttgtcggaccacgtcacactagtccaacgcacctccggacatatctacactacaaccagaaagcgcacccatcaataagacatgcagacaccacacacctactctgtcctacggccctggcatggcacacccgtgggacatttaaataggcaccgagacgacactataatcatacaagtctgttgcatgacacacatcgtgccgaacacgtgaacatacagtctgagctcacataagtcaaccgtgatgcgggtgtagacaataagcctcagaacacgccttatgtgctccacttaatatcttactatgctatgagtcacataacaacactacataccgactactctcccttctacgatgcctaacatagctgcagtcctatacctcgcgaactgaacacgt

SEQ ID NO: 550480 - DNA, 390 bp, Homo sapiens
cgcaggaactggccagctggtgttggagccagctcactccattcttcatagtagaagagtgcaggcttgagtgtcgcatgtgctgccacttttacggagtctgtttccttctttatcacctcctctaggatctcggttcccctctgttccttcttccaagataccagccgcatactgccatacccagtaccgacgtctgtatcgctcctgacccttgccgaccgcccgaagcatcttggatgagtgaagcagctttttgcgaatgtaccagctgacgcttgctgagttgttctatcttcgcgctctagctctgggatgctatatgccgtggcttccacctctccttctcttctacccctgcgggcctcccccagctgcggcggttccccg

SEQ ID NO: 550481 - DNA, 505 bp, Homo sapiens
tagattagacaccttagtatgatgaacaaaacaaaacaaggacctcagatacatatctgtctaggtcagcagactaacaatgtggatcacactcatgggaaagtgtagttgaggtagttgacaccttaggaagtatgggttttaaacttccctctgtggaagatattcacaagccacaagtggtgcaaatgtatatggtttttatttatcaatttttcatataggttttcttacaaaaggttgacatattccataacaggtgtaaggagtgtagaaaaaaaaaattcagattttagggggcagcgggggaaggagtataatgaaactgtatagcacaagggctctgatcaatccttcttgttctctttggcccacaatttaagcaagtagatgagcagaagacatggaaggattcagctttcagttcaaacagaagaagaagacatggcgaagagaaagttttttcacatttctttcttttttcatcgcgattgcgttcattctg

SEQ ID NO: 550482 - DNA, 1734 bp, Homo sapiens
  misc_feature (278)..(278): n is a, c, g, or t
tggaaaagggaaaaaaaactgggtctttatcacccaaatgacatgactatttacacagaaaacccttaaagatatctcaccaagaacaaagctactgagatattgcactaagtggatgttgaaggaagatgttggcaaatataacaatggccacattatttagaacacccacattggtgtgttcctataaatggacacaattcagaatattggaatatttcaaacaatatcgccagtgttatcataagggcatctcacaacacacacaccatgtgtgnagggcaccgtgagatagaagacacacaattaacagagagacgcagaccccacaaaacacccacagtgtgttctcaccagacactctcacaaaagagacatctcaaatatatctctttctcgcgtgacacatgtgcccctataagacaacacagagaatatctcagcggctgtggcgcccgcggggtgagtctctcacaaatctccctgtgtgtaaatgtgcgcacagcacctattgtgcgaggaggcgcccaacaggtgtggcggcaagattataccttgtgagaaactcaggagaggttattgtgagaaacaccagctctgtgggcccaaacatgtgtatgtagacacaccgctgtgtccctctctatcacactaacaatatgtggccaaacatactttacgcgtgaggtgtgtgtgagtgatggccaccgtgtgccctgtgtgataagtctcccccaaagacaactaccatgtgaggaagtagctcctgacagagggagaggcgacaacaaaaaatccacatcatgtggaaaaaccccccgagagagagagtgcgaacaacagggtagtggacaagcgttgaaagctccccccaagatatagcggcgcgcccccacacgtggaaacacctggcccaagaccacgtggggggacagcacactagcagaggggacaagaaaacaccgccgcggtgcctcaccacaaacaaaaccgaaaatcagcacaaaaagagaaaaagcaacaaacacaaacaagaggggggggcgcagcaatacattgtcatgatcaaacaaatcaactcctcgcgacccagagaagaaagggacatcccccaacaaaataaaccaacacggcactccacgcgcgaagcccaacccgtatggcgtatgtccccaaaaaatacaaggtggacgcaccaaccaccaagggagacagacgatctgacccccactaaagagcttatagagcacatagacaccaaacagcgcagcgagtcgacgcccgtggtgaacacaccacaaaggagccccccagaatgtgtcgcagctaaacaaacccccccacatacaacttagagtgaggaacaacatccacgagagacgaagacgaagagcacaccacacccctaggtgacgcaacggcagagcaacaacaaataaccgcgaggaccgacgaccaccccccacacgagtgaaaaaaccaacgcgcccacacggaaacacacaataaacaaacaaacatacaggcggacagcaacaggaggcagaacacacaacaggcgcaaccctagcgaacaccaagagacagaacacggccgacacgagaaagacataccacaaaaacagatcagaccgcacgaacgcaccagacaagaacaacatcacccgcagcccgaagcagacaagcagtgccgcaacacgaaaagaacacacgacaacagcaccgcagccgctc

SEQ ID NO: 550483 - DNA, 696 bp, Homo sapiens
cccaactagaccggttggctgagtgcaaaaggattgcctgagccctggaggtaaggctgcagtggagccactgcaccccagcctgggcgacagtgagaccctgtctcaaacaaaaaaaaaaaaaggaaaggaaaaaaaattttttttgtttaaaatatacatatttggcttaggaaaatattggggaggaaatacttggacaatattaagtgtccagttctctcagagttggtagcaactttatatttattccgttggatggttatatgggcctctttccaaattgtcttgtgcagcaaaacatgtcttactggggtcattaaggaaacaaattatttttttcctaacccaaaccaaaccctcaaaatacttccagacactttgttttcccaggagatgcgtacccttggtgatgtggggacagagggtccgggttcgggaagagagagccctggaaggtctgtactgcctgctcctgtgtgaccttgggctgcccattcaactgttctgggcttcagtgcctttaacttgtacacggggctgggagtggagtcttaatcccaccttactttccccacagggtgcgctgggcagatccagagagcttgtggctagagtaggggacagagggaggacgctaagtcttagaggattgagacgtactgcagagttgcatgatgccagctaacggatgta

SEQ ID NO: 550484 - DNA, 378 bp, Homo sapiens
caaattatcattcgtacattcccacgggcatgctcgaggtgtatagtcattgaattgactgcttataccattgttcctcttcgtacttcgattactttttaacacctgtgggtatctataaaccattacacttctatgcctcctccacctcgcactgccactggctgcctgttacaaacaaatgcacctcctccacgaattgcacttgggtgagttggagaagctgctggatgttgcccgggacgaataggtttagcaatctgtgcagaatgccctcttctggccatattctttgacctgactgcttcctttatgcgatctacttcttgctgatagcgtttgcgatcacgagatgcattttctttagcttctttcagt

SEQ ID NO: 550485 - DNA, 349 bp, Homo sapiens
acctcagatcggctatcggcgaacacttgagacgctattgctagagtctaaggcagcagtccgcaatctttttggcaccaggactggtttcgtggaagacagtttttccacggatgggaggatgatggttatgggataaaactgttccaccttagatcatcaggcattagttagattctcatgaggagtgcgcatcctagtttcctcgcatacgcagctcacaacagggttcgccctcctatgagaatctaatgctgccactgatctgactggctgtggagcccaagcagtaatgctcgctcatgccccctaccccaccttctgctgtgctgccgttaggccgatctga

SEQ ID NO: 550486 - DNA, 279 bp, Homo sapiens
ggtccaggggctcacaccattagttcgagaatttcggtaggatggtgagcacatgtcaccagcagtcagaatcttgatagcagtcctatcatcttctcaccacccagtctgcactaaagaagcataatgaggtacattgtggaggctcctacctggtagcccattatactcgtcccggccaagggaggtgattcgcatgactctggaaggtggagtttgctgtggaccactcatgggccattgcactccagcctgggcaacaagagcgaggctgtctca

SEQ ID NO: 550487 - DNA, 280 bp, Homo sapiens
tctgcggtcgctctagatgatccctactttccacaggccagtgatttcacaatgtgagtgctgtcagcaccaaagggaatggccaacaggcatgtgcggcctacagcgtccagcacccagtatgatggccaggaggcacggagcagcctggctgtcccagagaaagcaggagtcactggacacaactggacccaggtaggcatgtatgttactttcctgtggctgttacagcaaattaccaaaaatgtggtgacttaaaacaacagaaatttattttctc

SEQ ID NO: 550488 - DNA, 213 bp, Homo sapiens
gagaaacacagtaacaacctgatctctcttgcttttccccacaagttcaaaacagccaccctgcagatttccttgctcacctcttttgtcattctgtaacttttcctgtgcccttaaatagaacactgtgtaaagaaacgtaagcccgtactgctttacttcgcttagattcttactctgttcctctgtggctactctcccatcttgaaaatg

SEQ ID NO: 550489 - DNA, 172 bp, Homo sapiens
ccacaccccgtctctcaccaagagttactgattttgctcatccacttccctacacatctatgggtatcacacccaagactacccaccaagctcatacaggggaccacacccgacacttagacattcggacaagcagaccccagcggggggttcctttggcttcagcccctca

SEQ ID NO: 550490 - DNA, 442 bp, Homo sapiens
  misc_feature (2)..(2): n is a, c, g, or t
  misc_feature (136)..(136): n is a, c, g, or t
  misc_feature (200)..(200): n is a, c, g, or t
  misc_feature (209)..(209): n is a, c, g, or t
  misc_feature (222)..(222): n is a, c, g, or t
  misc_feature (272)..(272): n is a, c, g, or t
  misc_feature (282)..(282): n is a, c, g, or t
  misc_feature (344)..(344): n is a, c, g, or t
  misc_feature (355)..(355): n is a, c, g, or t
  misc_feature (364)..(364): n is a, c, g, or t
  misc_feature (376)..(376): n is a, c, g, or t
  misc_feature (412)..(412): n is a, c, g, or t
  misc_feature (419)..(419): n is a, c, g, or t
  misc_feature (425)..(425): n is a, c, g, or t
gnggggggtgggtggggagaggcccccagcctaagggcccaggctcctgccttcccaccacccgtccaggaagcagtcataaagtgaaagggctccagaggtgatgctcacagccctgggttcggctcctttcttncctccctgaagcgctgggttagacgggcaccatcagcccacctcacaggctcggcgtcgggtgngctcgtggncgctaatgctttntttccactctgaggtgctgctccagatttggggccctcccagagggcctnggagacaccnttggggaacagggagaggggctcggtccctgggccttacacagcacttctgctcaattaatnaattcaggttncctttcctnacgcaacagctnttcctccagagggggtgggactcggtactttttctnacacggnaatgcncccaggagctctctggc

SEQ ID NO: 550491 - DNA, 180 bp, Homo sapiens
gtgctctcaggattcccaatcttcagggtcaggatcctctttgctctgtgcttcgtcacccacgtagctgtcttttgtcccattcccaccatcaccccctgatgtctgggacgtcccacaactggatgggaaaacacgccctggtgagcactcgtccccacgcaaacgccggcctataca

SEQ ID NO: 550492 - DNA, 113 bp, Homo sapiens
gctgataggcggacactgtgggaggcagtgcgtactgaagccacacaccagagaggacacggccacaagagtcaccccaccccatctacctggcaccgctcaggccaggatgg

SEQ ID NO: 550493 - DNA, 941 bp, Homo sapiens
  misc_feature (764)..(764): n is a, c, g, or t
tattattattattatactttaagtttctagggtacatgtgcagcacaccaacatgacacattgtttgcttttgtaacaaacctgctcgttgtgcactttgtaccctaaaacttaaagtataatacataataaaattaaaaaaaaaaaagaatttcaggggtccgggataataagctcatggcattgtggctccaggttgtggctcttgaccccttcccacattttctccaggttgggtatctcttagaatgtgtttacccttcacagagttgagtgtgggagcgttaaagaactacgtgtgtgcataggggaatgtggaacttgctgtggccacacttccaaaagctctttgggccagttaatttccttggggtagagtgaggaccttattgagctgtagacttactttcctttaaagggttacgactgacttttttggaccccaaggttctcattgtaatgggaactaaaaacacattctagtgtgatcgtgcgcaatagaatttaacaatctcacacacaagggcgccttttcccccgttctctgtgttgcgcaaaccccctcttttgtgataactccccgaggggtgttcaaccttaagtggcctattgtgggatagagaacccccgattgtggaggatcatgctcggtcaacataaacttttactctgtccttgggggttcgaggaagcccagtgttttcccccccgcgggccctctccagcacagaaaaaattttttgcaggaagggcaggacacagangctgacacctccccaattagctgttgacaaaccgtcggggaacaaaagggttacacgttcgccatgggtcacctacgagaaactttaatacaaggagggcgacgccgcactacgatttgtacctaacgaaccacgagcagagttccttaattcccttttttgacaactggggcaccc

SEQ ID NO: 550494 - DNA, 944 bp, Homo sapiens
  misc_feature (773)..(773): n is a, c, g, or t
atgtctcgtagaacctgcccctatttttccccccaaaacaatattttgggaaacacatagaattggggcatccacgaattatccccgacaaaaattgtggcgcttaacaatatgacaagtgccatccctataagtctattccacaacgtcattacttgtaacaaatgcccccgcccttttttcccaaaccgaaatgttgcaatagattttcaagccgcccccctccttaatgatgtcccgcccgcccgattccttttctctgcagttctgtgcaccagcaaaaattttgggtgcctccgctgctatttaaagtaatgagcagcgccttgtggggataaagagagaacaatctcccgcttttggaagttgattataggcacctcccccccccttcgttacgtgggtagccacgccgggctccgccccttaggcagaagataatggtgttgaccctctcgttcggttaatttcgctcactgtttcccccacacaatcggggtgggcccccatttgttataaactttcttgggatgtgggtctgaataacatcacaagcgcatgtatttataatcgcgtggtgtaacaggagaaataacatttttaaatacatcgcgggacagacttgttcttcacgaggtatttgagcgcccccccgacgagtgttcccccgtcgtcttgggaggatccatgcaacatttcgcccttctatataggcacacaggggcttcacagaattatacataaacagggtgccgccagcttgttataacatntgtcgcgcccttactaatgcgccaatgctcgttattaatcaatctcctccggggcattattaaaaggtggtctttgtttacagtctatcttgggaaacggcgcagtactacagtcgtcggcttctaataatgtcaaaattaaacaattttccccccccgctctacaaaaca

SEQ ID NO: 550495 - DNA, 759 bp, Homo sapiens
tggataacaaccggtttaattaactatccaaagggaaagccgggtaggatattggggtaagggtcggtaattaggtagcataacttggtccccttgaatcaagcggggacccgatccaatctaaaacagaaatttcaaattatatttcccctcaaagttgaaaggggcggaggaagtcctccaaagtgggtggagacattctcaagctctacatcaacacacatcgggaccgggtgcagcatccatgttaattctaaaagaaggaggcttacggctcagaaagggggcagagatttcccagtcatcgtgggcttattaaaagcggtttagaataacgccacacttttagctagagtgtacacttagaacagcaagggtttataacaaggtctaagagacactaatacgggttttaacagatacgtagtggattacacaacttcagctccactccagtggcaaaagggcttctcaacgtgtgaatctaaaccgggtggggggacacccggggtgcttaccctcttttgaaatgaccaaggtgctttttaaaaggttttaaccactttaaggatgaaactcttttcaaaattgtggtgcactacattatctggtgttgtggccaatttcaaccttttactgtaattacctagaggttgaataaagaatatcctcagaggatgagtataggggggagggcccaagggggggtgacgggccaaacccaaggggccttggacaaggtatgggcccacaagaagg

SEQ ID NO: 550496 - DNA, 386 bp, Homo sapiens
gagcatcccctggacaggagatggagggtcgatgaaaagggagaggtcacggaactttactctctgcatcccatccctgctcgagtagaattgtggcattaggctatattattactctcaaggagtaatttgtcactcgggactctcctcattgcaactcacattctccccatcttccaataactatcacttccttcattcctttaagttcacgaggagccttcatagccaggtaacggttagcacatactcctttgatagacacaactcctctctcttctgctttcagtagtagctcgatgtgagtgtcgcttttctcccggaccccgtcaactcggccgtcgtgtctgatacgagagatgaagccccgcgtttcagcagtacag

SEQ ID NO: 550497 - DNA, 877 bp, Homo sapiens
gggcccaggcttacagttgtccacgacaaacccaacgaggattccgccagaccacgtgaacgtgccgacaacgtcaggtataccggctactacggtggctgcaggcgcgcccgggggctcgagtggcagcagtcttgggccacagtggcctgagacgggaagagcccccggggagcaccatgcgcttgggtcagccaacgtgctctagcacaagccgaagggtggcccaaactccttttggagtgccttccagctttccagccagcgtggcatgtgaggaggcatccagccacggggccagagcaccacagagccggaggcctccgacggaagggaagcaggcatgccccaggcggagaacgaggccccccagacccatgggcatacgcatcaaagtggagcccggcccgagggaaaccaaaggctccgaggacagtggacgacgaggatccactccagccacccggccacaccgaggcccgagttcacctctggtccataccgggcaggggtcctgaagcaggatccggtgcggcccatggggcctggaccacctcaccggggaccacccacgcccaccctcctgcacgcgggcttcctgccgcacggatggtgcggggcctgtgcacacccggcaccatccgtttacggccccgacggagctgggccatggtgtacccagcaccagcagaggcatgggtccgggccccgcgccatcccggaggcctttaacaccgcacactgggcactgcccatacccaggggcccgcagaggcaccaggctgccgcggaagggggactgaggactggcagagctgccggcgccagagcctgcgacaaccgggtcccccagaattgtccgcccgctctagacaca

SEQ ID NO: 550498 - DNA, 409 bp, Homo sapiens
  misc_feature (34)..(34): n is a, c, g, or t
aaaaggggcctttggggggggggcctcctgaccntgtccggccagaaaagttgccactgggaaacctggacccctactgaatggatctgctggcacctagacctcagagaagggggaactgaagactgaagtctgaccactgttctttgttgaaaatttctttctcaggggcttggagggatcacatctacaatcctgagctaatattctcttctgctgtccccaaaatttaaacgaagcttctcttaacccattgcaaatgagaaaaatctttgaatctacctatgactataagcccttatttcaagatatcctgcctttttaggccagaaccaaagtgtaacctccatctattgatttacaattttgcctgtaactttggctttcctgaaatttaccccagccttaa

SEQ ID NO: 550499 - DNA, 133 bp, Homo sapiens
ctgacagtctcgtggccggggcagccgctccccctccttgtctacttatgcaggatctgactgccgttgaggccgatccagtggctcctggcctgtaggtgaacatttcccacagtgtcaccccgaacagggt

SEQ ID NO: 550500 - DNA, 460 bp, Homo sapiens
attcgcggccgcgtcgacctggacccgctttacgtcacgggggttggcgatcaggatattgcgcccgcccaggcacatgaacatcaggcagttcaccgtcagcgacagcacgtgatacagcggcaacagggtgacgttggtttcctgctggttctcatccagctgattgccgacccaggccttggctgcatcaggttggcgaggatattacggtgggtgagcatcgccccttggcatcgcccgtggtaccgccggtgtattgcaggaaggcaatgtcatcgtgggccagcttgaccttcctgacccgcagcgttgcgccctgcttcatcatccgtggaaaacggatcgcccccggcagatggaaacgcggcacctgtttctggacatgccgcagcacaaagttcagggccgcgcccttgagcgtccccaccaggtcgccgatggcgtcgacgcggccgcg

SEQ ID NO: 550501 - DNA, 891 bp, Homo sapiens
  misc_feature (877)..(877): n is a, c, g, or t
tggaatgtggttcttttatatgttagggagaattcatgaggctttgtagctgtgaagaatgtctgttttggtatatatgcgtttgatgggtgagcaagttcgatgtgtggcagttaggatcagtgtatggtaggggaatgcgctgtttgtacatagggtaagcatgggcataccctagtccctcagagtctgttcctactgtgtactcaccatcggtgttcggaatcttgaaccttgtccttagtatatgtctttatcgtagagaccttcttgtcccgtcctagagggtgaaatcctggcacctggcacagctagcctcttctctgagctccatgtcccatgataaactcaggcctagacctgatgaaggctgccctcagaggctctctgttggcctccagctcctgggataagccgctctgcccacaccctactaggctgtcacattccctgccacgttgcgcaccgtgcaccaggtacactttcaagacactgtaaccactagatgttatttattgagctggcgcctgggacttgggatggggctctgccctacagtgagcagcctacacaggaacggctcctctcgcgagcggcccgggcagggaccgtgtccctacactcaacacctcgctctccagcccaatcttctgggtaccagacctgcttgtccctttttgtagaaaacacttttaaactttttaaaaatggtaaacgctttgtttcagcagatactggagagagtctgacaatcaattcacatttgtttaagccattattagctaaactgtcattgtgcatactctgaggttccctcatggagcgtccacagatccatttttagggaagggagttttggctcaaaacgatcgatacnccgagccgtccacc

SEQ ID NO: 550502 - DNA, 103 bp, Homo sapiens
agtatatgggactctggttcttggagcacaaacatcccatgggtgtggattcagccatcaggaggaggtttgaaaagcgaatttatatccccttttccagagc

SEQ ID NO: 550503 - DNA, 893 bp, Homo sapiens
  misc_feature (1)..(1): n is a, c, g, or t
  misc_feature (289)..(289): n is a, c, g, or t
ngcggtcggcggatcgttgtcccgtctttcttcctttggattttgtttcttctttgtctgtgtgtgctcgcacgtgttgtgaccgcgctttccggggccagtgtgaattgggggtatggtccgtagcttctgcattgggacccagggcatcactccttttcggagggatcccagatttggtgggtcagggttgcggccccggtgtcgctcggtgattaacctttttttaagccacgtgggggcccctggtcagttccagtgacctcgggaggggacattgccgctggcncccgtgggcaccctgataggggcatcttgatgtagcgttagcaaggtttacaaacaagggcgcgttagaagccgttgccagtgggggtccgctgaaagtaatcctgggcgaatgccgaccgcccgcatcttgtcttgctcgcgctgtatgaggggaactacagccaccctgggatatggactcctacgcccccgagtatcggatccgccagtgctcttggaaaaatgaagacaagaagggtctgcccaagtgtaccatttacacccaacgcgggccccatgacgtgggacgctatgatttgagagcgtcctgggtcaaactgggcacacacctaaggtcttcagccaatggggctgacctttacggggtcacacgaggaggcaacccctggagctttccaggccctgcataaggctgtgctgagccactcgaacgagaagggactgtagctgctggggcaacatgtttttatgaggccataacccacatgtctaaacccccccgaggtcaaagttcaaccaaccccttgtctttttaaagggtggcccaaaacccaatttcccctttttcatggggaaaatggtgaaatcccaaacaaaaaaaa

SEQ ID NO: 550504 - DNA, 205 bp, Homo sapiens
tctagaggatccctggccctcagttcataaccaccagtgtattcgccgcccctagagtagcgcgccctatcccgcatggtgggcagcacgccaaggacagccaggtacaacagcaactcatcgcaccgttcgcagaagacggatccgaccgtacgctgggtgcacagcgcatccagctgatagacggcggctacgagcgtactct

SEQ ID NO: 550505 - DNA, 304 bp, Homo sapiens
  misc_feature (51)..(51): n is a, c, g, or t
  misc_feature (149)..(150): n is a, c, g, or t
tttggggcctttgggaccctggggcaggggtgttttctccttaggcccaantgttcccctggaggaaaaagggaaaaaggggtgtttcccaacacctgcctttgaccccagcattttcaaagcaaagcctacaaaagggcagttatttnnaaaaggccacaggcagttcaggcctttttttgttccatccccctgcctcccattttggaccacacctgggatggtgcagggaaaaatttgcaccccttagttgggcagccaggagtgcccccgggaatggataataaaaatattaaagaattta

SEQ ID NO: 550506 - DNA, 173 bp, Homo sapiens
  misc_feature (62)..(62): n is a, c, g, or t
agcctttgtcccagacacacacacgtgtattctcatcttttcttttttcttttctggacaantctcatctgtcacccagactgagtgcatggtcgatctcggtcactgaactcgctcctgtatcacgcattctcctgcctcagctcccagtagctgtgatacaggcgcacaca

SEQ ID NO: 550507 - DNA, 207 bp, Homo sapiens
  misc_feature (161)..(161): n is a, c, g, or t
  misc_feature (180)..(180): n is a, c, g, or t
atatgggtgagcctctccaatccaaaccttttaaccagcaaaaccaaaaaagaggaggcaaaagttagatactgtaatcaaaaaaggtttctggggaaggatgagttatgtctgtcatcaggtttaacacgatgcacatcacataactatcaagattcccncaacacaagtttctgaatnggtgttcagactaaggctcacaatata

SEQ ID NO: 550508 - DNA, 1028 bp, Homo sapiens
  misc_feature (997)..(997): n is a, c, g, or t
gctgtgtcccctctggacctttgtgctgtgcccttgcgtcgtgtttcgcaatgccccctgaggcctccatcccttgtcttgcttgcactcgtgccattggctcctcatgtacctttctgggggaaaacatggcactgggagccaagataatggtgcttgttcattctcatgggacgtgaagcacctggtgtcctccactttagcacctgctgcctttcaaccgcgttagtcctgtgatagtcccgttctaaagtcccaaatcttaacgttgcgcttactcagctatcgacctcataggggtgagctgcccaagagcatcatcaaccaggtctctgtctccagactccagctggattttgccaaccacctgcgacaagcgcactggagtcccaccctgcctctgaagccaggtgtctgtaagaccagcctgctgttcccacactgtgcccacgctgcactggtacacacgctgctatcacggagaatccctatctggaagcctgcaagtctaagatctcctatctggtgacagtgggatggttcgacgttcgtgctttagagtatgacactatggattcagacttggtgaaagttcctctagtaccaatggataacagggatgaggctcttggattaaaaggtaacttcattcactgaatagctatgacatgagggttcaggcccctaaaataattgtaatactttctttctgggccctgtatgtacccacctaagaccatctttaaagtgctagtcggcatgatatggcgtgtggggagatgctaaccagcagggctctgagaagtcattgcttcatgaggctcaacgaatgccatagcgctggcagtacatgtgcacaaagcagaatctcagagggtctcctgcagccctctgctcctcccggccgcacgcacaagcaacaccacagaacaagcagcaccccacagtgggtgccttccagaaatatagtccaagctttctctgtggaaaaagacantacccccaggggggaccaagtgtctgtcccc

SEQ ID NO: 550509 - DNA, 200 bp, Homo sapiens
aatttcttcccccaaacttcttgcatgttgaagatatttgagctatttgtgatctaaaggagtagggtattaggcccttttgttgggagccccaattccctttttttcctaagttacaggggaaggaaggaaggggaaggccttaatttgttttccagaggaagaatggcatctttgcttaaaatttctaattcactggg

SEQ ID NO: 550510 - DNA, 114 bp, Homo sapiens
  misc_feature (8)..(8): n is a, c, g, or t
ctttcttnagctgaggtctgtgtcggttattagcatcagctttttcactttcctgggttcatctggaaagcctggtcacccactgtgttctcacaccacagagtcaggcagtag

SEQ ID NO: 550511 - DNA, 140 bp, Homo sapiens
taaaaataaggtctattaaggatgtgggaaaaaatcccctatgatttcattttattctcataaacttctcagtgaaaatttccagttcaggcctatactcttaaggtcctttattaaatgcccccaagatcacctcttgg

SEQ ID NO: 550512 - DNA, 192 bp, Homo sapiens
tcaggtttgcgacactggagctgagttacgaccccgacgagccgcctcgttgaagctgctggacatcgacacgcgcctgggacgctgtcgctggcggaattgcgccccacccgagcgcctgggggtagtgccgctcaatgtgaggcggcccgacctgctggccgaggagctcaccccaggtttcgcagatct

SEQ ID NO: 550513 - DNA, 359 bp, Homo sapiens
cacgagggctactctgagctgtgacagacacagtctcactctgtcatccagtcaggtgttgtggtgcaatctcacaatctcagctcactgcaacctctgcctcctggtttcaagcgattctcctgtctcagcttccctattatctgggattacaggcacatgccaccatgcccggttaatttttgtgtttttagtatagacagggtttcaccacgttggtcaagctgttctcaaactcctaacctcaaatgatctgcctgccttggccaatgtgctgggattacaggcatgagccaccatgccccgccctgaacttattaaatctttattattattaccatttttttttttttttgaga

SEQ ID NO: 550514 - DNA, 640 bp, Homo sapiens
  misc_feature (94)..(94): n is a, c, g, or t
cgggctcaagaattcggcacgaggtgagccatggtcacaccatgcaactccagccagggtgcaagagtagaccttgtctgaaggaaaatctaanatatacgaggaatatttagaactcaccattaagaaatgagggtgggggaaggagagccatcaggaagaatggctaatgtatgctgggtttaatacctagttgatgggttgacagatacagcaaaccaccatggcacacctttacctgtgtaacaaacctgcacatcctgcacatttatcctggaacttaaccaaaataaaactcaacaataagaaaatgaacaatctagttaaaaaatgaacaaaagatgggaacaggcacctcaccaaagaagatatacagatggcaaataagcatatgaaaaatgctttggccagacgtggtgactcatgcctgtaatcctagcactttgggaggccgaggtgggcggatcactgcaggtcaggagttcgagaccagcctggccaacattgtgaaaccctgtctctactaaaatacaaaattagccaggtgtggtggtgggcacctgtaatcccagctactcaaggaggctgaggcacaaaaatcacttgaacccgtgaggtggaggtgcagtgagctgggatc

SEQ ID NO: 550515 - DNA, 1144 bp, Homo sapiens
  misc_feature (399)..(399): n is a, c, g, or t
gtacatgggtagatagcatttgcaaggctctaaaggatttgagaaggataagatcggttcacgttagaaaggtagagaagtagaaggtatctgctcttgggttgcaatgaagcagataagtaactaagaatctaagattatcagggtaaaaggttgcttattatctttgtttcatttgtctatttttctatattctgttaattttggaccattagggggtactgcatctggtaatgtagccccatggtctagaaaatctgcaggaaaggacattagagcactagcagggcatacagaggacaagatctactgagcgcttctctagggagactccatagacagaattcgtcccagactttgacaagcttttcctcacatgctggctctgtcgagagaccnctacgtagttgtctgcaaacaacgaaaacaattggcactgagggacattaagagtagtcacacagggatggcccacgcgtgaatatttggaggtaacccaaaaaatcagggagagtgtgttccaacacgatttgtttttggccacatgtggactggggttccactcggatgagcattctcgtgaaagcacggtcataagagtgggatttccagcctcaaacccgtggggtcggctacagcatgaaagttgtgtttacagtgccctttaggcaaggggggccggtagaaagatccacatagtgagcgcacccacggagatttatccaaaccacggggggtatcgaaggggatttataacgggatgaatgaggtggttggtaggatatcgcataattttgaaacgggccgaattttggaagggaattttacaggtgtgggggctatcacaggagggacggcgtaacttttaagaacacagaaaaaaaatcagtttcaaaaatatggtcggcgcattggtaaaaacaccgggggaacatagaatcccatcttcggggtgaaagatggtctttcgcaaatagttctgagccagagttccaaaggacagaaaacggttcatctggcggaacctggggtggcggccatttttggtgatagggatcttccgccactgggacttgagttcaccgcttataagtgggtttaaggaccttgtacctttggtcaccaggggtaaccccccacttgg

SEQ ID NO: 550516 - DNA, 629 bp, Homo sapiens
  misc_feature (43)..(43): n is a, c, g, or t
  misc_feature (179)..(179): n is a, c, g, or t
  misc_feature (245)..(245): n is a, c, g, or t
  misc_feature (273)..(273): n is a, c, g, or t
  misc_feature (324)..(325): n is a, c, g, or t
  misc_feature (349)..(349): n is a, c, g, or t
  misc_feature (353)..(353): n is a, c, g, or t
  misc_feature (368)..(368): n is a, c, g, or t
  misc_feature (384)..(384): n is a, c, g, or t
  misc_feature (386)..(386): n is a, c, g, or t
  misc_feature (390)..(390): n is a, c, g, or t
  misc_feature (396)..(396): n is a, c, g, or t
  misc_feature (437)..(437): n is a, c, g, or t
  misc_feature (442)..(442): n is a, c, g, or t
  misc_feature (451)..(451): n is a, c, g, or t
  misc_feature (455)..(455): n is a, c, g, or t
  misc_feature (478)..(478): n is a, c, g, or t
  misc_feature (495)..(495): n is a, c, g, or t
  misc_feature (499)..(499): n is a, c, g, or t
  misc_feature (518)..(518): n is a, c, g, or t
  misc_feature (521)..(521): n is a, c, g, or t
  misc_feature (528)..(529): n is a, c, g, or t
  misc_feature (549)..(549): n is a, c, g, or t
  misc_feature (553)..(553): n is a, c, g, or t
  misc_feature (613)..(613): n is a, c, g, or t
tcagatgaggccagaaaggtgggtgggactggtcttcaggggngccagatgaggctgaggggctgggcctaggtcctggagtggggtcagctctgggacccttctggggctgtgtggggaaggggctgggggccaagaggtccaggaggaggctggcgatgagatggctggaagcaggnggttctagggaggccctaggctcctggttatcaggtgttcaccgtgctaataactgaggatccccngcccctggcacccagctggtggaggggntactgtcttggaggcatcactggttccacaaaagggagtggtgaatgggcnngatgggaccaccccatgcccccantaantcaaccagaagcttngcccggagcagcagcngnggantccagnagctgggggcaaacaggatgcaagggcggccacaacccagncagcngaggccganccancaaggaacgcaggctcagagcanacccccttgggacagangganaaggggagggggcggtgcntcncaaatgnnaagccgaacactgagcaccncacnggatacgagagaaggcaagccccttggtaggacagatagggaagatgccattatacctgngaggtctgtgaaagtg

SEQ ID NO: 550517 - DNA, 123 bp, Homo sapiens
gaggaggatacttctctggctagggacagctgggagtggagttctttgcatgagaaaactgtaaactcttgtgcatagccgggcctgtggatcatgtaatatgccatcctgcgaggggagcca

SEQ ID NO: 550518 - DNA, 1318 bp, Homo sapiens
caacgacggaggtggctctgacaggagcacaagatgtcagctggacgaggtctagacggaaatacaacacagactgtgtgcagggttatgacccacagcaaagcccaggagatcctggcccgaggatgggcctaacagcactcacgccacctgccataccaaccccaagagtgggtcaacgttatatgcctggatagactctatacgagaggctatcatccaatccatagctagtcggactcaggacggcttatacactctagactatccataggctcctaacgcgcaatacccagtgacgaggcaacaccgagtgaacaggacacacacatactaggatagcataaaacatagaaaccctaaggcgccaattacagaatgcctcgggcacggagatcagattgagatcgaaatcccaagtacaccttggagctctatggcctattcctacgcctaccataaacccacagcgaatagtggcccatacagacagacatacccacaaaggactaccacaatcgagacacgttaccaccatatacccagcgcgccccacccccacttggcattggaccacaccccccaacagccaaaaaaagacgcccatatagagagagttggaaattaccacggagaggaacacaacacgagacctcggcacagccacaagctcaaactaggcccaacaagccttagaaaaacacacgcaccacatacagaacatggaggaaggcagatcgccgatccagaggtatacccacgaagcaagactgaaccaccacgttggacagtattgcgagcacacagaaaattaccaaaaacctcggagacgttcagggggcaaacgtcaatacccttgagaacaaggaatatgcaccacaacaggactcatattggcacacacacgatatagcatcctgacgacacaatatacaaatgatctccattcccaactccgcgacgcctcctcaagcccacgtaggaacagtctaaggcccccaacaggaaaggaacagagagcaaaacaaacgaagaacagccacacaaccacccgagacccacacccgcccgtcgaacgacacagcagagtgcgaacgacgagacacacacacaagcagcacgagcaacaagtaaagcaccgaaaccacaaagagcaacacacgacacccgaagacgcagtaacaacgacagcaccacacagcacaacaaacacctggtaccacacatacacaggcaacagcacaacacgaaaccgagagaaaacaaacagcagcgcacaacgaaatcagatgaggacaaagacgagaaacaacaatag

SEQ ID NO: 550519 - DNA, 377 bp, Homo sapiens
cgacctctccctacgtatctataggtttgcatgatgtgtttccattttctgtttaaaaattttttttggatttccatcttaatttcttcattgacccaatgatcattcaagagcacatttaatgtccatgtatttgtacagtttccaaatttcttctggttatggatttcaagttttattccatggtggtctgagaagatacttgatatgattttaacgtttaaaattttgttgagccttgtttggtgtcctaacatatggtctatcctggagaatgttccatgtgttgatgagatgatggtgtattctgctgctgctggatgaaatattctgaaaatatctgttaggtccatttggtctaggatacagtagggaga

SEQ ID NO: 550520 - DNA, 165 bp, Homo sapiens
cactgggctgtttgaagagaacagatcatgaggcccatcaacataagatatgcaataagatttctttatacttggggtttaatgattcagttcatactgacattaggcattatttactttggctttgctttctgcatcatctcgcctccgcacccatgtctgatt

SEQ ID NO: 550521 - DNA, 259 bp, Homo sapiens
tagagatcccctatgtgtcgatcgttagaaatgcaggttatcgtcgattagatatagtgctgcagtcaacatccttgaacacaaatatttattccactgattatttctttctttcttttttttttttttgggaaagggattctcactcggtcccccgggtgggagtgcatgggcaaaatctgggctcagggaaaccttggcctccccagtaaaagggattctcggcctcagcctccggagaagcgggaactaatagggc

SEQ ID NO: 550522 - DNA, 219 bp, Homo sapiens
tgctatactgtacacagtcctggacacacaatctacaggccacactggaattttcaactaaaagaaaaaaaacaaaaaatgtactggggtgaggaaaggggttcccattgtactcaatcttcaaccaacctaatgcatctttattattccaacccttttcgaacgcaaatatacattctccttggtattatggtcttaattaatgactgagtcacaggg

SEQ ID NO: 550523 - DNA, 435 bp, Homo sapiens
cagtcggtctaccattaatggtttcaattacatggtgttattcagggacgtttccatgttcccctatccctgggtacttgaagttgactgtatgctaaaaaagaacaatcctaattattaaaagtcctgaatcataaaatgatatatataaactcattaaatggtaagaaaaaaaagaatgttctgattattttgcatatatagaattaattttgatatctaaaaaaaactccactcaattatttttccttgaaagtagtatattttttacttctaacccaatacagcagtgaaaatccagtcatttcagctaaacaatactgtggactcgtaaatatgagttcgatcataaatcctctaagtctgaaggttaaaaaaaaaaatccagtaacagacacttaaaaaaatacacaaagtggattttaagaaatccat

SEQ ID NO: 550524 - DNA, 439 bp, Homo sapiens
tgcaggtgatcacgttcagccccgtgtgggacgaagagcccttcgacatccccgaggtggtgctgcccactgcctgcattcacttcgcattgcagcctttgaggaggggggtaaattcgtagggcaccggatcctgcctgtctctgccatccgctccggataccactacgtctgcctgcgaaacgaggccaaccagaccgctgtgcgtgcctgtgcgcatgttcatctacaccgaatcctcggactacattcctgacgaccaccaggactatgcggaggacctgatcaaccccaatttagcacgtcagcctgatgaaacagagggcccggaagttggcccgccctcattggggagagtgaggctcaggctgggcaagagacgtgccatgagacccggtctcagcagctggggtctcagcctgtctcaaagcccatcccc

SEQ ID NO: 550525 - DNA, 396 bp, Homo sapiens
  misc_feature (6)..(6): n is a, c, g, or t
  misc_feature (376)..(376): n is a, c, g, or t
  misc_feature (379)..(379): n is a, c, g, or t
ttaaanccccaaaattataaaaacccccggaggacaaccctaggtaatacccattcctggaccctaggaacaggcctaagatttcatgacaaaaaaactatgcatctgagaaaggtctaatatccagcatctataaagaacttaaacaaatttacaagagaaaaacaacctcattaaaatgtggaaggccgaggcaggtggatcacctaaggtcaggaattcgagaccacctagtcaacatggtgaaaccctgtctctactaaaaatacaaaaaattagccacgagtggtggctggcacctgtaattgtgccacgggaggctgaggcaggagaatcacttgaacctggggagatggaggttgctgtgagccgaganttngccattgcacaccagcc

SEQ ID NO: 550526 - DNA, 278 bp, Homo sapiens
tgactctaaggatcctggctccacttggttgcagaggctgggggtagatattgtgttagaaacaaacaggaggggtggccaggcacagtggctcatgcctgtaattacagcactttgggaggccgagacaggtggattacctgaggtcaggagttcgagaccagtctggtcgacctggtgaaactctgtctactagtaaaaatgcaaaattagccaggcctggtggcacaatgcctgtgattccccgttagtcgcggcaggctcgaggtaggagaatt

SEQ ID NO: 550527 - DNA, 314 bp, Homo sapiens
  misc_feature (253)..(253): n is a, c, g, or t
gtcacccaggctggagtgcagtggcacatcttggctcacagcaacctccgcctcctgagttcaagtaattctcctgtctcagcctcctgagtagctgggactacaggtgtgcaccactacgcccagctaatttgtgtatttttagtagagacggggtttcaccatattggttggccaggatggtctcaatctcttgacctccggatcaactccccttggcctcccaaagtgctgcgattacaggcgtgacacncgcgcccggccgccaccttcaaatcttgttacgacataggcacattacccgtcttgacatg

SEQ ID NO: 550528 - DNA, 397 bp, Homo sapiens
  misc_feature (69)..(69): n is a, c, g, or t
  misc_feature (99)..(99): n is a, c, g, or t
ccgcttgagagtgccacgacagggagacaaagcagcaagaaatattaaaataacgtcaaaagttagttngtgataaggtttggctctgtgtccccaccnaaatctgacccccaactgtaatcctcatgtgtggggggaggatcctgatgggaggtgactggcccacaggggtagtttcccccatgctgttctcatgatagtgagggagttctcatgagagccgatagttttaagtgtggcacttccttgctcttgctctctctctcctgccaccatgtaagatgtgccttgcttccccttcgccttctgccatgattgtaagtttcctgagacctcccaagccaggtggaaatgtgagtcagttaaaccccttttgttcataaattacccagtctca

SEQ ID NO: 550529 - DNA, 106 bp, Homo sapiens
caattgccagctatactaccattgtctgtttaatcaagaatccttgctgctataaattggctgtataactcttggttggctctagtgaaaataagacaaactgtcc

SEQ ID NO: 550530 - DNA, 292 bp, Homo sapiens
cctgaatgcagctgtgtttttttttttcctctgctccaggctctcatcaggcttcatgcatggcattgggttgttctttctttctaggttaagactgatttttttgaagcatcagcccacttgtcttgtgtaatgccccacattttgggattaatctgatggttccctcacgatggggttcaagttaaacatttttggcaagaatacttcgtaggggaggtgtacattttcttgcaggggccagatcctaatattttacacttggcaggccatgcaggttctgtcacaacta

SEQ ID NO: 550531 - DNA, 510 bp, Homo sapiens
gaatcacaagcacatcctcaagtgacgtatttcggcagtctgcagatcaccagtagtcatgatccatctgagggtcatcagtattaaggtagggacatcctctaagtagtctggcatgactagtttttcatttggaagccaacagaccaatatcacagtgcccctcatctgccccactcatcaactacatctgaccactccccttctatcatcattccccacatcgtcatatggtagcctcctgagttcatgaactaccccctccctgccctatgtccgctgtcagaagcccaggagaggcctcttcatcagctttgcctgtagaagcccgagtgtacagatgagtgtctctgcatcagtcgagcctcacttctagagtcacccacaatccgcccagcttcccctaggctcctccgcaaacttctgactctgttaaaaaagaacctgttcttgcccagcctgcagtcagcaactctggcactgcagcatctagtactactgaggtgtaag

SEQ ID NO: 550532 - DNA, 147 bp, Homo sapiens
gctcggtgccacatcagatgtgattacttctcgtactgcattcatccacatcagacatcagcctccttgtcagaccttctccccttcctttcctaggtccattgcattgaagagggacccagcaaccaagttcctttctctagattg

SEQ ID NO: 550533 - DNA, 113 bp, Homo sapiens
gcccaagattctccttgactgcttgcaaaaacatattccgaacattgtgaagatccatgaaaaattcttcaacagacaacttctatggggtccagagaggaagtactcgccca

SEQ ID NO: 550534 - DNA, 869 bp, Homo sapiens
  misc_feature (147)..(147): n is a, c, g, or t
  misc_feature (261)..(261): n is a, c, g, or t
  misc_feature (287)..(287): n is a, c, g, or t
  misc_feature (289)..(289): n is a, c, g, or t
  misc_feature (291)..(291): n is a, c, g, or t
  misc_feature (357)..(357): n is a, c, g, or t
  misc_feature (359)..(360): n is a, c, g, or t
  misc_feature (374)..(374): n is a, c, g, or t
  misc_feature (378)..(379): n is a, c, g, or t
  misc_feature (383)..(383): n is a, c, g, or t
  misc_feature (393)..(393): n is a, c, g, or t
  misc_feature (428)..(428): n is a, c, g, or t
  misc_feature (480)..(480): n is a, c, g, or t
  misc_feature (488)..(488): n is a, c, g, or t
  misc_feature (491)..(492): n is a, c, g, or t
  misc_feature (509)..(510): n is a, c, g, or t
  misc_feature (521)..(521): n is a, c, g, or t
  misc_feature (531)..(531): n is a, c, g, or t
  misc_feature (547)..(547): n is a, c, g, or t
  misc_feature (550)..(550): n is a, c, g, or t
  misc_feature (578)..(578): n is a, c, g, or t
  misc_feature (635)..(635): n is a, c, g, or t
  misc_feature (714)..(714): n is a, c, g, or t
  misc_feature (738)..(738): n is a, c, g, or t
  misc_feature (742)..(742): n is a, c, g, or t
  misc_feature (770)..(770): n is a, c, g, or t
  misc_feature (775)..(775): n is a, c, g, or t
  misc_feature (805)..(805): n is a, c, g, or t
  misc_feature (859)..(859): n is a, c, g, or t
caaatgctaataaaacctttatttaaaaaaaaaaccaaactattctttatttgatagccctgggacatggtgccctccacccaataaagcaccctccagcaaccctcccacccctcacccgatacatagacatagggacacacacanacacacacacacacacacacacacacacacacacacacacacacagagatctggatccgtcttcacttcctgttggcctgagcagtaccaataacacactggttcaccttggangcaaagcgtagagagttgagggactngnanacgttctcttccagtggagaaatgttcacaaacatgagctttttagcactaccacccagagagttntnnagcaggtaggttantttnntgtnccggtaaggnacgtgggactccttgttgctcagggccatgataancagccccagcgtggacaggctgctgtaaatggccttttttttccgaaagttnttcccgcnccnngggggggaggggtaagnnggggtcaagtngctcactccnggccaggtccacaagnttnttgggggccccacactgcaggcctcggntggagttctccccagaaatttgtaggtggaatacactgtggctgcgtgatgaccgtncattctgggctgtgcgggccacagccgatctctggcgggccagaagaagcagggcgtccacttctttctcacaggaganagggacatatcgagcattggtganagtnagcccctcactccctggccctgcacggngaatntcacactcgcccccttgacccttccgggtnccagtggccagcaggtcccggacagtctcattgtagatctctacgtagcttgcnacaaagctgt

SEQ ID NO: 550535 - DNA, 404 bp, Homo sapiens
ggtccacactgccaaccctgtgctttgaagagaatgttttagttctgaaactaactatcccaggattattagatgttaaagtctcataagtagggacagagtggtgagttagcagttgagagcactgtggacttctggcctcccctggcagcaacacacaaattacttaggtatctgtgtatcggccgaatgtatagatgaccagggcaactgtaaatgggagtgggctccttggagttagaactacaagaggttgtcagccacctgatttgggtgttagaaaccaaactccagtcagtcctctggaagaacagttcacgctcttaactgctgagccatctctcctatggctggagatacatatatttaatatattgtataaatatattaataaaacatgtatt

SEQ ID NO: 550536 - DNA, 847 bp, Homo sapiens
  misc_feature (147)..(147): n is a, c, g, or t
  misc_feature (239)..(239): n is a, c, g, or t
  misc_feature (265)..(265): n is a, c, g, or t
  misc_feature (267)..(267): n is a, c, g, or t
  misc_feature (269)..(269): n is a, c, g, or t
  misc_feature (335)..(335): n is a, c, g, or t
  misc_feature (337)..(338): n is a, c, g, or t
  misc_feature (352)..(352): n is a, c, g, or t
  misc_feature (356)..(357): n is a, c, g, or t
  misc_feature (361)..(361): n is a, c, g, or t
  misc_feature (371)..(371): n is a, c, g, or t
  misc_feature (406)..(406): n is a, c, g, or t
  misc_feature (458)..(458): n is a, c, g, or t
  misc_feature (466)..(466): n is a, c, g, or t
  misc_feature (469)..(470): n is a, c, g, or t
  misc_feature (487)..(488): n is a, c, g, or t
  misc_feature (499)..(499): n is a, c, g, or t
  misc_feature (509)..(509): n is a, c, g, or t
  misc_feature (525)..(525): n is a, c, g, or t
  misc_feature (528)..(528): n is a, c, g, or t
  misc_feature (556)..(556): n is a, c, g, or t
  misc_feature (613)..(613): n is a, c, g, or t
  misc_feature (692)..(692): n is a, c, g, or t
  misc_feature (716)..(716): n is a, c, g, or t
  misc_feature (720)..(720): n is a, c, g, or t
  misc_feature (748)..(748): n is a, c, g, or t
  misc_feature (753)..(753): n is a, c, g, or t
  misc_feature (783)..(783): n is a, c, g, or t
  misc_feature (837)..(837): n is a, c, g, or t
caaatgctaataaaacctttatttaaaaaaaaaaccaaactattctttatttgatagccctgggacatggtgccctccacccaataaagcaccctccagcaaccctcccacccctcacccgatacatagacatagggacacacacanacacacacacacacacacacacacagatctggatccgtcttcacttcctgttggcctgagcagtaccaataacacactggttcaccttggangcaaagcgtagagagttgagggactngnanacgttctcttccagtggagaaatgttcacaaacatgagctttttagcactaccacccagagagttntnnagcaggtaggttantttnntgtnccggtaaggnacgtgggactccttgttgctcagggccatgataancagccccagcgtggacaggctgctgtaaatggccttttttttccgaaagttnttcccgcnccnngggggggaggggtaagnnggggtcaagtngctcactccnggccaggtccacaagnttnttgggggccccacactgcaggcctcggntggagttctccccagaaatttgtaggtggaatacactgtggctgcgtgatgaccgtncattctgggctgtgcgggccacagccgatctctggcgggccagaagaagcagggcgtccacttctttctcacaggaganagggacatatcgagcattggtganagtnagcccctcactccctggccctgcacggngaatntcacactcgcccccttgacccttccgggtnccagtggccagcaggtcccggacagtctcattgtagatctctacgtagcttgcnacaaagctgt

SEQ ID NO: 550537 - DNA, 253 bp, Homo sapiens
cttgaggaaggactgtttctgatagaccttaccttttgggacaaagtgcaggagtggacagggcacctttgctagtcatgaggggggctcttaaaccggactactgcccctttattttttgccctggcaggatgacttctcggaaccacctggtgcaaaaggggctgctggagctgtaagaaacagtggagtgcaaaggcctgaagggtctcataggtgctaacttggaggccaagcaggttctgtctacctt

SEQ ID NO: 550538 - DNA, 577 bp, Homo sapiens
tccggctcgctacctgttgggtagcaacaagagtgaaacgtcgtctcaaaaaaaaaaagtcggggcgttgagggctcacaccggtattcccagcacttggggaggccaagaaggggtgggatcacgaggtcaggagttcaagaaccagccgggcctaagagggtgaaacccggtctctactaaaaatacaaatattagcggggcttgggggctgcaccggttaattctcaactactcagaggttcgtgagtgcaggagaattgctgaaacccaggagggagaggtttacattggagccgagatggcaccacgtgcacttctagccgtgggcgacagagcaagactccatctcgaaagaaagaaagagaagggaattcccccagggaaagtaccttgggcggatttcataaacaggtaccggaaggaagcagaggcttgtggaggacttccccagctcatgcagctattggggccggggcgtcggaaattaataacttcagagtcacccctttgatgaccttagcaggggactgcagtcatctggttaaggcctctccagggcccacgtcaatgccgt

SEQ ID NO: 550539 - DNA, 405 bp, Homo sapiens
ggaaggcatcggagactcgtttggacaccgagcaaaagcgaggccctgtgagcctgctttgagcggaacacatacccgggcatcgccaccagagaacggctggcccaggccatcggcattccagagcccagggtccagatttggtttcagaatgagaggtcacgccagctgaggcagcaccggcgggaatctcggccctggcccgggatatgcggcccacaagaaggcaggcaaacgcggaccgccgtcactggctcctattccgacctgctcctctgagcctttgagaaggattgctttccaggtattgctgccagggaagagctggccagagagacggcactcctggagtccaggattcagatttggtttcagaatcgaagggccggacacaagggacaggcg

SEQ ID NO: 550540 - DNA, 277 bp, Homo sapiens
gaacctggggccttccgcgtgatacgcatgctgctgtgtatcaaagttaaatctcctcagaagccttaaaaaatttctggatatatatccagcaaaaggttttatcctaagcaagaaaaacaacataatacactcaatcttagccaaaaggccaaaaagtgatgaaaaacttcataatgaagctggcataaccatagtccagaacccaaatgtgtgcttcaaattagctgtgttctcttttaatatttaaacaataaccctgcgctaaccatgctca

SEQ ID NO: 550541 - DNA, 276 bp, Homo sapiens
  misc_feature (203)..(203): n is a, c, g, or t
  misc_feature (221)..(221): n is a, c, g, or t
  misc_feature (245)..(245): n is a, c, g, or t
caactgcttgcaaaacacatacagtttatataccattttcacctagcaccctccccctaacaacctccacctggcaacctccatttaacccaaaacaaagggcctcaatgtggccgggcgcgatggctcatgcctgtaatcccagcactttgggaggccgaggcaggcggatcacgaggtcaggagatcgagatcatcctggntaacgggggtgaaccgtncttccactaaaaacggcaaaaaanttagcctggggtttggttggggggttccttt

SEQ ID NO: 550542 - DNA, 648 bp, Homo sapiens
aagtagattaaggaacacatttacttaatatgaaacgtatataaaataaccgtcaaaaatataccacagttcacatgaaatacggtagtcaggaatataagagctctctagcacataatgatacacgagcttaagcagaatgtcgcacgaggacagagtctgagtctcgagctttccagattaacatggtcaagacagtgtctcagcataaagataagaaaattcccataactaactatcagtacagcacaggccatgcttaagatgcagtggctccacaggaatggaacagtctagttctcaggtcagctgagggcatgcaggttaggtcaggagtattccatttactcgcaatgcttcgtatttatcatgtacatgccatacatctaagtatcacaggatgaatggttttcaattgcaaatttctggtataaacgatatctgaactgaatgagaatatccaatgtagattagatcacctagattccggttatggctaaacgtaaaaacatcctatgcaatatgtaactaaggcactatacaggctgtatctcggttacattgcgataatgtatccagtaaaatgcattaaaactcgtgatcagtttagtcagataaacacaatattatatatcatgtccatagtct

SEQ ID NO: 550543 - DNA, 236 bp, Homo sapiens
  misc_feature (4)..(4): n is a, c, g, or t
ccanccgcacacataacgcactcacaccctcccctagaagcaggagaatcgcttgaacctgggaggcagaggttgcagtgagctacgtagtgtgccattgcactctatgtgagttatgagtaggaaaactccatctcaaaacacacacacacacacacacacacacacacacacacacacacacacacacctctccctctagaagcaggagcacgcgtcaaacatcggggtcacgc

SEQ ID NO: 550544 - DNA, 343 bp, Homo sapiens
  misc_feature (321)..(321): n is a, c, g, or t
ctgcagcccgcgaacagcatgccgcctccgaccaagacgcctgacgacacagcacactcaacgtgttcatgttgctggcctgtcatgggtccgcctggctcagtaccgcctttccgtcaagcagcgcaccccgtggcgacttaagcgatggtgaatctagtgcaccatgcactttcctgctagactctggcctagttcaagctgaccaatggcagaaggactgcctgaagagtaaaaactgtgtgaacaatgactgactgccagtgttttccatgtatgcataggtactaacagcagggttaggaaacctgtctctaagtnatgcattacttctgtcagaagt

SEQ ID NO: 550545 - DNA, 264 bp, Homo sapiens
ggctcggtggtgccaagacccacaacaccatgtcaggtgtggcccacagagcttttgaaaatgatgttgatgccttgtgtaatctcccggatttcttcaactaccttccccttagcaggcaaggcccggcttccgtcccttaggtccacggtttccagtgtaccgtctttggtttctgagcttttacacacattgtgcccctgtgagtcacacacaagtctcacaccaaatgtgggacataatacactctcttgtttatgatgc

SEQ ID NO: 550546 - DNA, 172 bp, Homo sapiens
  misc_feature (36)..(36): n is a, c, g, or t
  misc_feature (123)..(123): n is a, c, g, or t
  misc_feature (135)..(135): n is a, c, g, or t
  misc_feature (150)..(150): n is a, c, g, or t
  misc_feature (155)..(155): n is a, c, g, or t
  misc_feature (163)..(164): n is a, c, g, or t
atgaaaagttttcccaagaaaccacaaacgattgtncattttttctccttttttgttaactttttgccacactcaagtcagtttaagtcctagcaaaaagacggtagttaggataccactgtngctgtagatgangtgacactcgtcgantttgncccggccnntgtctact

SEQ ID NO: 550547 - DNA, 363 bp, Homo sapiens
  misc_feature (237)..(237): n is a, c, g, or t
tcaggaaggagagtggggcgggaaggggtgctgctaagaatcagtcagacacttacattctcagaggtggagcctgaggacatgctcaggcgaacaaaaagggtgttttcctgctgtttcagccagagaaagagtaagaaaagggctaagtcggccaggcacagtggctcacgcctgtaataccagcattttgtgagtgcgaggcgggcggatcacctgaggttaggagttcgagancagtctgggcaacatggtgaaaacccgtttgtactaaaaatacaaaaattaggcaggtgtagtggcacatgcctgtaatcccagccacttgggaggctgaagcaggagaatcgcttgtacccagga

SEQ ID NO: 550548 - DNA, 557 bp, Homo sapiens
ggtcgggcggcggtcggagcggcggagctgcatgggggcacgaggcgcagaggaacaatgaaaaagaagaaagaaggtgtcctgctgtttccaagcatcaaagatcattccctagagtgtccagacgttgcgcccttgaatgcatggcagcagtggcacagggtgtggcggcctagcctggtgagcggtccttgaccacccgtggagcgtaggttcaaccgtgctagagcggctgacgtgggtgtgatcgctagcagcttcgacgatcgggaacctggcgctcatcctcttcgtgatgctacttcgtgggcacagcgggcactcggcctgcgcctgatctggctgctggcggcatcgatccatgagcagctgcggcggcgcgtgcattgttcggctgctggcccggatgttgcgcatgaaccacaacacaagggtttgaatccaagacgggtttaaccctggaacggggctgtggtgctggaagaattcccgactaggggggctgcacgtatggggtcccgtcggacaggtctgctggcaaggtcagaacggtttgc

SEQ ID NO: 550549 - DNA, 203 bp, Homo sapiens
ataacacactttggaccagatgatctctaaggtcggcaagcacattgatgtgctcactggcaaggtgggtggcccagtgactgcaggcatcggggctggcgtggactcctaactttgagtacttggtgaaatggagccatccgtgcttcatggataaagaagctcagtggcacatgttccttagatgtataacacaagccatc

SEQ ID NO: 550550 - DNA, 145 bp, Homo sapiens
tggtcgctctagaggtccccctgtgggtttgcttttcatcttctttatgctcccaatgggttttgttcagaaaatacaagcatggtgacagaggcgaagttaatgtcccctggagaaagtggatggatgacttggctggatagac

SEQ ID NO: 550551 - DNA, 415 bp, Homo sapiens
  misc_feature (23)..(23): n is a, c, g, or t
  misc_feature (49)..(49): n is a, c, g, or t
  misc_feature (232)..(232): n is a, c, g, or t
ccgccttcctctgcagttaagtnaaatactactgttagccccagtggcnagaatactgcgggaccataaatccttaaaagcctagtaacatgttgttccttcctaggaattcccattcagcctacagatttaaggtttatcagtagtatttcccagaaagatggtccgacacagtggctcacgtttataatcccagcactttgggaggccgaggtgggtgaattgcttgagncccaggagttcaagaccagcctgggcaacatggcaaaaccctgtctttgcctgtagtacccccagctatttgagaggctgaggtggaagaatcacctgagcctggggaggtcagggctgcagtgtgctgaaattgcacaactgcactccagcctgggcaatcagagtgagaccctgtctttaa

SEQ ID NO: 550552 - DNA, 218 bp, Homo sapiens
gcgagagagggaggtggcttgatctagggcccgctgaaagaatagggtaataccactgaggaatcgcacttgttgaggtcctcacaactactcgatatcctacggcgccaacaccgacactcaacgtcttgggctgagagcatgcggaagatagtgagagaatggagctcccatgtgtggcactcgatatctatcttggcagtcgctcgtcatttgat

SEQ ID NO: 550553 - DNA, 884 bp, Homo sapiens
accccagagagccctagcagccccacctgcctgccgcctggcctagttaccatcacacccctgtggatggagcctgcagctgcctgcagccgtgccccagtcaccattcacctgcaaccaatgatgcatgctgatggcctgatgacccatgcatgcctgtcctggctagcctctccctgacttgccagctgcctcatcatgctgcggaggatatcaatggggctggaagtagaaggagcaggtggaagcattgggaagctggttggctcaccgggaagcgcgagccgtctagaattcaggatgagcgccctttgactagagagagatagaaaagagaaatgagtccagtgagcgagagcgagaaaacaggtatctatcgagagaagcagagaagagatagatagagttacagaagtggtaaaatggagaaagcaagagagtatagggattaatcaagttcgaagtcaaagagaagagtagtaagaagacacataggggaagaagatttaggatagatatagaggtaacaatcacagagaataattggagccagataaaagagagagtacagattaaagaagagctaaagagaaaagagataacacgataatcaagtcagagagagataacgcgaagaatttagagaaagaatgaagaagtaggtacaacggagaataagtagaaacagataaggataaataaagagagagacaacaagaatgtatgattagtagcagagagaggcaagagcgagtagaagtaagtattgagagagagagagcccatgtaggaaaggcagatgtagaacgaagaatacaagacaggggaaggagagaggagagagacatagaaagggaaatgagaggtaggagaagaagaagtcg

SEQ ID NO: 550554 - DNA, 121 bp, Homo sapiens
cacaatctgcttagcccgagtgacagcctcaccatacatcttgctgctttcaggaccacagtcctagcccatccagccagcaggtatgccagaagccatagtggcttggccagtcttggca

SEQ ID NO: 550555 - DNA, 674 bp, Homo sapiens
ctctctctctctctctctctctctctctctctctctctctctctctctctctctctctctctctctctctctctctctctctcgtatagattgagcggatagaaacaagaagatgtggcaagagttatatgagagaatacacgaggaggcaaaatgatatagatatttaaagcgcttctgcggtgtttttgttttttaaaagcaactgcggttgtgcagagccactctttcctacccaaaaaagacgagttctgaacaagacaagactgtcatattgtagagaccttggtgtgtgagaccataaaacacagagtggataggcaccctagtgacttaccaatactgacgagaagagaactcttaatactgagagatattaaaaagcacatatatactccttgcatggaaaagcaaaacaaatgcaaagggggagggcggataatttcagaagccaccgcataggaaagggtgaacatgggctcaaccctctaactctttacggggggagaagaccaacctacacccgtaaaattaataaagggtgaaagagagcaaaaaatggcgcacctataaaaaagggggtttgtactgaaaaagttttgaagagtttcaagggccccctatatttaaaaaagggagagccccgggggttatgtgatgggacaccgggccgg

SEQ ID NO: 550556 - DNA, 1477 bp, Homo sapiens
  misc_feature (1130)..(1130): n is a, c, g, or t
ttgccggcgtgcgaagacattgccgccccgccccatgatgaggactcttctttggtgggagtctgagtgaagctgtgtcttgttcactcgggggggcaaccacaacttgagggggggcgcgtattacaagagcatgtcgccaaagaagaaagagtgtgttgttagctcgtgtcatcaaacaggagagttgtttcgcgtctgtcctgtggcagcgcaagcccggtctgctggtcgctggggtgtgaaccaccgctcctgacgtgattgtggttggtccccccccccgccccagaattgtgggtaatgtgccgcattggcttggggcggctgttttgcacacgggtggggtgttaccacggaggtgggagtgttaagttccgtcctggagagcccccacttcgctccaggggcgcgcgaaatatatgcggggtccccggggtcttaattggcccccccctcgttgaagattggggaagttgggcgcacaccaacgggggcgttacgaaccacttgtggccaacaggcccacacgagtgttttgctccttggaaagtccttgtatatagggacgacaacagagagcttgttgtagattcgccccccgcctgttatctcggggttgactacaagagaagagccctcgggaagaaagagctggggcgcgccctcagaaaatgttctcctctcgaagagagatttctcgggctggaagagtcgcgtggggcacacatcctgcttagaaataatatcggtttctccctcgtgccacaaggcggcccaacatgtgtggtggctctgagagagaggctttttctccacgagactatttgcccaccccctctttgtggtgtcgctcgtctttgggcgtcgtgtgtcgctcgagataatatgagagagccacagagccacgcgtttgtcgcgcgcttggggctgtgtgtcactctcaacatcatccccacagtgtgggacccacacagagagaggcctctgtctctggagagcctctggcgcacacaggtgcacacgcacacagttcttctgcccccacagaatataaggctctcacagagagaggcgttataatatgagatattatagttccgctcataatatacctcgcgcacaccccnacacttcttataaatccacagctgggtggtaaagaaccgcgttctccacgaacactcgtttgtgttccacacattgccacacatcttataagtgttatagtgagagtataaaagagactcgggtgtatattgaataaccacattgcacttcgtaaaaccctctcacgaaaggaaaaggaagaaatgttttgtggagccacctcttggttttacttttttgggctgtggcacgctctttaaagttatattatagtttttataaaatcacgtactttttaatggaaaccaacttgacccaaaatcttgtcaccagaattttgagaccccctttaaaaagttaaatgaga

SEQ ID NO: 550557 - DNA, 272 bp, Homo sapiens
  misc_feature (214)..(214): n is a, c, g, or t
cgtaaaaacctcactggaacgagttgaaacgttggactcaatgcttgcttttttttttttgggggtataattggtaattttccaaacctgattcagggctcactcatctctctatgttaaggacaccctttgcaaacttgacaaatataatcaggtcactgttcccctttcagatctttctgctgacccctctttcacccactgccagtcaggncattccttcattctacttcgggagttctgcatgaagactctcccttcctttcctttgc

SEQ ID NO: 550558 - DNA, 464 bp, Homo sapiens
  misc_feature (17)..(17): n is a, c, g, or t
  misc_feature (172)..(172): n is a, c, g, or t
  misc_feature (176)..(176): n is a, c, g, or t
  misc_feature (218)..(218): n is a, c, g, or t
  misc_feature (402)..(402): n is a, c, g, or t
actttccaagtaatggngctgaaaccattatcctttattaaaatccggcttctaataaaagaagtaaagctttaaaagcttcagcgcctgctcctggtcatcactaaccagatttacttggagtacatgtgaaagaaaacgtcagtcttcctgtaaatttcagcggcgcggnttanatggggagcgtggaacatcaataaacacttaaataagtaccntttacttcatggcatgaataaatggatctgtgagacccactgctacctggtactactttcagtatgttccccctcagcccctccagcttgtgaagcatactctgagtagataatttgtcatgcatgccatcaattaaaattctcctaagcccccatcattgtgaaaaattacctcagtttccangacttggtgatcaagatccctgccctcactttattttctgcttattaaactttattaaactt

SEQ ID NO: 550559 - DNA, 468 bp, Homo sapiens
tgagggcagttcccaccctgttctagaatgctgtttgtgaagaggaatgactgaaaatctgaacaaaggaggattatgttgcagaggctcaaacatgtcacgtgaggaatggttaaagaagctggagaaattaagccagagaagaaaagacccaggagaaaagcagcaggtagtgatgataactgttttctcaagtaagagacgggctctcaggaggaagaggaactgatttcctttgtgtggcctcagttggtggtaacctcagtagaattttcagttaccttccaaaaggagagacgtgacctgccttttcatccctttaaacagtaaataaaacgtacactaacagcagtactcccactgggagtaccacttacaagtgaatactgcaggcgactgccagctaaagagactctctccttcctggaaaattaggagaccaatgtcctgaccaatgtggaagcatgc

SEQ ID NO: 550560 - DNA, 128 bp, Homo sapiens
tgatgtcgcgtgcatgtaggttgtcaaaatgcggaccagtctgtcgcagtgtcaagtggcgggaaggcacatcatgatgggcgaggtttgttatgtggttagcatggtggtggacatggcacgcgaca

SEQ ID NO: 550561 - DNA, 1318 bp, Homo sapiens
ggtggagagggaggcattctcattaacagtgcaaggtcgaaaggtttcatggagcgatacgcccctgtctgcgaatggacctggctgtctagagattgtggtgatcttcggtcgatgacttcgtggatgaatccgaggacacggaagaggctgtgggcctgagaaagaatcatgtcatacctatggagtgatggactcgagcgtacctccagagccaggtggacaacagcgtcgcgtgacctgtgtcatttacagcagactaggggcagtgactccttacgtcatgggtcggctaggagcgctcgactggaacggacgcctgagtacctctgtcgcgtccaccaagccgggtaggcaatgtactagacgagtggcggcgggacaatatgcgccagccgagaacgtaccaaggagggcgaggatccctgaagagcgaacgtgaactgggccagggaatcaggagtagtggcccggtccgtggtacgccatgtgagggaggccggccgtggtggcctcgagtgacatggtgtccaagccgcctcggggcgaaagctcgcttctttgggacctggtatgtctcttaggtcgggcatgtgcccatgagcagtcgaagagatcatgcaggccgtggagcataagagtcccatccaaattacaaccaggaacgcgtggggaacgaatctcgtcatgaatctgtgacaatatgcgcgaatttgctgattggaagcataagacacatcggaacatgcgactcaggcgatgccagaaggtcagatgccaatatcagtgcatggacgtgtacggggatgggacagcggtggtcgcaagaaaggtcgaggggaaaacccagaaagcgcatatggagaccttagaggcaccgaagaggctcgaccggggaatggcccggacgacacaactggtggagaccccggaacgcgagcaacctgagtctgtgcacgtgccagaaacaaccaacggaggacaagacacggcacgagtgaaggggaccgcacgcaaacgaaaacaaaaggaggacagaaagaagcaaacaaacagagaaagacaaccaaaggaggacacagaaatggcgcctagcggaccacggaggaggagcaacggatacgggagaaacagacaaccgggagataccaggagaaatagaacgacaacacaacgagaggaggcaatggaaacagaacaacacaccagaggaaaagacggcgaccacgcacaatacgacaggcagaacagacaccacagcaaacaaaagcgaaacagaggcatcaaaacaatagacctacaggtgagacacagaaaa

SEQ ID NO: 550562 - DNA, 137 bp, Homo sapiens
gttagaaaagcttaattagatacggtggacgtgttatacaatattttataacacaaagctaatgaatgaaataataaaaagatatcaatggattagcatatcaacagagttgcatgacatcagagaaactggtttag

SEQ ID NO: 550563 - DNA, 1025 bp, Homo sapiens
ggaaagaagaggaaaccagaggaagagagtccccggacaagatgatgcaaagaaagccaaacaagagccggaggtgaacggaggcagtggggatgctgtccccagtggaaatgaagtttcggaaaacatggaggaggaggctgagaatcaggctgaaagccgggcagcagtggaggggacagtggaggctggagctacagttgaaagcactgcatgttaagagggggcacagccctcctcccaagggaaagtgtatcgtatatcatgtattttttcactataaggaggattctctaggtataacttcaataaagattgtaagcaaaggttgaggctttgatggtctaattcttaattattggctgaatctgccttggagcactgctggtatacatatacttagccaaagggtaaaggaactgggccctactggtactgaatctgtgttccctgatcctaattcctatctgtctaacgtggaggttgatcaagtggaggactggaagggacttaggacggtccaaattggtagcaatattccaggtattccaaacaacttcaaacttgaaccccaagctggtcttggcaaactttcaagtggatgctagaccccctggaatggggggatatcacaaaaacgagcaaattggatgaaaagactccttgagccctatcagagcgcgtggaaatgtgatgtacatggaaccttttggcgtgtagtaaagccaaggcctctagagtgggttcttgtcccattatatcagcctatagttattaagcagtagggccagtaagacatgtgcccgtggcgataaggagatccttgtacaacacctgtgggtcacagaggaaaagtagtatcctatacggaacgacggggctagagcttataagaaccactgggatcgtcagaatggtccaaaggggagaagaagggagtggagaccacgagtatggttatagaacaccttatatggtagagatagtgctaaaggcaacgagtagacaatcatgtatcaagcggt

SEQ ID NO: 550564 - DNA, 215 bp, Homo sapiens
gataagcttctcgggtcttaattgtgtgtgtctcacgaaagaagcaagattagtatcctggctaattagactagtatctgtctctactgcttagtaaattattcatttcaacccagatctcttattcatgtcttgaacctctcttttatttattttggattgagtaaaagaccttcaggaccctggcaaaatcctgaaataatatcctgagctca

SEQ ID NO: 550565 - DNA, 118 bp, Homo sapiens
ggcagtcgagagtggacgggagcggcgggggcgtgttggcgcgcgcgcgcgcgtgtggtgtcctgtcggagtggctggcggcggacgggggtgtggggtccttcccaaacgcaagaag

SEQ ID NO: 550566 - DNA, 941 bp, Homo sapiens
gctgagacagggaatttgcaactaggtgactcagctagtgcaaagtaggtacgtagcaatactaatagaataacaacaaaccgggttaggatcagtgagtgcgatctctaaactacatacaggccacagaggtgtgcgacaccgaggcggtgctgaactgatgcgtataattcaattatctaggtcttataaggtatttacttcctattcgtactagaggcgagaatttggcgcagtaagacaactaatgagggggggggtctccgtcccatataatgtctaaccatttattatcaaaaggcttctatgacgtcgtatcgtctatgcattagcggttaaggcaacattggttgccacctttttagattcagttggtgagataataaacaatatgaagcacacatctggttcggaaagattcatactttctagtgcgaagtttggttaacctaattgaacttctctgcatattcccagattgcctgttgtggcctaagaatggggaaggatgaatgtgtgttgatgaatacagggaggggagaaagaggttaatacctgatcctttattgggaatgactcgtgggatttataagtggataggattttcctgggtcatgcattctttatgttgcagatatggtcttaatttctaaatatcagagagcgtggtggccgtactagtgatctggggggctcaaggcactgcaagggccagtgtggggacgtacggcaggcacgtagtatgtaaggatcaaccgtttgatcaagaaccgggcagcacgcatcaatcttcccaagtacacacagcgttcctacttcgggtgggggatggactcaagattggacgtgggcgcagttcccacacaagggacaatccaccaggaaggccagtccccagcctgagaagaagccactccgggagggctacaaaaaaacacaag

SEQ ID NO: 550567 - DNA, 796 bp, Homo sapiens
cggctgcgtcgggctggagcgagaagatgggggctctccacagagagtatacagttcctcgtaattcgcgcttgtggtaagagcttgtgaggatggacaaaactggatgtaggagacgttgacagtatagcgtgggcgcttggacgatgatggaagatatgacatttacaaggtggaccaggcaggtgattattgggccacacaaggagcgaatattatgaaagcatgaatatatagcctgaagagtagaatgtggacctaaataccgcagaagctcctccgtcagttagatttgtacgaagaattaatatgaaggaataaataattccagtgggatggtggagtgcccggaggatacagtgtgagcaaaaactggcagaattcatatagtcgattaaagttgtacttcaggagctaagacgttactgatgtccaaggaatatatgaagtttccatagtcagcagaaggacaagaatagcaacaataagtccagtggatctcaaactttgtcttaaatcaatgaacctgtctactctgtgttgccgtgtcttgccttaacatatcaccaagtggaaaatacacataagtaaactgaattccagctggtaagacatgaccctgacattgtgagaatatattactcattatggtgctcccattattgttgcaagggacaccggaggcaacatgcagcaccattttttcctctcgaaaggcctgcatttaaccattacctggggactcgcaatacaatcccgggtccaagcatccaacgggtgcaaatgcaaatgcgcg

SEQ ID NO: 550568 - DNA, 229 bp, Homo sapiens
gactagaggatccactgactttggacgcgcactgggaggttgcaggcgcccaggcagtcaagtcccctgctggcagagctggctttgacaaagtcagctactcagtgccaatcagccctgcacattcagcaggagacaggcgtgatgagctatggggccacaaccagcaatcagaggtggggaagaggccatggggcagagagccctgcataccaatgagggccttcca

SEQ ID NO: 550569 - DNA, 394 bp, Homo sapiens
cggcacgaggggctcatccacagtggcaatcttttgttttatgagaaccccccccctgattaccagattttagggggttcagtccgtcccctggtgttggttttaaaaggaggaggtggttttagacagggatggacccccccttttccctctttaccctgtcgcttttaatgaggcctcgtatatcctctctctttttgggaccccatagcccctgccccctcccctggatgcccggtaatgtatgtctactggtgggagactgtttggctccccggtttttttttttctggccccgagggccctttctggccactgggtgtttgtttccagtcctgtgggcttccctcttttaaaaatgtgtccctggttgtcaataaaatatttcctggca

SEQ ID NO: 550570 - DNA, 246 bp, Homo sapiens
tgtcgtttgtgtacagttgctgcctgggtgacctctggcccctgtgtttcagcgattctctcgtctcagtctctcaggtagctgggattactggcacagaccaccatgggcaggctcatgatttggtatttgacgtcgagacgagaattcaccatattggccaggttggccctcgaactcaccatatagggctcaggtgatccgccctgttcggcctcccaaagtgtcgtgactttgggcgtgacc

SEQ ID NO: 550571 - DNA, 711 bp, Homo sapiens
tctacaggatatctcttaacgccccaaactccactatggccaagaccaaagagctgtcataggacaccagaaacaaaatgtagacctgcaccaggctggaaagactgaatctgcaataggtaagcagcttggtttgaagaaatttactgtgggagcaattattaggaaatggaagacatacaagaccactgataatctccctcgaatctggggctccacgcaagatctcaccccgtggggtcaaaatgatcacaagaatggcgagcaaaaatcccagaaccacacgaggggacatagtgaatgaatgacctgcagagagctgggaccaaagtaacaaagcctactatcagtggctgactaaataattttttgccccactgtacctgtatatctctttacaattctatggtgtcttagcctggcccccagatctgctgtctagccaactcctactgtattgtcatagtcaagccaagcaacaatgtccatctgacaaaaacaataggagttggcaagatggcacaaacaaaccgggcaccaagttacccgtatctggtccaggtcaaagtatcaataagacaacatcacgttactcacttgtcgactattactcctggcggatgttttgctagaagatgaagtaggggggtgctggcatctcactctgtcaatagaggcagagaatggcccagggagggggggctgaagaaa

SEQ ID NO: 550572 - DNA, 216 bp, Homo sapiens
gacagtctggtcttcagtggtccaaagtgagcccctcacaacaggagacacttcagagatggtctgtccccagccacgcactcatgattgctttttatgcagaagtcatggtctgctgagtgccctgggtttggccaaaatgcacatgctgccagcagcagcacatgttcttggtatggtgtgggccactgtgctgaccctggcccccagatgcta

SEQ ID NO: 550573 - DNA, 436 bp, Homo sapiens
gatgcttaagtcctttgcataaaatggtgtatttgcaaataacccacacacatcttcttgcatgctttaaatcatctctagtttataatacctaatacaatctatatagttgtattgtctttttatgcgtattttaaaactgtattctattttaattttttccaaatatttttgatctatggttagctgaaactgaggatgcaaactggatatagaggaccaatttttgcgtgaaaagggcagagtcgcaccttatagttttatcctgcaccgtcagactctacacctgtgttctactgtatgccagccagccagcacaccagcaccataaggctttccgtcaaactcaaagcataacaaaatactgcggtctttgaaaaaaatattaaccatttctttacaacaaaaaggtcaacttctgagatgcttcttcctc

SEQ ID NO: 550574 - DNA, 197 bp, Homo sapiens
aaaaaaagggggaccccttttttcttgatggtgggccaagaggcccctgccgttggcttttacacaaaagaccttcgcccgtttggggggtaaaccacacccatgtcaatgtgtttgttttcatgggggaggtggagggcccctgttattgagccgcccgcctgtccccacccttgaataaattccatgttccccca

SEQ ID NO: 550575 - DNA, 250 bp, Homo sapiens
tcaacatgcttgcaactgagagtagctcctccttttctatctgagactcttcctcctccacatcacagcagcgaacacagctccagtgatcacatgctccaaagagaaccagtgccagcaatgatgcccacgatggtgatggtgggctgggaagacggctcccatctcagggtgaggggcttgggcaaaccctcatgctgcacatggcaggtgtatctctgctcctgtccagaaggcaccaacaccactg

SEQ ID NO: 550576 - DNA, 104 bp, Homo sapiens
tgggacctgtatttgatatttgtgatcagtgatcattgtacactgcgaaatagagtgtttgcttttgatatggacaattgtattcgttttaaaatccccggtcg

SEQ ID NO: 550577 - DNA, 255 bp, Homo sapiens
gggggccccccccccccccttttttggggttaaaaaggggggggggggccatcccccccccccgggggggggggggggggggcccctttccccccccccctaaaatgtttttttttttggggggggggggggccccccccccaaagggggggggttttttttttttggggttttttttcccccgggggggggggggcccccccccctttttttttccttttttttcccccggtaaaaaggcccccgggtttttta

SEQ ID NO: 550578 - DNA, 268 bp, Homo sapiens
aaatgacctatatccccataggaactgaaactcagtctaggtccagctgcagatggggagtcctctctttaattgctaaccatcctgcgccattatagctacactcaggagtgctcatcggacaagtcagttggcctgatcttctcttgcagtgtccctgaatggcaagtggggtaccttctgatgcagtctgcattcctgcactgctttctcggctcgcgttgtccttcttttgttctgttgaataaagcatattgagaagtgggga

SEQ ID NO: 550579 - DNA, 106 bp, Homo sapiens
ttcgattggcgggcactattaggcttgaactgctgggtgctaggatgacgtggcgtgaagagtctttcactgtggtaccgagcacacataaccaatgcttgaggta

SEQ ID NO: 550580 - DNA, 170 bp, Homo sapiens
tgggctctgcctcctgcaggagcatgcttatgggacaccgcttctgcgcgtctcttaacgctgctgtctgcgccgccacccctgtatacccggcaccgcatgctcggtccatagtccgttccgcccccaaaacgatcccgtcagcagactcatcgcaccgccccgaagga

SEQ ID NO: 550581 - DNA, 253 bp, Homo sapiens
tcagctaattttttgtatctttagtagagacggggtttcaccatgccagccaggacggtctcaatctcgtgacctcgtgatccacccgcctcggcctcccaaagtgctgggattctacaggcgtgagccaccgcacccagacaagtataaaaagaatcttaaggaagatagttcttagccactttccacgattttaagaacagataaaaataaatagctaattataataaaaagaagtatcagaactcaacca

SEQ ID NO: 550582 - DNA, 173 bp, Homo sapiens
ccggctcggtaccaggaaagtttatagggtcctgctgaagggtgctacgttggaatgaggtcattgtgcccgcaggttgtttgtgattagctgtttctaacaattgttcatacaataattgttcattattgttctcaacttggggctctccccaacctggggacccttcctta

SEQ ID NO: 550583 - DNA, 980 bp, Homo sapiens
ctgccaggttttttcattatatttgaagttatttattttacaacaatgggcgaaagatatggtctttaggataaggcagagaaacagatgtgcagactatccacggtgacccgggggagtggtgggtgtggacacatggttcggcaatctgattctcctgaattctcccagtcaggctcttgtggggaggcctgtggatggggggattgaactatttggaaacaaatgattctctatctcaggtgagaaagctggtcggaaacaaagggctggtcagctgattctaggccagcgaaaccaggaagctcttagaatcccaggcggacacccttgtgtcaaaagatatcccctaagagtcctttctgctttcttcacagatagatttgatgtaaaatgcagagtgggactacacgatttcttgccactccacaagtctgtcatcctagtatagatcatggtggtttccctcaagtgttatgttctcatgccctcaagtctgtaaattttgtctccagaaaaaccctcccaggatcccataccagtatcgttcctcatcactgtccatgtaccatgcagccatatggggggccgtgtgacacccaaaaccgtgagcttcagactttaaaactcatggggaggggccttcagagcagagttcacaggcgggtggtgctacatagaaagcttagtgtacaagtgtagaatcatttaggcagagactaattctagttcatggccatgtgatactgatgccagattagtgaacagcatggtccacatttaaaaagtgttcccagtggtctgcaatagagtcaggggctctccagtggggggccccttgaagaggggtggtcacgagccactggttcgaacgggaccctaggcacttggtcggggcccaggggagggggtgttccccaaagatggggagaagtggggatggggacaagggggggggtggctctctctcttacttcagc

SEQ ID NO: 550584 - DNA, 161 bp, Homo sapiens
ccggaccaccttacgaggctggacctcacacgagtgagagatggacaaggcatgctttgcagagagcacacgtgcttaggcttattaccaccaatatctaagggtcctctaaaattaatggactctccgtgctatacctgccaatctccctcgttaagctt

SEQ ID NO: 550585 - DNA, 369 bp, Homo sapiens
cccgggcataaatacactcttctaaagttgtatatacatatgcacattacatacattttaatttattgacaaaattaaccaaattaagatttggagatgtgggatgttcttgttttaaaatagcatgtttgaaaccatcagtttgtgtctaaaattagctgtagcacatggatgttgtccatattaagttattcgttgtattgatttatagaggtatacagaatttgtgttggcattattattttgttatcaaaagactacatattatctggatggctgataaactagatcttgtgtatatttgatctggtctgatttaaatcagactatagtgcatagagtaagttccgaagttcaaccgtctttccc

SEQ ID NO: 550586 - DNA, 105 bp, Homo sapiens
tagtatgcgaactgttcataccacgcgaagggagcgcccgtcggccccagctcgaagccatgcatccactgcaggatgtgagacccggcctcgctctgatggtag

SEQ ID NO: 550587 - DNA, 688 bp, Homo sapiens
  misc_feature (417)..(417): n is a, c, g, or t
gatggagaactagtctcgacgttggaacacttatacctattatctggcgcatgagagcgggagtcctaggcactggtctgggcctccttatcgaggccgagctgggccgaggcccaggggcgagagcgcgtgtctacgagtaactgacacaatcgaggagggtaaatcggtcgccatgcccccatggcgatatctgtagagtaatcgttcgttcgagcctattaaatatacgcccccgagtacgtcgcttttacaacgtaattgccctcagcgacgccaaacttacaagagcatgagttgacaaacgagtaaacaacgtgaagcaaagcgtagtccgttccccatacgaaggcgagagaaggcccccccacgtgaaaacacggaacttgaaacacagagtttaataaaagagaaaancccttgaaggaaaacccaaaaagaattggagagacgcggaaaaaaattctctggtatccgcctttccaattttccaacttttggcccccccgcaaaaggaaaatgcgccttaaaggggacgcttaaaagcccgggccgggcgaaggttcaccttggagttaccattatcctaaatagataccccccccctttctttaatttggagtcccccccgcaaacatttcccgagaaaataattcttccaattcaaaacaaaagcccggaagttaaa

SEQ ID NO: 550588 - DNA, 559 bp, Homo sapiens
  misc_feature (336)..(336): n is a, c, g, or t
tcggtcaaccagtgctggagtgcagtggcacaatcttggctcactgtagtgtagacttcccaggctcaagggatttctcccaccccagactcccaagtagctggaactacgggtgtgcaccaccaccacacctggctaatgtctcttttttttggtagacacagagtctcactatttagcactgattggtctccaactcctggcctcaagcgatcctcctgcctaggcttcccaaattgctgggattacaggcatgagccacaatgcctggcctctgctagttccgtattctctagagttgtctttactttgtgctagtgtgtccctcattgtgcngatcctctgtctcaaaaaaaaaaaaaaaatccagaatgactacagtgttaagctacggtggctcacacccaacatggtgaaaccccgtctctactaaaaatacaaaaattagctggatcgctagtgcacgcctgtaatcccagctactggggagcctgaggcaggagaatggcttgaacccaggaggtggaggttgcagtgagccaagatcacgccatagcac

SEQ ID NO: 550589 - DNA, 703 bp, Homo sapiens
tgtaaaactctgcttaggcgtgactgtttggaattccagccctgggaccgggcaggttgttgcatcacctgataatgatgaaattatctttaccattatgttcttacaaaggcttgaaactttgacttgcacattttagacatcgctttaagcagcaggattaaagcattgtcatctcgttacacctgacttaacgtggcagttcagttaaccctataccagtctttaagtttttggctgcattagcgtttacagtactttccacagcatttttatgggcggaactggtttgttcatcaaggagaagcagctcttctagtgaaagctgcaactccagttccctgaatgaagtagaaactgcactgaggcttcaacttagccgtgtgagcaatgatctggcctctagcaggctgtgtagatagtcacatgttttatgaaatttccctcagggattcccggggcatctgggctgtgcctcctggcacagagggcttccaagaggagctgtgttggatctgcagcctccctgcagggctgggctcacaaccaagccaggtctccccgctgggacaagggatccagagcccagtttctgaccccagtctgcaggtatctgccgtattcagttgagctgtgtaccaggtggaagagcggccaggccaccttactggcctgttaagttggaattccctatgggagttcc

SEQ ID NO: 550590 - DNA, 1218 bp, Homo sapiens
  misc_feature (698)..(698): n is a, c, g, or t
  misc_feature (989)..(989): n is a, c, g, or t
  misc_feature (1218)..(1218): n is a, c, g, or t
cttattaaacagatctgaaagccacaggggtgacagacagatttgaaatcacatcccagctgtgcaaaatatcgtctggaccatctccaaagccactaccttgctgatccttgagtttctcatctttcacaagggtagtgtggtcgtttgtatatgcatgatccagggagtggcgctatgaggaggtgtgtcctttttggagtagatgtggctttgctgaagtaggtgtaaccttgttagagcaggtgtgtcactgtgggcatgggctttaaggctgtcatcctagctgcctggaagccagtattctgctagcagccttcagatgaagatgtagaactctcagctcctcttgtaccattcctacctgaatgttgtcatgttcctacctggatgataatggactgaacctctgaacctgtaagccagccccaattaaatgttgtccttataagagttgactcggtcttggtatctgttcacagcagtaaaaccctaactaagacaggtagactcatgaccagatacagcactcagaggacttgaactagcagagcgggcgaggggtgcacctcacccaaggtgtacatctaataaatgatgctaacattaacatttttaagaccgactcctttattatctctgccaaaatgattacaggaaggtccggttgggcctggctaagagttcaagcaaccatnccgccggaggcaggttaccggtgagccgagaagggatatccagagccggggggcacacactccgagacacaggggccctggagccctaaaggacaagtcacacagtgttgttgtgttacccggaaaatgggggcagaagtggggaacctacccgcaaggcgtgaaccggagggaaacaccgagcctaagagagaaagatatatcactgcgaggggaaaaaaaggacgagccaaagcaaaaaacaaactaaagtgcgcacgcacgacagcagggggagaacatcgagcgacncgaaccgacgcgaagcaaacacaaaaaaaaggtgctgaacagagagggacacacacacaagagaggagaggacaacgagacgggcgcaacagacaacatacgacgaacgagcaggcataaagacacaacacgaaggatacaacacaaaatacgtgaacatgtacgagaggagacgagaccaccaaacagtgagagcgacaaacagagcaagccacaacgacacgtagan

SEQ ID NO: 550591 - DNA, 218 bp, Homo sapiens
acactgctgatggatttttgactaagacaggctgagggctctttccaggctagtgaggtccactgtaacatacatgcacacagaacacacactcatgcgcagcacatacataaacacagcgtcaactagcacacaaacagcgcaaactgctacaagtaacacacgaaaagcacagaaggagacagcacaacaaagaaacacaacacgaaacacaacag

SEQ ID NO: 550592 - DNA, 309 bp, Homo sapiens
  misc_feature (35)..(35): n is a, c, g, or t
  misc_feature (55)..(55): n is a, c, g, or t
  misc_feature (76)..(76): n is a, c, g, or t
  misc_feature (91)..(92): n is a, c, g, or t
  misc_feature (173)..(173): n is a, c, g, or t
  misc_feature (254)..(254): n is a, c, g, or t
gtcattaaagtataatcctgttgttatcgattttnagatgcagcctatccacgangtgctgcggcaacaagcctgngccatctggaggcanngcgccagaacctgcgccgcgccttggaccagtatctgatggaattcaatgcctgccgatgtgggccttgcttcaacaatgnggtgcccatcctcgagggcacagctgcaggtgcagtcccgcctgggtagcttgggtgctgcctgtgagcaaacacagacangaaggagccaaagcagatgggagctggagttgctggagctcctggtctgtatgca

SEQ ID NO: 550593 - DNA, 668 bp, Homo sapiens
  misc_feature (28)..(28): n is a, c, g, or t
aaaaggctgatagctggtatcacatagntggagtcagtgcataattccacgtggctttttttttttgggcacgggggacggatcaggaagatatattccggcataactcaatctgaaccagggatggtagttagttttcctcctggccttcccttcggtgtgaccgacccctgggccaaaaaaaaaacaaaaagcaaaaaacaaaaacctacccggtccgggttttttccctcccttaagtcccaccccaaaccccaatccccgggtggccttctatagagatgagaaaaaataataagggaaacatctttcatacgccactataaaataaggagaacctggatatactataatttttctcccttttcaaaggatggacttataaaacccctggaaatttatataggtggagacaatagaattaaaaagatcttcagccaggcctttctggagggagtaatccggctaaaaatgggtctaagtggtctgaaaagccagctctggaccctcttcacaacagtatcaccaggggctcccccgggtccatttaatgcgtgcaaaaagtcaggggtaccggcggcggggctaaatacataaggggtaccggctttaaaaaccaaagatggtaggcctgtgtgtgccctggttggcttcaccagtatatccta

SEQ ID NO: 550594 - DNA, 278 bp, Homo sapiens
ccccagtcttgtctcatgtagagtgaagatagctcacaccctcatttatctggccagttaatgaggctgactgctgctgcaaactgtgtgtgtgctttactatgttacaaattcaacatactaggtcattactttggttaaagaaaaacagaagtatatggtagaaagaagaccgatcacacggtctcagtggtaccacttcctagtgaaatgatcttgggccaggttcctcgctgtgtgacaattttcgtcatcattcaaatgggtaccaaagtttt

SEQ ID NO: 550595 - DNA, 107 bp, Homo sapiens
atgggagatgtcgaggtacacggcaggtctaagagaatgcaacagggctcagatgatgataattaagagtagccaacattaaagttaattttaaaaaatacaggtta

SEQ ID NO: 550596 - DNA, 750 bp, Homo sapiens
  misc_feature (394)..(394): n is a, c, g, or t
tcccatctctcaagcacgataacaagagtgaggataggttgagcccaggattgcgagaactgactgcgtaatgtctcgagaccccgtcttccctctgaaccaaacacatgtacctcagttcattgtctagagagccatatgagctcacagatgcctgcacatttaccccagtaggccctgaagtgtgggccccgtaccctctgtgcccagcggagttacggcgcctgctctagctcctcctgctttcacctatcccgcttcatgcatgcccagggtgttctctcctgaggctaagcccaacacacctgtcttttgtccacttctccaggcggaacattagattgggtgctctgggaagtgtgttgtaacataccaacctacttgcaagagcagncaagagggagctcccatgttgaattgttgttagctattttcccccctttcacaaaaactatttcttgacgacccttgagagaatttcaataaacaactttaactcagagcagaccatgacaaaaacacaacgccccacacaaacaaacaacttggccgcccccctcggccctcgggaagcctttcgcaaccacccgttgggcccgcggccccagtgttatcgtgacagggccatcggcggtccaaaagaaaccggcgcgaaaggcgtggctcccaccataaaaaggcgggggaacggcagctccgaacacatctgcatgggtcggggcatacgggcctcacgggcacggccctaaa

SEQ ID NO: 550597 - DNA, 384 bp, Homo sapiens
gagacgtacctctaacattccgacacgccagcttagatgacgcagaaagcggggggctaaccatactgtaggcacagagaagcgaaaacagagaggaatgagaagaagcagcagatggggcaagagtaacgtgagaagatagaggcaggaactggcaggacatctggcaaggatgttctggagctggagggacaaatatactcataccccaatgctacacaaccagaaagtaaggtgtactacttgaaaatgaaaggagatcatttcatttatctttcctgaagtggcatctggagacaacaaacaaaccactgtgtcgaacctcccagcaggctaaccaggaagcctttgaaattagtcagaaagaaatgagatgtcggacgg

SEQ ID NO: 550598 - DNA, 429 bp, Homo sapiens
  misc_feature (27)..(27): n is a, c, g, or t
  misc_feature (46)..(46): n is a, c, g, or t
  misc_feature (64)..(64): n is a, c, g, or t
  misc_feature (73)..(73): n is a, c, g, or t
  misc_feature (95)..(95): n is a, c, g, or t
  misc_feature (104)..(104): n is a, c, g, or t
cacaggcaagtccctaaagttaccttncccccggtttccagagganagatgggaatttgatganccttataanaaacctgtactctttggcccanacacggtgnctcatccctgtcattcccagcactttgggagacccaaggcgggcagatcacctgaggtcatgagttcgagatcaccctgggcaacatgctgaaaccccatctctactaaaaatacaaaaatcagccaggcatggtggcgcatgcttgtagtcccagcgacttgagaggctgagggatgagaatcacttgaacccgagaggcaggggttgcagtgagtgcggtggcagctgggacattaaccaggttgtgaaaggagccatgatgttattagctgagtcatgtcactgcacctccagcctgggcaacagagtcagactctatctca

SEQ ID NO: 550599 - DNA, 99 bp, Homo sapiens
tcgatcgagctcggtcctgccttctgtcgctagtgtaaggaacttgagcttttacagaggaaggccccaaaagccttctcccccagctccccttccctt

SEQ ID NO: 550600 - DNA, 129 bp, Homo sapiens
atgctttatttttccttgaaagctaggtatttatcaactgcagatgttattgaaagaaaataaaattcagtctcaagagtaaaccctgtgtcttgtgtctgtggttcaaagtcagaaatgattctattt

SEQ ID NO: 550601 - DNA, 643 bp, Homo sapiens
  misc_feature (590)..(590): n is a, c, g, or t
atcatgacggtaatcgctgtggggaggcacagctttatgacagagagaacccattttacagatgaggaaacagaggctcagggatgtaatttgtccagacttattccgcatgtggtgcaactagaaggaagggccgagcatctcctgcgtgcttgcctgtagcctgctgcagagatgtgaaccccaaatcccgtattcccacccggggaaggtgtgagctggctgaacccaagatacaggaagagggcagctcagctcagaccagggttttgcggaagtctgagtggatggcgccgtccatctgtttcccacgtgggcaggaaggcggatggtccctgctcctctcagtgggtggcgcacacggtgtagttatgtggcttgaggatctgggaaaggcacactcagttgcagctggtgtgctggcgtgtggcgttttggtgctctaaccattgtctgtgttcaactcccaagctacagacgggccccctccttgggagcgccagggatgttggcgccctggagccccagacagggagagactcagaggtgcctcaccctgacacctggggtgtatgtccagttctcccagngtagaaggggaaccacaggaggtggacacccggttctccggtggcttctttcc

SEQ ID NO: 550602 - DNA, 288 bp, Homo sapiens
gaggacccggctatacattatcctccccaataaagcaaaactcagctgcgttgtagaaaactccagttgatcacataatagactacgaaagggcttgaagatatgtgaacaacaaaaactaagagccaaacggggatatagataccccactatgcttaccctaaacctcaagagtaagatcaacaaaactgctcgccaggacactacgagccacagcttaaaagtcaaaggactggcggtgttcatatccctctagaggagcctgttctgtaatcgataatgtgatag

SEQ ID NO: 550603 - DNA, 157 bp, Homo sapiens
ccagttggcatgatccataggtagttcatggctagagtattatttgcttgatagtaagcccgcgggggacaagggaacttgcgtactttattcttattgtctatctctagcatctaacacacctgggcacagatcattgcagaacttgtcgcggatt

SEQ ID NO: 550604 - DNA, 834 bp, Homo sapiens
atgcgcctcatcgacataagtgtgatactagcatgtaccatctcatgtctatgaatgttagtatatcgatcatgcctcatatcctcgctagtatgcctagaaggaataatagtatggcggtacatgatagtctccgctcataaccacgttaagagagccacggcgcgctcttagcgcgaatattgtgcctagtggtcatacgttagatctttgccggccatgtgaacgccgcggtggtgctagcccctaatagtctcaatctccaacaaatatggctagacctacgtacataactaaactactccatgctaaaactaatcgtcccaacaattatattactaccacgtgacatgactttccaaaaaacacataattggaatcaggacaaccacccacagcttaatcataagcatcatccctctactatttttaaaccaaatcaagaaaacctatttagttgttccccaaacttttcttacggacccctaaaaacccccctctaatactaactacgttgattcctaccccttcaaatcatggaaggccaaggcattttattcggtggaccacctatcagaagaaaaatcttagctcgttaataataaatctcctaaaaatctctttattataactttcacaggcacagaactaatcatatttatatcttctcgaagcaattatcccactggtaatatcaccgtggggacagcaaagccgagcggaatcatccatctcaccaagggcctcctatatgatattacacaactggccaaattaaactccgcagattacggccatttgggaaattgcacctggctgcagtgcccggacttg

SEQ ID NO: 550605 - DNA, 738 bp, Homo sapiens
  misc_feature (3)..(3): n is a, c, g, or t
tcnaaagaagaagaagagcggacgggagcgaccacgcggcgacatagagccactcggtgccagtcgctctgaccctgggcgtctcgtggccgacgtgttgcccgaattgggtgccagtacgtgtgagagtgtgccataagtgagagttcctgtcgatactcttccaaggcccggagttcaaaaagccaagtgcgggtagattttaagggacagtgcacaggtcggggctgatttgcccctggtgttcttaataagaggccccccccgattgggatgtttcccacacttggggttatggctcttagcccccgtacctccccgagctttatgcctttcgcgcactgtgaggcaataaacagttgactttagccccccccaagcctccatcttgagctctagcactcaacactccgctctgggcccccggtgaaggaaccatacccacgggttctgcatttcgaaacacgacataatgtctttctcaataaagtaggcggacttacccccggtcttttcgtacccaagcaggcccccttatctggagttgccaacctcatttcctgtctgacatgttttaataacaaatcacccgcgatcttcatggttttcacctgggggctgggatgagaatgtgtccactaaggaccaccacaacgaggggaaactagaaagcccacctggcaaccaaaccgtgtcgtgccccccggcccaaaaacaaaaaaaaatcaaaccaaaaca

SEQ ID NO: 550606 - DNA, 148 bp, Homo sapiens
atccgggcaatggagctgtgtacttgcgaggccagaaggaacacaccttcaccatccaggcctatagactgtgtgctgagggccctgacggggcaaacaccaagaatgtcccacaagagccacttgtgcatagtgcgcggtcacacga

SEQ ID NO: 550607 - DNA, 206 bp, Homo sapiens
agcttctcggtcgcggaggtgctcacgccctgtaatcccagcagtttgggaggctgaggggggtggatcacctgaggtcgggagttcaagaccagcctgacgaacatggagaaaccctatctccactaaaaatacaaaattagccgggcatggtggcacatgcctgtaataccagttactggagaagctgtgccggccggaggcgt

SEQ ID NO: 550608 - DNA, 129 bp, Homo sapiens
gttggtcagggggccctgaaaaccctggtaatattaaaagtctttctcaggggaacttaatgtttttttaatgaacaatgtttccagctacaaatttttccaataaattgtcttcctttttgaaaagta

SEQ ID NO: 550609 - DNA, 272 bp, Homo sapiens
  misc_feature (154)..(154): n is a, c, g, or t
  misc_feature (232)..(232): n is a, c, g, or t
  misc_feature (234)..(234): n is a, c, g, or t
ctgtagtcccagctactctggaggctgaggcaggagaatcaattgaacccgggaggcggagcttacagtgagctgagattgcgccactgtactcctgggcaacagcgagactccgtctcaaaaaaaaaaaaaaaaaaaagaaaccatttatttnaaaaatgattagattgctatgcctcaactcatagaagatgacccttcaagaaaacgtgaagtagaacgggtgggccananatgaaacaggcaagtaaagtatttcttcggaaacattt

SEQ ID NO: 550610 - DNA, 985 bp, Homo sapiens
actattctctacaaaccacaaagacatgggaacagtatacctattgattcggcgcatgagctggagtccctaggcgcagctctaagcctccttattcgagccgagctgggcgagctcaggcaagcttcggtaggtaacgaccacatctacaacgttatacggtcacagcccatggattgtaataatcttcttcatagtaatacccatcataatcggaggcttaggtaactgactagttcccctaataatcggtgcccccgtatgtggcgttgccgcccgctatgaactaaagataagcttgctgatgtactatacctccctctctcctactcctgactcggatctgcttatagatggaaggccggagtcaggaacaggttgaacagtcataccctgcccttaggcaggtaactagtcccatcctggagcctccgtagacctaagcatcgtgctctcttacagccataagcaaggtgtgctcctctgagtctataaggggccatcgagtttctccatcacagagcaagtgatccaataataaaaacccccggccattaacccaattaccaaacgcgcctcttcggtgtgatccgtgctaatcgacgaggagtcctacttctcctatctctcccagtcctagctgcttggtatcatttatactacttaacagatcgtataactgaaaatcacctttttcgaacccggcggaggagagacccattctatatcaacaactattctgatttttcggtcaccgtgaagtcatttgtctaatctgaacaggtccggaatagtctcccatatggggtacttactaatgcggaaaaagaaccgctggggtcctacgggtgggtgagccaaaatatcaaaggttcccagggatcggtagccccgatatcggggaaaaagtaaaagaaattactcgcccaagtttccccgggaatttgaccccccaaaataagtagggggccaaaatcgagaggga

SEQ ID NO: 550611 - DNA, 109 bp, Homo sapiens
  misc_feature (64)..(64): n is a, c, g, or t
gttggaaaagtttatttattggggagactaagacgatgcaagaaggatttgcgtgggtttctgncagtctggatttttctcagcaaaggatcatttttgttttaccagg

SEQ ID NO: 550612 - DNA, 224 bp, Homo sapiens
ccagctaatttttgtatttttagtagagatggggtttcactatgttggccaggctggtctcgaactcctgacctcgtgattggcccacctcagcctcccaaagtgctggtattacagatgtgagccaccgaacccagcctgagtttctcgtctctcgtttaacttattttttgaaaaccggtagacttgtgggagcattttgtgataatttactgatctaagct

SEQ ID NO: 550613 - DNA, 187 bp, Homo sapiens
ccgatttcagggaatagacactggagacaatacttactcaggcatggctcatagaagtaggattctgtgtgtcttttgttccctatttccctccagctaaatccccaaccctggggaatcagaagaaagtcttttgggggatttttctccaattttttagggactattttcaagggggttattgagc

SEQ ID NO: 550614 - DNA, 1656 bp, Homo sapiens
  misc_feature (1197)..(1197): n is a, c, g, or t
  misc_feature (1405)..(1405): n is a, c, g, or t
  misc_feature (1656)..(1656): n is a, c, g, or t
taaaaactggattgtttatttcccatcaaccattttcccatggctgggttaagaccctatgcaagaacagcttaaaaccagtcaggtggtgtgcctccttacccatattcaggtggccgtgagcagtggggagctgcaaaccagatcttccggtggcaggctgagcgcctccagtctttcagtagggaattgctgaaataggcacagagggcaccgtgttacacctttcagaacacagtctgtgaaaccctcaggcgtgagatagcaggtgaacctcaggaagcgggaagcagttccattcacccgtgaaacattccctccgtgtggtcacgtgcctttcctcgagcagcgagcgcgtggcatcttctctttattttcaaaatcctcttctcagaggattcttctgtggtagaaagattacagaatctcaggcatgtgtacctctcccagtggcggtgttctcacgggggaaacagtggggtgccagcgcatgtggcgccagaaaaatttctcgcgagggcacaggaaatatcacaacccacacattttcaaaaaccccagcgtgtacgtgtgagatcctcccttttgagttgtggtgtgcctgtgtgagagtgggcaaatggtttcccaacgatttagcgcggcccagaagggaaaaaactcgtggggggtctaacaaacaaagagcggaccacagggggtatcagcggctagggcgttaacgcaatatacaggatatggcccatccccggtgaagcaaggagccttgtgagtggtgttaccaagcacccgttggagagcttcaaggagaaaaacccaacgcaaagaaaaaagccccgtgagggcatcccccccccgggaaaagagggggtggacgcagtgggaaataccgagggactacaagaagtggaacagtggggtaaccccaagcgtgaggtgtgaacacacgctgggcgcacagacacacatgttgcgacgaagggtggggaccccccacaggtgtggcgacaagatgaaggaccacaaacaatcttttacatagacaacacgatgcccccttcgtgttgggcacaaagtgattaattaccccctgggggaaggagaatatattatataccacaggcgttgcaagactactcaagcgacagggggcgttttacaccaaatgtgggggtacaaacaacaatgtagtggccncacgaagaggctactgtcccaagagcaaacgaaaataggcatcgtactccaccccaagaggagtccccaccttgggagagaaaatctatcagcagaaaatcattagaatgacggccacatacaacgatatttacacccagtttaataaagaaacgagtcagtcgtagtgccaccatagtgcgtgacaagcacccacagaacaagtggnaggtggccacacccacaatagacgaaggtcgaatcccacgtcgatgaggacgagagaaaacctaaaaggaggagcggacgcgcgcaaccacttctgatcgaggcggagacacactcaaggaggcctcgcagaacagtgtggcgaagacatcgcccgacgaaagaggagagagggaagaccaacaaaagaagagtgcgatgaccacctcgtgcctcaggcgaagacaacgagagacgataacccagcgatgn

SEQ ID NO: 550615 - DNA, 662 bp, Homo sapiens
agcggggctgctgcgctccctgcccccgcggtgccccctttcccgccgccccgctcctctctcaggcgctcaaagtggcctggaatttgtagaacgcccccctccaagcccgttggcagttgtcctagcccgctggcccttgcccccgcacgctggacgttgcccccgcgacgccccggaagccatggtcctgcctcccgcacctgccaagtccccgccctgccggagtctcgctctgtcagcccaggctggagtgtagtggagccatctcggctcactgacaacctccgacctccccggattcaaagcaatatctcccgccatcagccatcacccgagtacttgaggaattacagtgcgcccagcaaaccttcgacccggcatacattttagtacttatatacatagagacggggttacagccgatgtaggtcacagctggttctcaagctcctgaactcaagtgatctgctagcctaggtctcctaaagtgctgggattacaggcgtgagaccaacgaagtacggccaaaagcctttttaggatgagaaagaatcacttcagacttcgatcctgaagagcaagtgggctgggagaagaggaagagtatgaatgtgagatccaagaagcaatgttaggaacattaatacttacaaagaatt

SEQ ID NO: 550616 - DNA, 165 bp, Homo sapiens
cagttatattttcgcgccgtttctatgctgaataaggaaaaaaatgtacggttgaatctgtttcttctttaaattctgtatatttgaatgacgtatatcagcgccatgcattaacacctacacatattcctggtgtacctgagactctgaattctgtaactcatg

SEQ ID NO: 550617 - DNA, 148 bp, Homo sapiens
acgatacatgtatgcgtaacctggtgtaagtggggagctgtttcaaagtggtacctaacaatgctcactcgctcttctacgaagccagggctcaggtacccgtagcgtccggccccctgctccgcagatgggaaagtcagtgcgtatc

SEQ ID NO: 550618 - DNA, 330 bp, Homo sapiens
gtcgacagtttgaggcttaagaagctggatcgcctgccgggcgtggtggctcatgcctgtaatcccaccactttttttttaaggcaggcggatcacccgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccatgaggcagaggttgcagtgagctgagatcacgtcattgcactccatcctgagccacaagagcaaaactccgtctcaaaaaaaaagtcgac

SEQ ID NO: 550619 - DNA, 1567 bp, Homo sapiens
  misc_feature (266)..(266): n is a, c, g, or t
  misc_feature (328)..(328): n is a, c, g, or t
tcattatgccccttctgacatccaatgtagagcatgatctgtggactagagaccccgatccatgaactatgcatccctgctcgagatgctcaagcccccgacgcgaaccagcccaagaatgcgataacctccacctcctctctatgccaagctgtatccatatccatcattccaacgccgcgagcttgaagtatcttgattgcttgtgactccgctagtccactaaagattacacgattctagacttctttccgtagtgtgtcttngctaaggcgatccacgcagattagtggtctatctaccctcgccattattggtcatagacacncttaaacgctacccccacatgtatcgccctcgagacagagagggacttaccgatggagtgacccgcgcatacacaccatcaaagacataacaacacagaccacccatgaccaatcaccgtacacattctaagacaggaggcgtgcacctacatcttctttccgggggtgacacctccctagatgggtgtcaccctatcacttcaccccggagaattctctgtccaaacggcgacaggtcgtggccgccattgtgcagcctacgtctctcttatgtctaccaccatggggcgcccatgtgtcttttctgcccgatgttgtgggcccctcaccacgatggtcagcagtaggggggccgcccgccaaagaggagcgtcgcgagttgtgtacatctgcgtctactagcaataaatgttcacgccctctatggataacataatcatagaactaacaactcgtgtagcgccgaccataattgtatcgagccaaacgggctatttacaagagggggggaacaccacccacatgatgttctgaccctgccacacgtgttcaatgtcaccaccgggttatgggacctcgggcaacggagaacaaacgatgtgtccccggttatagaccacaaaaggagatgttgctccacaggatattctcggaacattgtcaaaccttatactattattcacgacacgctatcctctcggaaagagaacaatccacactggttgggagcagaagtgccgactggggaccacacactgggtgcctccctttcccaaacaagcgtggcacccgttagttatgccaatgagcattgcttctggaacacggaaagacaaaccaccaaaagaaagtccgtggtcaaacggacaaactaggtattaatatccatgtagacgcgtccaaacggctgacggggcaagcacgaccactggaaaagcttgcgtatggcgtcccacgtggcgaccccccaatgggtatagcgttgatagtagtagcaactaccgcgcaaggcacaaccattatttcagaggacgaacgggtggtgctgtcaaaccactatggttggctcgtatgattatcaccccctgttggaggggattcccatagcggaatgaggtgtccaccgacgtaatacaacaccgtctcgtgtgtgtacacacacccagtgttgtacacagacccccgtcgctgccgttctacacatagacaagacgtgcacaacaaggcttatgccatac

SEQ ID NO: 550620 - DNA, 160 bp, Homo sapiens
aggcgcgtctgaactgcatagggctctggtagcaggtattgaccaccagagatcatggataccctcaaggcaaatgcttacttctctgaatctacacttgctgtgtttctggggcctctaaggaattctttcatgttactgccagttcagaccgcggcct

SEQ ID NO: 550621 - DNA, 452 bp, Homo sapiens
  misc_feature (184)..(184): n is a, c, g, or t
gaccagaggaccggagtacgccacacattagtacctatagtaccggtcattagaaacagaaaaatatacgctatcttgcataaaaaaatctactaacagtagatataaattgactcatatgtttttctacatattatgtaatcagctcttaagcaagacggtggaggtatatgatctgtacaancttacgtagtgtatatccaaataaggttttctcctactatggatgacatataactgtttctgaatgagatacatgtaaggcttaggtgtaacacttgggaggcaacagctagtgaaaaattatggtcattacaatggtatcatttcataatagacccgaacttcaaattactgtgagaaacattacatcttactttctaggaaggccggcttatgtaaaaaagcgcaagtttaacccaccatatattggaaggcttctttcatagaac

SEQ ID NO: 550622 - DNA, 916 bp, Homo sapiens
  misc_feature (30)..(30): n is a, c, g, or t
  misc_feature (97)..(97): n is a, c, g, or t
  misc_feature (512)..(512): n is a, c, g, or t
  misc_feature (624)..(624): n is a, c, g, or t
  misc_feature (820)..(820): n is a, c, g, or t
  misc_feature (822)..(822): n is a, c, g, or t
  misc_feature (855)..(855): n is a, c, g, or t
  misc_feature (881)..(881): n is a, c, g, or t
ctatcttctgccattcaggtcataatcctncatttctacaactgtcctaacccaacttctgactgcaaaacaaccatcaattgttcatctaattttnattcttttctcattaccaaaactgggttacaagtatataacaagttttggaaatttgagcattgcaatttcaacgacgtcacaacccgctttaaggaaaataaactaacatactactgctgcaaaaaaaacctgtttaactttaacaaacaacttaaaaataattgaacatccttatcaaaaaaaacaattcttctacttgtaactccatttcttgcagcaccctgaaaccttcatccctaaatcaacaccaaaaaaacttctcccaaactccccgttcctacatatcctctttctctttcttccacattctaaattcttaatattttccaaattaatcctattggaaaaaaataaaattaacttaaacaacctagctaaaataaaaaggctctaggagactttgaagaccagtnctgtttacagggaagccccacttgaaggaagaagtctaagagtgaagtaggtgtgacttgaactagattgcatgcttcctcctttgctcttaggaagaccagctttgcagtnacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgcaaatgttccatatgttggtntnattaaggacacaagatccttaatgcagactagnagactctggcagggaattggggaatntccagatagcaggcatgaaacttagagagtacaat

SEQ ID NO: 550623 - DNA, 399 bp, Homo sapiens
tgctggtcgatctctagcaggatcccccattggtccgagagaaattagaagtctttgaaggtgtgtgaggaaaaaaatcctacatacaattaacgaacatttcagaacagggtaaacaattctttactttaacaaatagggtatatcaagtgagcatctcacaaaaaggccactgcttggtgacctgggctagtctgccacgtaagtccatcttgtaaatagtgtgctggcgttagaaatacctagtcgccaaaagcatttcactttaacctctgcacaatgaactgtttcctctgcagcgtctatgcaggctatatccagtttatgttgataaatctacaagattaatggctctgttgtcatatactgcttatgcatcttatttctctcgtaccaatg

SEQ ID NO: 550624 - DNA, 144 bp, Homo sapiens
cgtagaaacgcggggactagagcctcctcagtgtacttgcctgccacttaattattctcacactccacaggggactgattatcccctggcatatttcacatgcgttccaagcggggctctcaagtgtacctcccacgccccatt

SEQ ID NO: 550625 - DNA, 101 bp, Homo sapiens
gtaatccagcactttgggagtcttgagggcagatcacttgaggtcaggagattcttcctatgacaaatctggttttcttaagacaattttggtttctttct

SEQ ID NO: 550626 - DNA, 193 bp, Homo sapiens
taagcgagcgaggagcaaaaaatcaaatgtatgacgattactactattatggcccacctcatatgccccctccaacaagaggtcgagggcgtgcaggcagaggtggttatggatatcctacagattattatggatatgaagattattatgattattatggatatgattaccataactatcgcggaggatatga

SEQ ID NO: 550627 - DNA, 928 bp, Homo sapiens
  misc_feature (497)..(497): n is a, c, g, or t
  misc_feature (583)..(583): n is a, c, g, or t
  misc_feature (770)..(770): n is a, c, g, or t
tatccttcggaaagaaccccggtaaaagaagcccaacaggtgaaaatggacgatatcagcagtggaggaaggggtgacagggctggaagagacaaatggtggtgagacattctcctggttccatcaggtggccatccactaacccggttttctccttctggctggcaaaataaaccactctggtcccatttttaactcctaaacagcatatttttggtttctccatctttcaactatcccaagcccaacctaattttatttggttcctttcatctggtgtactggctggctggactcttatccataattttccttccaaaccaaaacaaatggtatagcacaaaatccatggtctggtggacattccatgtttgtaacatggtaccttggctccagactccaactggccatttccaggttgggtattcataggtcccaggttcctttatccaaccattttaaaacccttataggccaatctcatttccaaactcttnattcctggccaacattggtcattaagcacattaagaggttcagcacatttaaccaaattttcatttttgggtaccaaccaggtggnacatctttcctggtccatggcatttatggtggcttggaggtccccttattaatctttatagcaccatggttgattagccacacaggaaaacaaatcaacggccaagagcactccatttttccggccttggactattgtttcactgcggatttacattttgggtccctgttgcctttctgttggaacncggagcttccctttgggttttcccttttcttggttcctgggtgggagcgcttgtgccgggagaccttatcctctcgacggtttaacccttcacatttcgtggggtggctgggcgggcctttccacgctgcttctgtgggccccggttttgcctgattt

SEQ ID NO: 550628 - DNA, 980 bp, Homo sapiens
gcacaagctaagagagctgcaaaaaaaaaaaagaaaaaagaaaaaaaaaaaccacgttcttggtggagcggggtctggaaggcaaaagaaaaaaaatttctaacagtaagtctttctgggtttctaagttggagctggcttggcggtgaatggcttaatttcctttaggtttatggataaatttcacttaaactttaaagactattatttggcacaaaacctttggtttaaagatctggcaataatttatctattattataatattattattatcaagaataaagaagaaaacggttatgtgccgaagggcagggagtaattttctggtatattaagaaagaaggcctaatttaaaaacaaaagagtggtcttccttggaactaagaaaagagggaaaaacatagtgggccaattttctggagtgtggccaaggtccaggaaagtgtggtggttattacctgggtgaaaggaacaacaatttacaaaggcagggggttaagagagttaatttatatcacaatgtgttggaggattattggcgactaatctttttacatattataaatatattgtccagtggctaggcttggaatgggaaatctttctcctggtggtcctggtcggagactttaaaggggaagaactggtcgggaatttccaaaaatttcgccttgaagggcagagggttgagcccccggggagtcttggcaaagaggcttggcctaggagcgggaggcgcttcccgaggggccatttgtccctgcaagagtggactgcttactggctagtgacagggttatcaccacggtataatattcccttaacgaaggggaacacccttttcccccctgtagccaagaaaagggctttaaattcacaaggcaatatgcgacagttacccacgggggcacccgagttcccagggagggggttgcctttccaaaaatgaaataactggcccgggagaaaaacaacaaca

SEQ ID NO: 550629 - DNA, 1066 bp, Homo sapiens
  misc_feature (91)..(91): n is a, c, g, or t
  misc_feature (250)..(250): n is a, c, g, or t
  misc_feature (1066)..(1066): n is a, c, g, or t
ggtgggttgaggagaggctccagacccgcacgccgcgcgctcagagctctcagcgccgctcccagccatagtctccctggcctcgctcagnttccaacatgggcaaaaatcttaagccctatagatgatgagctggtgctattcgcacggtgccgtgattgtcctgtctttccatgatagttactgctaggcaaaagggattgtttcataacatgatcacttctctacctaaagtacaagagttcccttnaatgctttcattgagattaccacggaactagattggcatttcatcacacaggaaatccagacacgtgacccttgtgttgtctcttgtaacccgtctttgacttgaactgaccttctgggatcatcccaacgagttgaatggtacacgctagaattcccctcaggaacttctctttaatcctagatgtggctgagtccttgaacttatgagttggtcaaatgaacatctattccttacaatggctgagtcaccttccccacgaatggcggcacctagtaggaaccacccgtttgaagtccctggactttatgcaaaaaccggcatgcaccgtttatcttaccaggaccttctctggtatatcatctaccaatagttaaacaatcctcactgaagcaccatatacacacttctcaatgaaggtccccgaacctggccaataagtaataaacgccatgtccactttttttaacaccaacaaaccacaagagaaaaaaacaatgtttggcggcggccgcgaccagagagaattttcaaaacccatctgtgtggggccgccggccattggtatggcaattggttgatgttggcccaaagaaaccgggcggacaggctcgttccaccaaaaaaacgcggcggcccgggtctgacataccaggctttcggttaggcggcctcaccgacaagacagctcgtacacccccgcgcgccgtagggatgacacatccaaaaggacacaacaaaccagactaacaccagccgacaactcatctgcaccaaactacaagacgaagcagaaagtcacacacttctctcaan

SEQ ID NO: 550630 - DNA, 366 bp, Homo sapiens
atgctcttggggtgtgtggaatcacgccagcgattttgcctgagccgagcccggtccgttcgaggatcagtggactactctggcaccgtacccgggctgctgacggtgctggagaggtcgttgactgcatcatcttcgcgtacatcagcgaccccaacctgtaccagcagcagccggccctggagtggtgcgtggcggtgtacgccatctgcttcatcctagcggacatcgcggtcctgctgaacctgggggagtgcaccaacgtgctacccatccccttccccagcttcctgtcggggctggccttgctgtctgtcctcctctatgccaacgcccttgttctctgggccctctaccagttcgatg

SEQ ID NO: 550631 - DNA, 279 bp, Homo sapiens
  misc_feature (2)..(2): n is a, c, g, or t
cntttgaggaccccttatgtctgacccacctaaagatattcacatttaaaaaaattttttggagacagtctgctctgtgggccaggctggagtgcagtggcatgatctcggctccatgaaacctccacctgccgggttcaagtgattctcctgcctcagccttccaaacagctgggattacaggcgtgcgccatcacacccggctaattttggtatttttagtagagacggggtttcaccatgttggccaggctggtctcaaactcctgacctcaggtg

SEQ ID NO: 550632 - DNA, 231 bp, Homo sapiens
caccctcagtggatattgccacatcgcatgcccagcctgtgcccagctacaaagttggggacaagatagtcacccgcaaggtcctactggggaggcactgtgccgaagctgggccatgtcgcacgtgaccgacatcatcgccctggtatggggacaccatacaattccaccgttcttcggagcatcttcataaaatggagcacctcgggaccgcctctcatcagaggtgct

SEQ ID NO: 550633 - DNA, 130 bp, Homo sapiens
tgtgtcctgtaaccaaatgcccctggtcactgtgttctctcctgttgcgctatttttttaagaggcttcggtatgggcaatgtaaaaaaaaattggcgctttggagattgatctggttggcccttgaaca

SEQ ID NO: 550634 - DNA, 827 bp, Homo sapiens
gcaaggttgaggccgagttccagcagtcatggggtctcgcgttgtcccagtcctatttgagtcctatatcactgcgcctcccggtaccgccggcgcagcccagtcaaagcctgacgatgccccagtctacacccgtgatgcgccgagcctccccatgtcaagaacacctgtctttatgaatgatccttgctggacgctgttcgcgctgctttctgggattggggctgattgggggcgggacgggtacgtgtacctgggatggacacggaaagcccaatgaagaatgggatagccgccccgtagtcccatggtaccaatgtacgtcacgagtggttcattcgggcctcagggcattgtgccacctgggtgtattcgtgttgtcactgtgtagtacccccaaaagcgcgaaaggctctagccgacgattgctatctgacacatgctacccacgcaggtgcaattcttgatgctgtcgtgatcatctagtcccattatccgcctggtggaacacactaggaggcaggcgcattggcaagttctacaatgcgcgcttgttcctgcgaacaggaacactttgctagcatggtacatggactattcagcttagcatgctgtgacttaacctatagctaaagaaactttgacatacaagtcaccgaaatcccgctacttgtttgcctccagttcccgtcgttgaggcttaatggcgaacggctggcataagggtagggcacctgtccactacagtgacactttttcgaacacggggtaaaaccccaagcgctgagaaagttcccccgttcgagcgaagcaagagcgtttacagc

SEQ ID NO: 550635 - DNA, 121 bp, Homo sapiens
ggggcgggggggcccccctttttttttttgggggggttttggtcccccgccccccccccccccccttttttttattttttggccccttttggggggccccctttcgtttttagtgggggga

SEQ ID NO: 550636 - DNA, 105 bp, Homo sapiens
gacgcactccgccaagttacatccttcccctttgactttcccgacttccggtccgagtattcgtagcctccgcggcgcctgcgggcggccaggaggacagtggcc

SEQ ID NO: 550637 - DNA, 184 bp, Homo sapiens
gaagacagcacaaaaccccagggacatattactggggttttttaaagttttacaaacattcaaaccaaaactttgttttttccttttttttgttttcaactttaaaaacaaaaataaacgatgataattttttctgggggaaaggatgggaaaataaatcccccaatgccacccgtttgtgaga

SEQ ID NO: 550638 - DNA, 80 bp, Homo sapiens
gtttcgagacaaacacagactcctcctctttttcgactgagccttcctccagatgtagttcttacccctattctttccgt

SEQ ID NO: 550639 - DNA, 193 bp, Homo sapiens
acgagagaggaattatttcattactctcagtattctagcaattaacctctatttccccagaattatacaatagcccatagagatgacaaaatcgtccataagaggcagagataattcaaatggaagaattaggcaggcaactactaactttcactattttttcttacagaaagagtgatatgaaaagtggtgg

SEQ ID NO: 550640 - DNA, 648 bp, Homo sapiens
  misc_feature (437)..(437): n is a, c, g, or t
  misc_feature (648)..(648): n is a, c, g, or t
atacttttacaattacttttacgggggggccttcttttatcgttttaaaaaccctcccagggcccgccacttttttgccaaaaaaggcccctaaggttttaaacccgctttaaaattactgttgccaagaagattgggccctaaaaactattaaaaaaagattccctccctaattttcctattggaaaggtaaaagggatctgggtgtattgcaaaaaagggagtttctaaaccaatgttaagggttccgggaaaaaccttcccttgctcccgtttttctaggaggctttccttcattaaaaatcttttttttttttgagattaagaaaaaaaccccaaattgttataaaactttgaattagccctactgactgaatctttcccaagccccctcctacaaaggctttccccccactttggaaggtctcctaattttntccccgaatctcttttggccttactcccaacagtcttttgcacacctttcccggaagagggcttgtatttcttttaacccacaaaacttgcccgactcacaaaaagctttttaaaaccccccccttctttttttttttcccagattttcaaaaaaccgggttggcttccaaatgttttctccccaatggtcttaacccaaaattttttccn

SEQ ID NO: 550641 - DNA, 1380 bp, Homo sapiens
aaaaacaataaggcaacaagaaagtaggctgggtgttgaattctggccgcagggtattgggcatggagctggggccttgtgtccactctgagtgaggccaccatcacccacacacaccctgcccactcctgcgcttttcatatgccattaccatatcccagcagctttggagacctccaggattatttactctgtcagccctgccacatatcactaatgacttgaactatgggcatctgtgctacccttatggttatgggggtctgcactgagtgtcccaccccaactaaagggctacccctagtgccatggtgtatacttgacacacatacaccagtaagtgagacctacagttgttatttggtgtactagtgtgaggaggcaggcccctactccccacaacctacgaccccaacagagactactgttatacttaagccgctcctttgtgcattgctgttgtcccatcactcatgcgttgacaccacaagacataccttggcagtgacaacattactatgtgcaaccccatgatgtggatgcaatgcactgtcacacaagtgcttgtgactgtggacggatgggaaccgcaaatggacccaatggctttgcatgtgacaggtgtgtgcgaacatgtgccatgggtgtattattcaaggggaatatctacgagattgcattatcctcccctccttgcgtgatgtgcaacaacggacgtgctatgagcatatccatgcgttggtcaccattccagacaggataacatgacccttgcagatgatagttcccccactgaactttaacgggggaatggattcacaacattacttatcgggagcttatggcaacaggaacgcgactggtgccaatttggtcaacgggtggcaaaggtgagcgtccccgataagggtgatagaccccacactatgagagtattactacccccacgtgtggactccttcctatattggacaccgttttgatggagagattccttatattgggattgctagaaatatgttggaattagagaacctacacaccaaacgtatactgtgcaccccatgtggtgatcccgtggaagacaatcatataatactccacaatggtgtgtacctgtaaagtaggattgagcccccgtccaacaatatgtgtccaataggatgatcattcgtctatgaggttatgattcgtacatatcaatattccaattcagaaagtcaagcaattcatctaaatgattttcaacgcccatgggcattgtggaactttcgggtaagggcttacccttcacgatagacaactaatacccactttgaagacaccaattcatctcatctgtcgtacatttatattagtccagcaattgttgcatacatg

SEQ ID NO: 550642 - DNA, 80 bp, Homo sapiens
tcgaccaacaggggagagtgttagagggagaagtgccccctgttgaagctctttgtgatgggcgagctcaggccctgatg

SEQ ID NO: 550643 - DNA, 159 bp, Homo sapiens
ttgtaatcaggattacaaaaaaaaaggggccagtattacaagctgctaaaatgcttttgcgtggattattgttttatttgaccccctgttccctttaaatatgatacatgctaagattttccatggcacagcaacctactaatatgtggtttcgcttct

SEQ ID NO: 550644 - DNA, 409 bp, Homo sapiens
ctcgagaccaggaattgggcacgagggccttcacagtggaagggggacctgcgcccccacatctgaatcgtgtaggtccccccagctcacttgccctgatggggcccaacactgtacccagctggttgggaggaccagagcctgtctcagggaattgcctgttggggtgatacagggaggaggggagttgcagggaagagggaccgccctcagctgtcaccagcacttttgtccaagtcctgatagtgcggcccctgccataggggtttgagcatggccttcctgccctgggggtgatctgggcccagggctttttggatgctttcctgctgccccagccagggttggagtcttagcctggggacccattgaagccggaagccaaataaacccaaaagctgtctcccca

SEQ ID NO: 550645 - DNA, 421 bp, Homo sapiens
  misc_feature (305)..(305): n is a, c, g, or t
  misc_feature (352)..(352): n is a, c, g, or t
  misc_feature (369)..(369): n is a, c, g, or t
  misc_feature (381)..(381): n is a, c, g, or t
  misc_feature (416)..(416): n is a, c, g, or t
ccagtttccatttgtggaatacatctaactcggtcatggtgtataatccatttactctgctgctgaatgtgatttgcttgtattttggtgcggatttttacatctgtatttataagggatattggtctggtgttttcttatgatgtcttcctttggttttgatatcaggataatattagcctcatagattgggttaggaaatgttctctcctccgttttttttggaagagagagattggtgttaattcttgctagaacctttggtaggaatttgccagtaagcctatctggtcttggggtctttngggaggattttgattcgattcaatctatgtatttgttatagaaccgntcggattgtccatcccngagtcagttgcnagcttgtgtgttcctgggagtttttcccctttggncccag

SEQ ID NO: 550646 - DNA, 461 bp, Homo sapiens
gagcgcggcccaatgccgacatacacttcaccactatttgttttatttttcttattaatataagaagacaggaatgtcaggcctctgagcccaagctaagccatcatatctcctgtgacctacacgtacacatccagatggccggttcctgccttaactgatgacattccaccacaaaagaaatgaaaatggcctattcttgccttaactgatgacattatcttgtgaaattccttctcctggctcatcctggctcaaaagctcccctactgagcaccttgtgacccccactcctgcccgccagagaacaacccccctttgactgtaattttcctttacctacccaaatcttataaaacagctccaccccatcttccttcactgactcttttcagactcagcccgcctgcacccaggtgaaataaatagccttgttgctcacacaaagcctgttaggtggt

SEQ ID NO: 550647 - DNA, 1015 bp, Homo sapiens
taacccctctttagtttatggcgctcaaaaaccaatttaaaccccccccccattgtaacgggggggcgggacaaaagcaaaaaccgcgaaacccgctgggaaaccccagttcttgccccccgaatttttggcccgtgagtggggtttgggtttcaatctgtcccgtgttgctggggttgagagttggaggggtggacccctcttgggggggcctttgcacatgtgagcccccttggagacacttcagagggggaggtggcaccagggccattgttccgcacgtggtgttctgggcacaggtgggtgtggttccccagaaagtctctgaggcacgaggggggggtggggccacgggtctcctacgggtgccaggaggggtgctcgagggcgcccccagggaggggggctcctgggtgtgttccttgagcgtttgtccgcagaggcacaacgggggtcaccccgggtggttgtccaccaagggggtgtccattcagggcggcgggagaagggggggccgccattccggacactttgagagaacccttccctttttcccgccggagacagtttttgcgccgcccttaaggacctatgctttggtcccccagaacgttcgagaccgcttttgtgggaccctttggggcgctcgtttgggcttatgcgccgggaataacggaagtacagggcaggttttgatcccccagaagcacgagaatctgccgggttggcccatggcccatgttgggtgtgcgcccgcggaccccaaggggctggcgttgtagcataaccaccacacgggaggtattaggctagggggactggctgggagggttacctcgcccgttggtcccgttaaccccttgagcgcggacaatagagcgaggcatggctgggacgggggtacccggctagtacccattgaggtctagcctgtgtcttgattagccagcgtagtgacctgtcactagcacgtatccatttgtgtggttgcttgtgtgttgttttcgctttgtcc

SEQ ID NO: 550648 - DNA, 243 bp, Homo sapiens
ctgatgcgacactagcggatcccttctgctgtcgctaggacaaccaggtgacagccttctcccactgcccgcggctcaacagaaccgcgcactgattcctgccccctcaggccagggccctcggcagagaggccagcctccatccagggcgtctctggcctcagtgtgctctactcacctgggctgtgtcacccacagcagaggcctgggctccgcctgccacatccctgtcctagggtgagg

SEQ ID NO: 550649 - DNA, 108 bp, Homo sapiens
  misc_feature (78)..(78): n is a, c, g, or t
gaagccaatccgcatcatgtggtctcagagggatcctctttgagaaaatctggtgtgggaaacgtcttccatcaggancctggacaaatctatagataccaaggcact

SEQ ID NO: 550650 - DNA, 671 bp, Homo sapiens
  misc_feature (125)..(125): n is a, c, g, or t
  misc_feature (151)..(151): n is a, c, g, or t
  misc_feature (333)..(333): n is a, c, g, or t
  misc_feature (386)..(386): n is a, c, g, or t
  misc_feature (396)..(396): n is a, c, g, or t
  misc_feature (416)..(416): n is a, c, g, or t
  misc_feature (429)..(429): n is a, c, g, or t
  misc_feature (475)..(475): n is a, c, g, or t
  misc_feature (478)..(478): n is a, c, g, or t
  misc_feature (514)..(514): n is a, c, g, or t
  misc_feature (527)..(527): n is a, c, g, or t
  misc_feature (531)..(531): n is a, c, g, or t
  misc_feature (553)..(553): n is a, c, g, or t
  misc_feature (560)..(560): n is a, c, g, or t
  misc_feature (573)..(573): n is a, c, g, or t
  misc_feature (595)..(595): n is a, c, g, or t
ggcacgagcttactcttaaagaagagcaggaggagtatatacgggaggatatagaatggctcacattgactacttcataatgctatcatttgtgactaatagaaaatacacaaatggatcctggncatgctggatgaagagtgcctcaganctggcacagtcactgatgagaccttcttagaaaagctgaaccaagtatgtgccacccaccagcattttgaaagcaggatgagcaagtgctctcggttcctcaatgacacgtctctgcctcacagctgcttcaggatccagcattatgctggaaaggtgctgtaccaggtggaaggattcgtngaccaaaacaatgaccttctctatcgagacctgtcccaagccatgtggaaggncagccatgcnctcatcaagtcttttgtccncgaaggaaatccngccagatcaacctgggcctctacagcaggctcacagtcaaggcatncgngccactctgatgcctacagaccaagaccccaactantataggtgatcanaccngatgatttgagaacgtcgatcngaggcangtacgcttcagcngctatgacctgctagaagtcanatgttgtaacaacatgctatgaagacagcagctgttgaggcattatgatagtcgtgagatctcttgagacagtatt

SEQ ID NO: 550651 - DNA, 872 bp, Homo sapiens
  misc_feature (387)..(387): n is a, c, g, or t
agcggcatcattttttcacagaattagacaaagcaattttaaaatttgtatagaaccaggaaaaaaaaaaaaacacctgaattagccaaagcaatcatgagcaaaaagaacaaagcttagacgcagattatagttaaacaaaacaggatgcgtattttgtattaaaaacaaacacattagaccaatgcaacagaattagagaattccagaaattaaattttgcattgttttacagacacactgatttttcaaacaaaggcaccaagggctcattacatttggcgggaaagggctcagtctctccaacaaatttggtacctacgttaacaattggcgaaatttcattattgcaagaagaattgaaacctgggacccattattcttctncaccattattagaaaacttcaactttaaaattagatttaaagacttaaagggtaacgatctgaaacctatttaaaattactctagaaacaactttctgagaaaacctcttcaggacacctggtctaggcacaagatttccatggcctaaaaccttgaaagcacaggcaaccaaaaagaacaattagacaattggggactttattagactaaaaaatctttgacacagcaaagaaaatcttatcaacagagtgaagaaacagcctggtcatacaggcgcccacttttttggcaaactattcatttttctagagactaattatccagaatatccaggaacttcaaataacaagcaatcccattaaaaatgtgggcaaaggctgggtgtggtggctcatacctgttaatcccagcactttgggaggccgaggccggtggatcccaaggcccggagattgagaccatcctggtaacacagtgaaaccca

SEQ ID NO: 550652 - DNA, 127 bp, Homo sapiens
gcactcaacgacaccagtagcttcatgccaaccattaccacaaaagatagcgtagcgtaaactgacagagatataggtccctatggataatggacatattccaggtatataggagggttcccgtact

SEQ ID NO: 550653 - DNA, 1420 bp, Homo sapiens
gggcggacgcgtagggcgagacgcgtgggaagctgctacatcgtcgcttgagagtctgtcacattcagtccagcatttgtattctgcgactgtcgagctatggcacaagtgagtgacaaacatgtttcaatacactcattggatctcttcatcatcctcttcctctcgattacagcgttattacccggagctgaaaacctcacgtcttactgtacatgaccagatgggcgatcttctcttaccatgtcttacattacattctctacataaaactgatcgagaacgagcttcttagagcttgtaccatattacacacgctgcttcatggcctctacgctgttaaatatatcccagtgatacttaaagcccactattaaccatggcacatgggacgatattcacttcctcgcagcgcacagaaactctaccgggcactctacttattccgtcgttgctatgcggacaacaagaacaggacgcggcctctgccttcgctaagctcggtcgagccacgtgacaaaagccgttgtgttggacgacacagatcggcacttccgtggatagccttacggcagctaatttgggtcaccacttgccacgctcatcgccacagccaacgtcatgacggcaacacctagacaccacgagtgaatacggctgcgctggactcctcatgggctaccgtaccaacactatcaaaggagccgtcacacacctgcctagcttctgggctccccactccccttcacaccctccctcttcttgcacaccaccaccgaccaccgcacgcaatgccccacgactcggacagccaatcacgtgacagaagcacggtcggcgccgttccctcgtctgtctatccacatatcggcccagcctgggtcactcctccgcgcggggcgtggtgccacggcagaggcgctgacgtcacacacgcgtctcacggtgcgaagcagtcgagctcaagagagtgacgaacaacagcacagggtgcggcacgactcgtccgtcgatgggcgtgtccgctcgcccgcctgtagtgttagtcgggcagcgaagcagcaccagcccggcgcccggcctccgccaccggcacgccgctcgacacacgaagaagcacagggagccgacgccaccagggagccccagccgagggcgcgaaccgagcagtcgccaacagggggagcccagcacccgagcagaccgcgggcgggcgagggagaccagatcgcgggcgcaacaccccgctgcgcccgaaacgaaggcggcggtgacacaaaaggcagcccgcagtcaccgccgcatcagcagtgcggccagcccacgggcgcgacagggagcacacacccggcagcaacaccaaacacacacacaggaacgcaaaccacgcagccgcgcacgaggagcagagcgcgccact

SEQ ID NO: 550654 - DNA, 122 bp, Homo sapiens
aatcctgccgtcaaatggtccagacaaaaagaaggtaaccccagttatagaatgaggtacaaatttaatcatcaatatatgtccaggattaagacgtactatagaggtgatttattctgtca

SEQ ID NO: 550655 - DNA, 998 bp, Homo sapiens
ccatgcacagagagaagggcggtgcctgcccacctcttgctccgacagcctcccggagctcccacgcatgcaacgactggccaaccactgcacccacacttctcacagccactgtgtctcactgcctgcctgtctgccatgcgtcgcgccgacactgacacacggcgctgcactgccctgctagtgccaggctttcccctcactccccagccccggggctcgctcgcccccgcgctgccctcctgcccacccggccacgtaccgcccactgctgccccccccacccacacacacacactccctgccccacaccaccccccccccctactacatccccccaccccccccctcccaccccacgacccaccacactctccgcactccacccacccacacactcacccacccacccacgccaccccaacctacactcgcctactcactgcccacccacccagcccccaccccacccctcatccctcacccacaccaacccccacacacaaccccacaccactaccacactctccacccaccccccccccaccacacacaacacccaactcacccaccccccaccatcactccccccccaccacaaacctgcaccacacaacatccaacacaacagcacctcacacagcctaccccacccctacacaacccccccactaccccaccacatcacccccaacaaccaccaccaatcccatcaccacaatccatcaccctacccaccaccccacaacacactaccaaccctataccccacccccctcacacctcaccacccccccaacaccccaccacacccacccaccacacccacccacaccccccacccaacaacccccaccacaccccacacccccaaaccacacccccccccacgccactcaaaacccccttacgccccaccccacacaccccccaccaccacccccacctccacaccccacaccacccacccacacaccacacaaccctcccccacaccc

SEQ ID NO: 550656 - DNA, 369 bp, Homo sapiens
aaagcagtggcaaaaaaggcttttggagctggcaaggtcccccagtttgcccagaaagctccgaagggtaaatgaatattttccctaatacctgcccccccccttttaatcagtggtggaaaaacggtttccaaactgtttgtttccattggccctttaagtttagtagtaaaaaactggtttattataaccatgcctcgttaaaccctccaaaagaaaagaaaattttttttgggcccccttgggttttttttttggggggggccgttttaagtttttaatttttaaaaccaggcccttttaatgggaaccacttgccccaaaatttgtccccaaatttttaggcccctttaaaaaatttaatttgga

SEQ ID NO: 550657 - DNA, 150 bp, Homo sapiens
  misc_feature (40)..(40): n is a, c, g, or t
  misc_feature (76)..(76): n is a, c, g, or t
  misc_feature (83)..(83): n is a, c, g, or t
  misc_feature (137)..(137): n is a, c, g, or t
ctttgtcgccgactcagcgagacaaggacccgtggttctngtctcaacatcatcattgtggctgagggtgcaattnacaagantggaaaaccaatcacctcagaagacatcaagaatctggtggttaagcgtctggnatatgacacccgg

SEQ ID NO: 550658 - DNA, 1143 bp, Homo sapiens
  misc_feature (1082)..(1082): n is a, c, g, or t
gacccacttccaccgttactagcagacaaccttagccaaagcatttacccaaataaagtataggcgatagaaaattgacaatccgtggcgcgaagtagatataggtaccgtctaagggagataagcatgagaagaaatgtagtaatgcaagcataatatagcaggggactaacccgtataccttctggataagtgaatgaagtagaaataactgggcgaaggagagccaaagctaagacccccgaaaccagacgatgctacctaagaacagctaaacagagcacacccgtctatgtagcaaaatagtgggaaagatttataggtagaggcgacgaacctaccgagcctggtgatagcgggtgtccaagatagacatcttagttcaactttagattagcccacagaacccgtctaaatccccttgtagaatttaactgttagtccaaagaggaacagctcttgggacactaggaaaaaaccttgtagagagagtaaaaaatttaactaccatagtagggctagaagcagtcaccgaattaagaaagcgttcaagctcaaggacccgactacctaagaaaatccgcaaacatataactgaagtcctcacagccaatgtggaccagatctatcaccctatagaagaacgtaatgttagtataagtaacatgagaacattctccatccgggataagccatgcgtcagattaaaaacagtgaagtgaacagttaacaggccaaataatataacaatcagacaacaagtcatattaaccgttaatgtgaacccaaaaagagatgatcaataagggaagggacaaaccgtaaagggaactcgggcgagatattacccgacgggttaccaaaagagatacccctgagaataccacgatgtgaaggacagcctggccaggaacaagggttaaggcgcgggaacacaagcggaaagggaccaacaacgggcccagaaggacacagcgactgaccccaagcacacgacctaaacaaacgaagacaagcgagaagaggaaaaaaaaagaaaccggaactagagcacaagccacacagatagaggatgggtcacncgcgagagagcgcgtcggcgaagacaacaccgaccaacacatcatacaagacgaaacacac

SEQ ID NO: 550659 - DNA, 1400 bp, Homo sapiens
gggctccctctctgctgcagagagctttctttcacttatcaaactttcactcctacctcaccctatgtgtccacgctccttaattctcttggtcatgagacaaagaacctccgcactgacacctcacaacagagagactgctacatcgctggtgcataggcggacgactgccaacactctctgatgctgccccacaacaccacgcgctccctcccgacgcgatcatctctccattgccaccagacctggcacgctgcacgcggccaccgacatcatacgcgcttcactggcaacacctcctgaactccctagcgctacacaggcaactcctcctcaccctccaggcctcccccaagtctagcctcggcgaattcaccacacatgactgcttgatcacacaaccaccaccacgctccccatctccacggcacctgaaacacgtcagcgcggctacccaaccctcttccttgtgcccaagcgactaggcctccctccgccaaacatcaccctgcaccccatccagacgctgcacctctccgaccccccaccaacaccagacacaccatcccacaacacacgttgcaccgtggccgcaacatcaacaacccgccagcaagcaacccccacccccacgacacacccacaccacacacccaccaacgccccttgcgccatcctagcactaccattccactgtgccactatcacaacgcaccccccaaactagatccaacctcccaacgcccacacgtataatacaacgtacaccttctctccttgccgtacaaccccacaacaaatagttatcccaaacacatgtccatatctacgtcctcacctccacacaccttctacctcacacctgccactcgcctatcactcttccaccacactccccttcgccaccccgacggccgcacataaccactttagtcactagtcggcaacactcatctccaccccttccacctagcggacaacgaaacacagtcccagatccttgctaagcagacgccatacatagcgctctcttgccaccagccgacaccctcgcgcgcccccccataacgtaacacacatactagacaccacacacacaaacatctcatctcacccacccacacacaccaacactccccaccagcaatatatcattacaacaacaactacacataatcttataccattaatacaatacgattcacaccccacatacatcacatcataccacacctcatcaaccaaccacagcacgccccactctccaatgaacacaaccgtcatagccaacactacctacacacatactatactcataaaacacaacaaaaaatctaccatacacaatacactttacatacatcatctctctctactttcataatcacattaaacatata

SEQ ID NO: 550660 - DNA, 125 bp, Homo sapiens
atatagtaatgacgtaatatatgtgaagtgcttggaacagtgcctggaccatagtaaacacgtcaaatattagctattgttgccattacaattaataatttttacttccatcacccatccaaaag

SEQ ID NO: 550661 - DNA, 1513 bp, Homo sapiens
gagctcttcaagcgcatctcggagcagttcactgccatgcttccgccggaaggccttcctccactggtacacaggcgagggcactggacgagatggagttcaccgacggctgagcagcaacactgaacgacctcgctctctgagatatcagtcagtaccaggcatgccaccgccagaagcagcgacgcgaggactctccgcgtgacgcgaggccgcaacgcacggcaggcctaccggccagcagcccccccactccaccgtcagcgcctctcctcagctctcccgtctaggcccgctccttaccttcacacctgtcccccgtcttccctcctccgcctccagcacactccggctgcttccggcgttggccctcctactccttggctccgccccgcccccttctccctctccttggcgcgggcgctccttagcacaccagctggccctgggcccacccttaggctacgcgccgccctcccccgtcccccctacctctgctctcggctcggacagtgttcctcccctccctcctcccctctcccaccctcctgcgcgccaccctccccctcgcggctcctccctggccccctcgccctgggcgctcggacccccctggcccctccccccctcccccccccgctcggcccccgcactcccccaactcctggcttcccaaggcgccccgcctaccgcttccccttcctcccaccgacactcgttcccatccgcgacacccttggggctcctcccccgccactccgcgccaactgggaacgcacgctgcccaacccccccgcggccggcccctggcccgccccctcctgccccttggctccggcaactccccgctcgggccctcacttccagttcccccttaccagcccgccccccgccgccgccgtcccgccccctcgcccttggcgcctcccgccaccgggcgctccaggcttgcgccgccttggccgcccccccccgcttccccccccctcccctcgcctcacccggccgccctcccgcgcgccctctcggcccgcctccccctccccgcccccgccttctccctcccgcccccgcccctccctcgcgcgcccaccgcgccggcccctccctcccccaccgcccccgccccccccgcgcctccggcgcctcgcccccctaccccccctccgtctccgctccccgctccctcctctggccccccccccccccccgcccccccccacccccgccccccgccgcccctcccccgccgctcctgccacgcggccgctcccccccccccctgcgctcttcgcgctccgcccccccccgcgcttcttcccggtctgcgtgccgctcgccccgctcccccacggcagccctccgctccacccctcctcttcccccggcgcccgccgcccgccccgctccgcgccccccgcctcccttccccggcctccccccgccccgtgggccgaccctgctccccgttcttccccccccgcctccgccccccacccgccctcctctcccc

SEQ ID NO: 550662 - DNA, 558 bp, Homo sapiens
ggacacacagtgaagagaccatgtgtgagttcatgggtagagagagaagataattcaaactttgggtgtggggaaggttctagaatctctcatgatatactggaagggtagatttccaaactttcctcccattttctttctctctttttttctttttctctttttttttcttttttgagatagagtctctgtcacccaggcaagagtgcagtggtgtgatctcagctcactgcaacctctgcctctcaggttcaagggattctcccacctcagcctcctgagtagctgagactacaggcgcacgccaccatgcccagcactttgggaggctgagggggaggactgctctagcccagtagtttgagaccagcccgggcaatatagccagataccatctcttaaaaaaaaaaaatgctggatgtggtggtaggtgcctgtagtcccagccacctgggaggctgaagcgggaggatcacttaagcctgggaggtcgaggcaacagtgagccatgagggtgccgctgtgctccagcctgggcaacagagcaagactcagtct

SEQ ID NO: 550663 - DNA, 419 bp, Homo sapiens
  misc_feature (32)..(32): n is a, c, g, or t
  misc_feature (36)..(36): n is a, c, g, or t
  misc_feature (39)..(39): n is a, c, g, or t
  misc_feature (52)..(52): n is a, c, g, or t
  misc_feature (56)..(56): n is a, c, g, or t
  misc_feature (209)..(210): n is a, c, g, or t
gtgctgcctagggcgctccaaagctgccttcnagcntcncagtagcctcccntgangtccttctgggtcctcctctgggtgcagagctcgggcaggtcttctgggcacacaggagatctggggggactcccaatgaccgttctcttggcctcggctcagcggcagattgcgctggtgccagtccttcccggcaccggtagcgacgcccnntgtccacctcatagcgcagccgtgggcggacgaacacttgagccaggggcagctcctggtgtgctggccacaggacaccagtcccatcttgcaggcgtaggacaggtggtagttgcagtggccactgtcactccattgtccctgatcatgccacaccatgaccacgcaggttctctccagacaggaagtcgctgtcgggctagtcgggg

SEQ ID NO: 550664 - DNA, 211 bp, Homo sapiens
ggatccttccagctactcaggaggctgagcgcaggagaattacttgaacccaggcggtggaggttgcggtgagccgagattgcaccacttcactccagcctgagtgacaaagcagaactctgtctcaaaaatacaaaacaaacaaacaaaacaaaacaaaacttacttgggtctctcgttgctatgtgtatggactggacgagacaggagg

SEQ ID NO: 550665 - DNA, 110 bp, Homo sapiens
tatcgatgccaccattgacaagacggaaattctctcccgtcttgtcaatgctgatgacatccatgaatccagcagggtaggttatatcagttcggtggcatcgataaaca

SEQ ID NO: 550666 - DNA, 370 bp, Homo sapiens
  misc_feature (1)..(4): n is a, c, g, or t
  misc_feature (19)..(19): n is a, c, g, or t
  misc_feature (36)..(36): n is a, c, g, or t
  misc_feature (39)..(39): n is a, c, g, or t
  misc_feature (234)..(234): n is a, c, g, or t
nnnngctacccattatcanagtggcccaccatattngtnatactatatataggtttgttgcctgatgcccatggcaagttaatacactgggacaccaggttgcagaagagaaagaggtttaatcatagggccaccaaacacagataggaggaaacctcaaattcgtctccaggaggactttgagtctcaggttcttaagggttttagagtggtcccaagtgtggagatcataanttggctgaagagtacagggcgaagtcatgggacagcgagatgaagaagctgtattctcatgctgattcccttcttctgtggcaggggtcttcaagctggctggcatcagctgtttcgctggaatttggcgtcggga

SEQ ID NO: 550667 - DNA, 208 bp, Homo sapiens
  misc_feature (65)..(65): n is a, c, g, or t
  misc_feature (85)..(85): n is a, c, g, or t
  misc_feature (94)..(94): n is a, c, g, or t
  misc_feature (128)..(129): n is a, c, g, or t
  misc_feature (134)..(134): n is a, c, g, or t
  misc_feature (142)..(143): n is a, c, g, or t
ccagtacggtgatcaggactttcagatggagggtaagagagcgcatcgggattactctgctttgngagcgtcggtggcacaggcnggtttgccngccgcatatttaaggcttgggtcaaccagcgcgnngaagngcttgagnncctcggagccgatcagcagcgggaactggaaggcgctgcgagcggtgaggttcacttcgataggg

SEQ ID NO: 550668 - DNA, 117 bp, Homo sapiens
tgtcactgaatgtagtcagttgatattggaaatttgcaagcttctccaagacagctttcagagctgttttcttcctctccaaagtcaggatcaatccgtattcaagatacctgtact

SEQ ID NO: 550669 - DNA, 211 bp, Homo sapiens
gatcaaaagagtgaaagaaaacataggaaaccaaacggcggcactcaacaatgtgggggaacaatgtaatttttaaatagtaagagcttgttccggtaaaccatgcactgaggctggtcacacggacctcgtggtctacctagctgagcatgtcacgaaatcccgacgtggcggtctgggcgccccggtttccaggggcgtgggtgtgtca

SEQ ID NO: 550670 - DNA, 187 bp, Homo sapiens
ggcagcactcaggagacacatgtcaggaagaactcatctggaaccatcccggaggattgctgagacggaacatataatcacattcgtaacttgcatgcagcggtaaggcttcattatctaagctgtacgcatggcactttaactaagatatccacaatattcaattccaaattagagttttagccca

SEQ ID NO: 550671 - DNA, 458 bp, Homo sapiens
tctgatgcactgcgtgtttaaacacagatcagtccttttttctggtgctactgtggaagaagattgtctttgggcatgctgacagcagatctctatagcctcacggatgagccctttctacgggagtgactccatgcttgtatacagagtatttatacaaatgttttagcatcttcatatgcggtgttaacccctagttctgtacagcatattctgttcaagtatttttttacaagcttgtgctgtaggcacatgccttctgccctggaactcgtgcaggtacgtagtagctgctactgccacaacggcaacaccaagcaagagatggtccatgcttttctgacgttctcagaatagtggctagcttcaaacctgacaagcgctgcttgaagcccgaacactagagaatgttgctgaaagcagaaacggccacgcgggtcacgactatgcgtgggaaa

SEQ ID NO: 550672 - DNA, 385 bp, Homo sapiens
aagtggatcctggacaccgacaccttcaatgaagggttgaatgaggatgactatgaaggaaatgatgacagaaaccctgtctcccgccgagagaagactatagccaagacactgacagatgaggtgaacagcccagattcagatcgaggggacaagaaggggggaaaccataagaagaggaagcgctcccactgtccttcaccaaccccagaagcaaagaagaaaaaggctaagaaaggtccctcaacaccttacactaagtcaaagcgtggccacagagaagaggagcaagaagacctgacaaaggacatggaccagccctcaccagtccccaatgtaaaagaggtgacacttcccaaaacagtcaacacaaagaaagactcag

SEQ ID NO: 550673 - DNA, 1144 bp, Homo sapiens
cctgtgtttgttttttcttgaaggattgtgttggtttgtgtagtgtaggaagtggtaggcgaaggtagtatgagcggcgctagagtagtggttgtgttgtgtgggtgcacgctagtgacagcacattacccaggtggcaatacgaagccgagtctcagaccggggtgtacccgcccaatattccggttaaggtacagccttggggcatctccccgccgccaaaaatagtcgttgtcgcgatgtcaattttttgcccctgccgttgcccttgtggtcaccctgtcccccctggtcagggatttcgcccccgttggtccaaacgcgagccttgtgttaagtcctttgcgttgaacccatcgttgttcccagggcacccccatttgggacacaccggtggccttgagaaccattccccctttggggagcccttggttgcacacgccctctgatgtaggcggccgccttcctttcccttgggacctctgggttatggagaaaggctaaaccgaggcctgccctgggaggcccccgagtcaccccctgtcctgaactgagcagccaccttgtttgagacgctgtgcactctgccaccgtgagacccgttgttcacattgtggagatgtctgccctgacacaggccagataccacagggttcccgaacactgggcttctcctaatgcctgaacgctcgcgtggagaaacccaattgtccgctcgtcacacttcgaggccccgagaatttggggcgttatacacaggttgttcctggaggacctggagccacccagagcgcccaccgccacggcaccctaatgaaggttaagaatttttcgacgaaggaagtcctacacgcctcctcacggaaggctccacgaaggaattaacgagggacactttccactcactcccgcccttctgtttacaacagtcacagcgtggagaccacatcggggcacacttggaaacgggccctgggtgtcccactgaaggtgctggctgcggcgatcggccttgttgatttacatacttggccttccaatgcgaagaaccaccatcccggcctgagggcgggccacccccgccctgcccttgcttcccttccaattaaccatcaccggacctgggactgcaccggacctggga

SEQ ID NO: 550674 - DNA, 84 bp, Homo sapiens
ggatttgctggtgcagtacaactaggcttaatagggctcgaattcgaggctcgaattcgaggctcgaattcgagtcaagcttct

SEQ ID NO: 550675 - DNA, 724 bp, Homo sapiens
cgacgagtacgactacctattcaaagtggtgctcatcggtggactcagtgcgtgggcaagagcaacctgctgtcgccgcttcaccctgcaacgagttcaacctggagatgcaatgatgcaccatctgtgctgtggatgttcattgccaccctgcagcatccatgtgtggactgtgcaatgaccatcaatggctgcagatctaggtgacacctgctgtgccagtgatgcgctacctgcggccatcaccatcctgctgtactaccagtggttgcacgtgtggcagccacatgacatggtagtactgacaatctgcacaaggcaccttgacctattgaaggaacagtgtgagctgctgggcttgaatgggagcttgcctggggacccactgccagagacaggcaaacattcggtcatacattgcattggggtgggtgcaagcaacggaagttgaaccattgacgacccaaacccattgccggagacatggatgacccccaacctttggaacttgaagaggcccccgggcgagccccataatccggcgactgcaggcagaagtgacaaccctagacgctttggatccagttctccaagtccggatgtaaacccattcaaatgcccctttagtgcaaatttacccagccattaagacaggttagagaaagggacagtgccaattacgaatggaatacacatttcgattcaccaacgaagacttctaacc

SEQ ID NO: 550676 - DNA, 286 bp, Homo sapiens
agaacctggatactgaaagcaggagagctggttccaaattatcaccctaagttagtccccctccacaactctgacaaatgaattaatatacaaaaacattactaataagttaaaatgcatctatcttctcctgggattttcttcttccatagaaatggagttttctctctccccagagtcggctgaagatttcaacagaaaccaaaattctaaaataagaaatcctttaaaatataagatccacatctcctacacataagaaaaaaatataaggccttttacatat

SEQ ID NO: 550677 - DNA, 246 bp, Homo sapiens
ggggccaaaacatacgacttgacaaaccaaattcttggtattggcacattccaggccaaaaggccctcaaagagaatgctatcagcggggcacagtggctcacaccggtaatctcagcactttgtgaggggagagataaagagaggctggttaatggggactaataggtaagaacatacagttagaggagtaagttctaatgtccgatagtagagcaacttcctgatggatttactgcaaggtgtc

SEQ ID NO: 550678 - DNA, 180 bp, Homo sapiens
tattataaatgaaacactcgcaggcaatcacagttgctctgccgactttctgaatttctctaaatatctggttcttgtgtaaaggactgccgaaaacttttgtgacccacggcccatcttatttccttgagcctagaaatatcagtgtataatctgttatcgtatcgaaatacactctct

SEQ ID NO: 550679 - DNA, 1208 bp, Homo sapiens
  misc_feature (605)..(605): n is a, c, g, or t
  misc_feature (743)..(743): n is a, c, g, or t
agcgggtgagatgcgatccggccctatagcttgcaatcattctccgctggaccctgaccctggatgctcctcgcgttggagggacgtcggacccccaacggccgcctcgacttcccgaggcgtgcctggtctgctacccgacgccagtctgccagcggtcggcctgcaggcggcgcgccgacgctcgcacgtgcccgcttccgtctttcctcacagcgcttctggaccgtggtgaggcgatccctcccggtcgcgtcggtcttgttttgcactggtgtctctgtcggtcagtaactaactatagcttttcaagctactcatacagttctaagaatactttaggacccatagtcagtaccaggctcagtcttccggttgcttgaacgtggagtgagtgcatcgttgagcccaacgggtgaacagacctccctgctgcccattgtacacttgagcctactaccatcagttcaagcccagggaaaccttgcttagagaccttttcattcgcccccaggtctctaggcgcctgggctggctcccatgcagatcatgtcccgtttgagcccagctatgcttatcgggtcaagggagatacgaccaagccnatattgcttgctgtggcccctctcacacgctcgccccaaggcacgctgtggctgagaacggctcttatccattttgcgatgttccgacctcattccattgtccttgggtgagaggaggttaggatgcgttgtgctccncggcgtttgttgcaaagcggctgctgttggctacgctcatcgagtggtcccattctcatcgactcagctcgtattgaggacctcgcaccccctgtcatccccggtgtcctcgtaaaaaccctgggccggatttgaaccttgcctcaggtgaccttgtcctgtaccccgggtaacagtgggtccagttgccgcgtgagacgcccttgcatcatcttatactcttgggtaggaatgggttcgcaacgggtgtcgccttccggtggttgtgaccgcgggtggataccttttggaatttgtccctgtgcgcctggccgttcttaggaacgcgtgatgcctgggggctttttctcccgctggatgggcacagggaagtccctttccttctggggcccagttcctacatttcgcccttggggttggacaactttctcagtttccgttgccttgtcgcgtgctcctaccccg

SEQ ID NO: 550680 - DNA, 850 bp, Homo sapiens
gcaccatgcagtcctcgccgtataaagaggcagcagttcggagagccggttcctgcagagatccggcggcgcgtcttcacaccgcatcgaatgcggcgtgtgtgacaatggtggatgtggtcggaagagcattgtcgcggcggcggagagaaaaagttacgccacggtagcaacagtatccaggcggggtgtgtcaggagagaatcaatgctagagttatgagatcgaaatgcccataaatagtggagaatgaacttctactaataatcgcagcgaagatatgggtttattcacggatagacattgtgatttatataccgatagttcccctgagtatggtacctagccaaatatcgagaatcatttgaaggagtggtgcttggagaacaagagtgaagtagctgaatgtagaaatcaactgagagatggatctggttgtaatgaatggagagaactagggacggaagtgttcgtgtcgaaagagccttgatagataagaatcgacagtagcaagcgctcctgtggagggagaatgtaacgtcagtaaaattagtgacctggatattctgtggtgatgagtttgctggatcctcaggacaactaccgaatactggaggtaggctgtgggtggtgggaaacacatgtcttggcaaaggtttagaaagagatacaagatgaggcaggaatctatgtgatggtgggattgtgcgatccacagctattagaatgggtcgagactaattcttggatatgattctactgggagtaagccttttgttgcgcgaaggtgggtgatggaagagagaagtaacgagggggccaaggggggttggaaattgtatttcgagat

SEQ ID NO: 550681 - DNA, 777 bp, Homo sapiens
cagaggcgagtcctgcgtgagtggtagcgcgcacgagctgcgtgtgtgacacccagcccctgccagtcccccatggccccgtggcaggccgagaggcggtgctgagtctctatcgggctctgttgcgccagggcctgacaagcttctgcatacactgatcgagaccttctacatttgggcctcctatcctgtcgctgaattcctgaaaaatatccagaagctagaggacgctgagtgcccgggcatgaggcacgctggcagaaggcggccctgggtctttctcaacggcaaattggggaggatcatttagtgcatcctccaaggggaaagaggacagaaggtgccttctgtagacactcctgctctcttccatccccatcttacagatgtattaagaagcctcagatgagcaatggcaggcgcttggctgagcgcaaaggcaagaaggatgacaatggcatttggcacggccatgactttgtgctctccaatgcccggcttggtgctgggggtgggtggagcggccatgctgggcatcggacacgcgtggtatttcagcggatgtacgatcgggcgagtcagtgcccctaccaggccccacccgccctgatcccattcgggggacatggagctgcgaagaacccaatggatgggctcccatgactgctgaccaggacatgaagacggcctgagcggtccttgcagacccttccaagactctccacttggcccaatctttttccgccgccagccatgcaggaggcggggacttacaac

SEQ ID NO: 550682 - DNA, 198 bp, Homo sapiens
acataggcatctattccaagcattttttctttttagcagagtcttgctctgtctcccaggctggagtgaagtggagccatcatagctcaaagcagcctccaactcctgggctcaagtgaacctcctgccttagcctcccaaggtactgggcttataggcgtgggccactgcacctgcctggccagcaaggaccttctt

SEQ ID NO: 550683 - DNA, 163 bp, Homo sapiens
  misc_feature (132)..(132): n is a, c, g, or t
cagtacggatgtcggattcacagagggttatggaatagagtatggttaccatcccccacagagagagcgtcatgcatccatgtttgtctttcttcctgcccccacagagagagcgtcatgcatccatgtttngtctttcttcctgcccccacagagagagcgt

SEQ ID NO: 550684 - DNA, 418 bp, Homo sapiens
  misc_feature (8)..(8): n is a, c, g, or t
  misc_feature (22)..(22): n is a, c, g, or t
  misc_feature (231)..(231): n is a, c, g, or t
  misc_feature (243)..(243): n is a, c, g, or t
  misc_feature (279)..(279): n is a, c, g, or t
  misc_feature (289)..(289): n is a, c, g, or t
  misc_feature (319)..(319): n is a, c, g, or t
  misc_feature (342)..(342): n is a, c, g, or t
  misc_feature (346)..(346): n is a, c, g, or t
  misc_feature (376)..(376): n is a, c, g, or t
  misc_feature (386)..(386): n is a, c, g, or t
aaatgaanccatgtgaccctgnccagggcggtgcgacggggaagcaggaggtgtggggttggtcccgcacgcaacctttgtggagccatcgaagcctgcctttagttatatctgtggcgttctcttgtaagtggaaatgtaattgtgtaccagtttccttaaaataaacaaagccttcatactgtgacagatctgtttccctatgaaaaccaaacaatgattcccacagtncataatgatggncaaaatcttaaaatgtgcctaacatttgagaatagnctcaccaagncaaaatatttaaagttaatgatggtgtagncaatgattgttgtctaggcctancagnagttgtatatgtaatgtatagtctgaaatncattaaatgnacattttcctgaaagttctttttgttttagta

SEQ ID NO: 550685 - DNA, 102 bp, Homo sapiens
attgtgacatgtatacttactatttatttattttacgttacaagacagacaatgagaggatattctcccatgtcaccttcaggaacgacccagagctaccga

SEQ ID NO: 550686 - DNA, 193 bp, Homo sapiens
tagatatccgagtgtcttcagacctgcagtatgagaagaatggtacacatccaagtttgctgacctctctgaggctggcagcggaacaatgacgccctgcgccaggcaaagcaggagtccactgagtaccggagacaggtgcagtccctcacctgtgaagtggatgccctaaaggaagcaatgagtccctgga

SEQ ID NO: 550687 - DNA, 244 bp, Homo sapiens
agatgcggaacttaaaacttgtttgccattctggcatactgttagctttcgggaaatggcaatcagacctggggaatctctgatacttaacacatcggcggattggagatggcccggaattattgatttgggacgagactgtctctcggggccaccccttactttggcgctatgccgtatcaatctaactgacctccatctgccgggggatcccctaatgacccgggaacggctggaccatggc

SEQ ID NO: 550688 - DNA, 1146 bp, Homo sapiens
ctcctcatactaggcctactaaccacacagactaaccatataccaatgatggcgcgatgtaacagcgagaaagcagataccaacgggccaccacacactcacctgtccacaacaggccattcgataacggtgataatcctatttcttaccctcagcagcttcagctatatcttacgcacggattttctctgagacctctttaccactccagcactagccaccttaccaccacccaatctcaggagggacaatggactacacacccacaaagagctaatcaacaccgcgtcacctcgccacacgaagaacagtccacacatatcagcaaacacaacaatagcggtacattactacgacactccaggcgctatcaaatcaacacgtggacgacctacacacacacccgctccttcacctaaggaaacaaatcaaatacgaacaaaacaacaaagtatacatccccaccgacaagcctgacctagcaatgacaccaagataatacaccaaagcgagctaataccataatatataccaccactatccaaaaacacacgcaccctcacagacagccaatcacaactcgaaggacttactaacgaccatttccaatcacgaataagctccccggaccccgggacacaatagactaaccgatggagcatactaaacaggtattaaaacactggatcacgccgtaaccacgcgccaaataacacaccaggcgcatacgctacaccagcatcacacataacgtccgggggactaccaactactatttcaagcatctcagacctaaatctccgtgctacgtccaaataccacgagcaaccacacctacaccgaataacattcacccccaccttgtttaacacgaacccacacaacacatagcaccacacacacatacagggcacaaaacacacaaacatcacaccgccacagtaaccgatcgaacataacatgaggagtcaaacctataggtaacagaacactcgtcattgccctccactgaaaccgcaacaccatctgcggtatattgcaagaactcaacaactatatcaaataccgaaacagtccaacacgtgagattacactacatagcataacgacatacagaccacacaactcagatcaacaacgaacgag

SEQ ID NO: 550689 - DNA, 436 bp, Homo sapiens
aatcttttaccatggttcttagcttcttgccatgggttagaacatgcttctttacctccttgaagtttgttattacccaccttctgaagcctacttctgtcaattcatcaatctttttctctattcagatttgtgccctttctggagaggtgttgtgatcatttggagaagaggcactttggccttttgtgtgttcagcattttttggttgattctttctcatcttcatgagtttgtctggttttgatctttgaggctgctgacccttggatgaagtttttgtcaggactttttttgttgatgttgttgctgttaccttctgtttgtttttctttcaatagtcaggttcctcttctgtaaggctgctgtggcttgttgggggttcacttcaggcctatttatccaggtcactcctgcatctggagatgcccacaga

SEQ ID NO: 550690 - DNA, 817 bp, Homo sapiens
gcgatgtgacgcgtgttcgcggagcccgggtttgacggaggagggcgtccaattggcgccaaagaagtttggccctcccaggtttgcgtcgttgtcaaagaggtggcccgacagtttgatgcttggttcgctatttgccccgcggatgaccaagacgcatgtggcaaagatttgaacccccgctggttttatccaggtatttagtaaagtcgcccaccacagtcgttgttcttaaggtgtaggtacaagaaatacaggtgggcgcgccccggccacgcaccacctgcgtctcgcagcaaattcatggtcgcccgcaaccaactcctcgctactaattaattcttggatataaatgcggaccaaataatgattcccagccgcgcgaacagaagataataaaagtaattgtcctactataaagtgagggcgcgcgacaacacttagatactaacaagaaagtagtgtatatctgttctatgatatcgagcttctcctccaactaagaagatcctccttcttaactagaggaccacccatgctctctccaaaaagatagataattgtaattacttaggaccccccgtcatcagggattctcaggagatatatgttgagacttgtaacatttccctcgcggcctattgtcttcgacgcacaattattttttggggaggctctcgctggcaaaccagaataaatcctggatcaatgactacgtgaggggttctccggtccccccctcctattatcacaggcctcaaacattttcgggccgttcatcacatgtaggagcccaacaaaaatttcgggacaatac

SEQ ID NO: 550691 - DNA, 1020 bp, Homo sapiens
  misc_feature (1006)..(1006): n is a, c, g, or t
tggtatgatctgttatgtctaagtgtacgagctcggttgctgtgatatacacactcgaactgcccaaatgttatgtacttccataattggttgagaaagggatctcccagttcattgttacggtgctcgtttcgaggctgagtgttcttggtgtgtgcatgtctaagtcgttcaatggggcgtgaggcgggactcattgacctcactttgtgagatctgtggtctcgatgggctactgtttgttaggagcatgaatgcagagagttgatggctccccagaggccttccttataggtcttgggctgtatcatgagtatctggctcgatatcttctaacgcgtattggtgcttcaccttcagtagaggtggtcaccatgatcgaggatcgatgtcacgcattgaatatgtcggagcgacgctctgtctaagctggtacctgtgaacggtatctcgtaagtcagagatagagctgctgaatgaagaatctgtataaatgtagggtgtagaatgcgatagtagaatagttagttcactcgagctcacacagctatgatcatgttctaagtgagctcactccaggctggagttgaaaggtctccatcagaggtaagtgagatgctatgcaagaagatccctacttggtagttaaccctaactacttgctcgaagattgagatagtgaaagtaactgatccagagcctgaggaacctgtggcacagcacctcgtggcctggatgtcctggctggagctctgttagggacataagtgtttctgcaagtgactgacttccaggatgtgttttcagaaaccaagaattgagttgatggtcctatgtgtcacattcatcacaggtttcataccaacacaggcttcagcacttcctctggtgtgtttcgctgtcccatgtgaagttggtaaccaatataatgtgtagtctctatcaccaatacctttgttattactgtgtaagaaaaggcccattacttttaaggtatgtgctgtcntatcggcaaataca

SEQ ID NO: 550692 - DNA, 497 bp, Homo sapiens
cgtctagcaggggtcagcaggaaacaacattggggtcataacttcgtctggataggcggtagtgtacatgggatgtaaaacaaacaagtgtatcaaaggtggatgattctgttagagtgaagttggagagtaaaggtcacttacgtttctcatagataatcaagagtgggctgtgtatggactgaaagaggggtaattctttcaaatatgcatttccacacatttaggtctcagaagatgcttagggaccaagggataccacggatagaaaatgctcactttacaggggcagaaaaaccccactcttccttatggactcttcagaaccctttagcaggtataagatattggctccaacatgctgaaaaagagttctatgcataagtatcagagaagtccctcaagcaatcagtaggtgtgtactattaagagagagttcacagttctcttagcatcagacaatggatccctaaggttccagggtgtcacaacaaaaa

SEQ ID NO: 550693 - DNA, 439 bp, Homo sapiens
  misc_feature (3)..(3): n is a, c, g, or t
  misc_feature (71)..(71): n is a, c, g, or t
  misc_feature (102)..(102): n is a, c, g, or t
  misc_feature (108)..(108): n is a, c, g, or t
  misc_feature (122)..(124): n is a, c, g, or t
  misc_feature (137)..(137): n is a, c, g, or t
  misc_feature (157)..(157): n is a, c, g, or t
  misc_feature (176)..(176): n is a, c, g, or t
  misc_feature (207)..(208): n is a, c, g, or t
  misc_feature (215)..(215): n is a, c, g, or t
  misc_feature (224)..(224): n is a, c, g, or t
  misc_feature (265)..(265): n is a, c, g, or t
  misc_feature (277)..(277): n is a, c, g, or t
  misc_feature (433)..(433): n is a, c, g, or t
canactggccggcccggattgacgagatgcctgaggctgccgtgaaataaaaagcaaaaaaataaaaagtnttttttttcgggacccaagagaaggcatttntgggcnccaaagaaatcttnnnttaagaggaatcnaaggagaagtttggaaagcncaaaaagaggaaagggttnagcgaggggctgtgggagattgagaacaacnntactgtnaaggctttnggctataagttttcccagaaaaagagttgtgtggaagagcntgaaccagagcncgaagctgcagagggtgaaggtgataagaaggggaatgcagagggcagcagcgacgaggaagggaagctggttattgatgagccagccaaggagaagaacgagaaaggagcgttgaagaggagagcaggggacttgctggaggactctcctaaacntcccaa

SEQ ID NO: 550694 - DNA, 574 bp, Homo sapiens
acgcctgcacggtatggtcaaacaaccatgagatcagagctcggcaactctctctggacaagagtcttccgggaaggggactccctgaatgccagcattgtggatgccatcaaccaagctgctgagtgctggggtatcggatgcctccgttatgagatcaaggatatccatgtgccaccccgggttgaaagagtctatgcagatccagttggcggcaagagcggcgtaaccgggccacagttctaggagtctgagggggacccggagagtcgggccatcaattgtggcagcaagggcacgaaacaggccccagatccttggcctcggattccagaccaggctgagcagataaatcaggcagcaggagaggccagtgcagtcctaggcgaaggcaagggttaaagttgaagcaatgcgaatccttggctgcagctctgacctaacataatgtagatgcagcacgttcactgactgttggcgagcagtatgtcagcgcagtctccaaagtgcccagggactccaatagtatcctactggcttccaaccctggcgatgtcaccagcatgttggctca

SEQ ID NO: 550695 - DNA, 100 bp, Homo sapiens
aaaaagctattagtgggagtagagtttgaagtccttgaggttgaggctgcagtgagctgtgatcgcaccactgcactctggcctggccgcgcagagttta

SEQ ID NO: 550696 - DNA, 415 bp, Homo sapiens
atatacatagtctgattctgaagtaatctcatccatgaggtttctggaattgaatgacctttgtctaatatttcttcaagtaagttatgaatgaagtcctgcttccttgcgtttcttaagaaaaggaactttcacagttgcatatggtgtgtctgccatgccactcgttcacttgtgttatgaaggtattacatttcattgtttcgggtggctgttacatgatcgcctgagaggggtaccgtccttcctctttttcttgtcactcctgaaaattcagctaacaatataaaccatttaaaagttggaatccttaaagggaaaagattaactcgttgactacatgaaatatactactcatatggccaaaagtttgtacaaagtccaaagatatggcatacttcaacaattagtcagc

SEQ ID NO: 550697 - DNA, 814 bp, Homo sapiens
agttttgatttttatattttattttgtttgttcattttgtttttttggtgatttgttgtttttgttttcattctatttttctgttttattgatattgttttctttatatcttttattgtatttgctcctcctaatgggggtacatcgtgtctcccccccacacagcggagaacactggggtggccccccccccccccccgctgggaatttttttataccccgaacgatataacatttttgataattagaaagatctcttcttgggaccacacgttagacaaaaatttttggggaaaaaaatttctacaaaagggtacaacctcttaaacacgcggttcacccccaatttatatattgccctcccgcagaatttatattaagccccacgcggtttatattattatttacaaccacaaagggttaattatatgtattaactcttccccacatttttgcccacgtctgttagaaaaaattatataaatataaaaaaaaggggaaatatataagaccaccggccttctacaattttcctcttgagcacaccacttcttttaactctcgctcagtccccccggcccacacgagtactatattaattctccttctccctcccccgcgggagaaaataataatatggatcgccgccttccacaaaggcgtttaataacacacacccccactggcttatagacaacaaacctttgttacggcggccttatatcaaatacatatcaggtgagagttaatcataccatccacaattttctcaaaagacaagtacccccccacttattgggccgccaaaaaaaca

SEQ ID NO: 550698 - DNA, 121 bp, Homo sapiens
agatgtagcgctcaacgggatctgctgcaccttgagtcatgagcggcacagacccatgcagagggacagcgccagtcgccaggagtatagaggccctgcttgaacatcaaggccaaccagt

SEQ ID NO: 550699 - DNA, 987 bp, Homo sapiens
gaccgagtgcgttggctcaggcctgtaatcccagttctcagggaggatacgaggcgggaggatagctgtgatgcgccagtgagttcgagacctgcctgggaaatatagtcgagaccccgttcctcctataatgaggaggcacttattacacgggtagggtctgacaaacatacattagtgactaacaaacaatgacatagttttgctggctcagtgcgagtgtataaaaaaaatttaataacatggattatatgcgcgtcatgccgtcccgcacagagtacataggacaccacgttggtggatcgcctgtaacctgaacagcagcaattcgggggcagcaacacagagcccaggtggtgttcccccactcgtagaaacgaatcccgaccggtaacaacggcaacttggctttgcacacaccatcgcattggttggcgtatgcgcgggccgcacctagccggctggaacaagacggtggttccaagcgcagcgccatctcttttatgaataactctctcccgcagtgttcgtgcgaacattaccacgaagaatggtggcgtcaatacacttcagagagcagcaacaatatcttaatatcctttaaggacgtggtgcgtccaggccatccagatagcaaactgctttacggtacccctcttggggacacggtggacctctgtagattcttaactggaaagattatgggcatagaaccatggacagacctcacacggcattcatacgagaccctgctaataatttgttgatcatccagtagtctctcaagggaacctgctcatccctgggttccgttgtactcaacaccccaagtccgaaatattatgaccctcctatcaccaccatttaagcaaatcgacagggtcaactctccgttgacaccgagctaaacgtcgcgaacatgcgttacaacacagctaaggttactatcccaaactgtctattcctctgccaaaagctaccaacacg

SEQ ID NO: 550700 - DNA, 195 bp, Homo sapiens
tcccaacatgagcgaaactccgtctaaaagaagaaaagaaactgaatttaaataacactgggttatttaaagtatttataaactgcagatttagggagagtacaccgaagggaagaggaactctgaagtggacatttaagggatgtgagttttatccattaaccagtcttgattattaggagtggttatttggcc

SEQ ID NO: 550701 - DNA, 133 bp, Homo sapiens
ccatgagcgatgaatagctcctaagttcatccatttccctcttcttctccatttcttctttttctcgggaaggggtctttttcatttcctggaatttgggcttttttctcattcctctcttcacgctccatgg

SEQ ID NO: 550702 - DNA, 181 bp, Homo sapiens
gggggggggggggcccctttaaaattgggggccccccttccccttttttttttatttcccaagttgggggggggggaggggggtttttttatttttttccaaccttttggcccccccgggcctttttcccggggggggggaaattaaaaaaacctttttttaattttttttttttttttta

SEQ ID NO: 550703 - DNA, 142 bp, Homo sapiens
tacagagtttatgtgacatcgtgatgtgttacagagagcgttcggctacttatccatagtctgagcacagcacgcgtcgaggggttaactgcaggatggctcaccgccaacttgaatgggtaccgtaggctcgtaattcgta

SEQ ID NO: 550704 - DNA, 572 bp, Homo sapiens
taagatccctcactcgaggttctagctggtctatgcagctggctgaggtctgcggaagacaggcctgtgtcatagtcaccaaagcatcacagagcataacatctttttgtgcagattacattgagcgcacttggttttggagtatcagcgctcagtctcaaaggcagatgcatcagatgcaagacccgggcctcatgtcctcctattagggcagcactagggctacctctttgtcagcagaacctttggatagccgctgatggggtgagtcagctttctgggcccggcagaccttttgggaatccctggcttttggggcacaacatcctggggaccaccaaaaaggcctttcacctgagctttgggaaagaggaacagctccggctgtgggtggctcatgtcaccatctggaagccagctgggtcacagcagacgcgtaagtcctgtattcattcatccccttctccttttggcagaaaagggatggcgtgggttggaggggtgtattcctgggttcttgcacaattgctcattagaaattcacttctgtttgggtgttggaagctgggcgc

SEQ ID NO: 550705 - DNA, 308 bp, Homo sapiens
cattagggaaaaaagccagtttattttatttttaacagggcctttttctcctttaattaaaacaaaccattttaccctttataaaaacataacttagtttttagtttttcaaaaagggaaaaattttggggggggggaatttaggaaatcaaattttttaaagggggtacctttagaagttcctttttcaatcttaatatattaacaggctggttcccaggtccattacccagcttttttttttacagggaatttatcaagtcctacccaacaaatagtctacttttaaaaactgggggtaaaaatgt

SEQ ID NO: 550706 - DNA, 1005 bp, Homo sapiens
gcagcttccccgcgagcggacgcggcaggcctctgtctcgcttattcttatttttcccccctttcccctttcttattgtctttctttctcccctcccccccttcacattcccctggaggggacccggggaaggggaagagccgggtctcacccagcagacagcacaagggcaacgcagagaacacagagacgaagaaagaccaaaccaaacacgtgaaacaaagcgacagagaacatacagagaccagagaagccaccagagcaaccagacgtgagaagaacagaagacagacgacacacaataacaaagaagaccgagaagacacacagcacgaaaagaagcaaaaccaccaacgaacacgcaaacacacagacacacaacgaaacagacagcccgtacaagtacaatagaaaaaccacatgccacacagacactcgataacgaaagaaatggagctaagaagacaagctgacattgggagccgccaccagctgaaccaggggtgaatcagcacatgataaacaagaacgggtgagaaaacagttaaagagaaaaaaagagacacagaggacacaacaggaacacaaggaggcagacaagagaacacaaggaggccaaatcaaacacagaagcaccgaacaggtacacaagagacatagagggcgtagaccaagggagcagaccacaacgaccgcgtggaacacacgaagcggacaaaagagacgataacagagagagccacacaaacgacgacacgacaacacataggagcaccagaatgacaacggcaaaaaagacagcccccaagaagcacaaaccagagagacacagaagaagctaatacaggccaacagcagacagaagcatagagtaacgagcgaccacaagaaccaaagcagagcacaagaacggaagacagcacacagaaccgaacacagaaagacaagacagacgaacggacaacaaagagaacacaaatactcaagccataccacgcagaggag

SEQ ID NO: 550707 - DNA, 286 bp, Homo sapiens
ctcacggtggcttaaagctgtaacctttaactttccatattctgcctggtcccagaggctcctggaaccacataggtaaaaactgctttcataattgtaacactttctaagttggtttgatactgctaacacagaatcagatctagagaatgggattagcttctaatatagagacatcaattcttggcttgtcaagaataaaaatctcatgagcataatacaagttgtactggtcttcagatttatataataaagggaaatttctttcacttccctcgtaaagctt

SEQ ID NO: 550708 - DNA, 107 bp, Homo sapiens
actagtccaggttggtactagtcacgggttggctactagtcacggttggctactagtccacggttggctcaattccattccagcgtactagccaaccgtggactagt

SEQ ID NO: 550709 - DNA, 365 bp, Homo sapiens
  misc_feature (6)..(6): n is a, c, g, or t
  misc_feature (19)..(19): n is a, c, g, or t
ggtatnattattggctttnctctccactgatgacagttgcactgacctcgactcttgaggatcccccatcgcatgtgccgctccctggacctgtacggtatgatcactgaggttaaggcacaccatgaggagatggccaaatgcaggcagcactgaggctgaagcctgtgaccagaccaagattgagacccttcaggcccaggctgggaagcatggggacgacctccggaatacccggaatgagatatcagagatgaaccgggccatgcagaggctgcaggctgagatcgacaacatcaagaaccagcgtgccaagttggaggccgacattgacgaggctgaggagcggagcggcacatccgttg

SEQ ID NO: 550710 - DNA, 951 bp, Homo sapiens
  misc_feature (8)..(8): n is a, c, g, or t
  misc_feature (131)..(131): n is a, c, g, or t
  misc_feature (153)..(153): n is a, c, g, or t
  misc_feature (185)..(185): n is a, c, g, or t
  misc_feature (220)..(220): n is a, c, g, or t
  misc_feature (283)..(283): n is a, c, g, or t
  misc_feature (287)..(287): n is a, c, g, or t
  misc_feature (338)..(338): n is a, c, g, or t
  misc_feature (370)..(370): n is a, c, g, or t
  misc_feature (397)..(397): n is a, c, g, or t
  misc_feature (506)..(506): n is a, c, g, or t
  misc_feature (522)..(522): n is a, c, g, or t
  misc_feature (591)..(591): n is a, c, g, or t
  misc_feature (604)..(604): n is a, c, g, or t
  misc_feature (606)..(606): n is a, c, g, or t
  misc_feature (620)..(620): n is a, c, g, or t
  misc_feature (630)..(630): n is a, c, g, or t
  misc_feature (636)..(636): n is a, c, g, or t
  misc_feature (654)..(654): n is a, c, g, or t
  misc_feature (657)..(657): n is a, c, g, or t
  misc_feature (690)..(690): n is a, c, g, or t
  misc_feature (710)..(710): n is a, c, g, or t
  misc_feature (726)..(726): n is a, c, g, or t
  misc_feature (730)..(730): n is a, c, g, or t
  misc_feature (757)..(757): n is a, c, g, or t
  misc_feature (801)..(801): n is a, c, g, or t
  misc_feature (807)..(807): n is a, c, g, or t
  misc_feature (809)..(809): n is a, c, g, or t
  misc_feature (811)..(811): n is a, c, g, or t
  misc_feature (813)..(813): n is a, c, g, or t
  misc_feature (815)..(815): n is a, c, g, or t
  misc_feature (821)..(821): n is a, c, g, or t
  misc_feature (828)..(828): n is a, c, g, or t
  misc_feature (830)..(830): n is a, c, g, or t
  misc_feature (858)..(858): n is a, c, g, or t
  misc_feature (885)..(885): n is a, c, g, or t
  misc_feature (908)..(908): n is a, c, g, or t
gttatatnatatgccttttgtgttagttccatgttattttaaaatttctattggctaataaaagcttttgctctatagatccagatatatctagaaaagcacatgatagatttttttgcaagctgaatgcntgagacattacatttaccttanggcacaatgagaaagttaccaaatccaatgtntgcgttagaacgatacagcgactattacagttgcnaaaccatttatcagcttatccacatatgttcagctgggtccccacgtgacataatctaaaggnagancagcatcttactgcacctgttctccatttcctcacagaaagggactgtganattttggctctttccatgttgttctgctcttnacgagagggcagggttatacgatactnaagatcatgggcaggtactgttcgttcgatatctgatttcagctgttctgagccgtgttgtgacggctgagttttttcgttaacctctgcggggcgatgcagcgctggntgaggttgtggaaggnaatttgctcccgttcctgcgtgttatactttcgaatgaggatgttgtggaagtggtgagagagctggtngctgagacctgananggcctgccttagcncgttcttatngatcancccggagttgttccggtngtncgttcgggagaagttctgccagttcgttaagtnctttcacacacccgttaacncgctgaagttcacgcnggcnttgttcttacggtcaaacatggatatnatcgacctgacagttactggatttaagggagttcacgtgccgtnggaganancntncngaagcncggtgtntnaaaaaacttcacttctgtttttattganccttttggaaacgttccaaagggagcnctggtccggcagcccgcgccttnccgcggggccagggccggccccagggccgggggcggttagagt

SEQ ID NO: 550711 - DNA, 227 bp, Homo sapiens
aatatgtgcacatgtatattatcaatatcactcatcctttatatttatcatcttttttgaatatatttgccaccttattgcatatcgaagaatatctccatattcttatagctcgtttttcttcggttcctttctcaatcctttcctcccttattcggttacctcatcgaattcgttcagttctcaacaatgatttctcaaattttcaatcactatagatcatattg

SEQ ID NO: 550712 - DNA, 101 bp, Homo sapiens
  misc_feature (2)..(2): n is a, c, g, or t
gngcaccatgtgctggcagtacaggtatgagtcactgtgcctggccaagaacttaagtacttttttcagtgcatgtctgctgtggctaaattctttccttt

SEQ ID NO: 550713 - DNA, 114 bp, Homo sapiens
tgtatatgacactatacaaatgtctgtagaagaatcaacccatctcccgtgaaactggggagccatatctgcctctctccagaacccactccttctggggggtctctgggtacc

SEQ ID NO: 550714 - DNA, 163 bp, Homo sapiens
gagccggccctccttatctgatagtgagctcaggtgattgatactcctgatgcgagtaatacggatgtgtttaggagtgggacttctaggggatttagcggctcaacatttttggtagccacaggcttccacggacttcacgtcattattggctcaactttcc

SEQ ID NO: 550715 - DNA, 426 bp, Homo sapiens
caggaaacagtatacctctttgacaaagccgtgacgatacatctgttgtcccgtggcactttcttggatatctggccatgtcatatatactcatgtctgctgttgtaggactgtattatgagatgttgctacccagaatgagggaacgttcgctttctcaattatcaagatttaagttgagttgtcttatcattgtctttggtctttaattgaggaagtttaattttaaaataaaagtggaagaagcacttgtagtaagggaatgaatacactcacactcaggatttattgacagtgagaacttacatggtatttccactgatcttttatacattcaataggtttttagaggttttggacaggatgctttaaaaaaaaagattaaaacattaaaagaaaacctttttattttgaagtaattataga

SEQ ID NO: 550716 - DNA, 746 bp, Homo sapiens
ttacagaaaacaccaacatggggagggagtttatgatgcaaaggctatggcaacacgtcggctagcttcagggtagcaccgtgagaaatgggctgtattgatactgtgaatgtttgttttccaagctgttttatacaggtttgttttttcatggtgtagggtatttatgacaaagtaaatgttgagaaggttaaagataaattaacattatccaccaaatgctaaaaatactgatgtgtaaatcacctttatcgcctcacctgttctacaagcttttgtggcttgagggcttttgtttttggcttttgtctggatgaaagctttgcccagctgtgtcttaaaaacaattcctcatgaacactaagattaattgtgtctgtatctctggaactgggtgctcatgttgcgtttaatgagcttgcaacccttccccgtttgctttgtttaaggaggtgcctatgttctttgtggaggaatgaaatggaacttctagtgtgtgtgtgatgtattgggcgtttgcacacacgcgtgtgctattgtagcattacaaaaagtggcatttccttgttcaccttaacccggtgtgagagttttgcagaacactttttttcgggaagtttaaggtgaatttgaaccatgcctattcctatgaacaatgttttcgacagggggactaaaggccacctgtgccaattacattttgtccggtttacggcaccccattaccaaattgcaaatgcttttcc

SEQ ID NO: 550717 - DNA, 804 bp, Homo sapiens
aaaaagtcagaggatggttcatggggttatcgcactcccatatatatgccaaatagagcgattagactacaagctgttctagagataatcactaaccaaactgcctcagccctagaaatgctcgcgcaacaacaaaaccaaatgcgcgcggcaatttatcaaaacaggctggccctagactacttattagcagaagagggtgcgggctgtggtaagtttaacatctccaattgctgtcttaacataggcaataatggagaagaggttctggaaatcgcttcaaacatcagaaaagtagcccgtgtaccagtccaaacctgggagggatgggacccagcaaaccttctaggagggtggttctctaatttaggaggatttaaaatgctggtggggacagtcattttcatcactggggtcctcctgtttctcccctgtggtatcccattaaaactcttgttgaaactacagttaacctcctgacaatccagatgatgctcctgctacagcggcacgatggataccaacccgtctctcaagaataccccaaaaattaagtttttctttttccaaggtgcccacgccaaccctatgtcacgcctgaagtagttattgagaaagtcgtccctttccccttttctataaacaaatagacaggaatgggaagattctcctcggggcctgaaagcttgcgggattgaataactcctctcctcaggccagtcccaaggtacaaacttgcaacagcagcagatagcagaggcaggaagagagtggtggaagacacgtaccccctgaagatcagag

SEQ ID NO: 550718 - DNA, 872 bp, Homo sapiens
gaggctcggaccggcccgcgagttgctgcagtccttcgcgccctcctcgcctcccaaccgaatcatgctccagttcctgcttggatttacactgggcaacgtgcttggaatgtatctggctcagaatatgatataccaaacctggttaaaaaaacttgaagaaattaaaagcggactgtggatgccaagaagaaaccccctagtgcatgagactgtgcctccagcaatcgcttcaggatatacgtgattctacggctctgtgaggggcctcgtttactatctgaaccaaaagctttggttccgtctccagccctcagcacttctcttctggctagacccgtgtgttttggcttaaaagcaagcaaaatggggccccaattgtgagaactaccggaatttccaaaatactcacctcttccacataatccctttccaactgcatgggaggttctaagactggaattatggtgctagattagtaaacaatgactttaatgagtagggtcttctaatcgtggggattttactaccttttttcaaacagaaaatggatgagttggtatagctggtcagatacaaattaatagtgactccaaggttaagtcattataaggggtacttgtaacattgtggtactaaattatgtggcttggcagtattaaaattgatctagagcacagttggggaataatcactatttggacggtggagcacacctggtgttgtaattaacccaaatgtattggctactgaaaaaggttgaaccgtgcggatggggagaaaacacacatggtgtgcgcaagaaaaaaaagggagggcaagagtagagagtcacaacacaacatgtattgtgtaggagagagagacccaaa

SEQ ID NO: 550719 - DNA, 637 bp, Homo sapiens
cttgtaaatattcttgtttggattttctgtatacattgaggaagcattaccggaatgaagagaaacaacccagtgttgcctttcaagtgtgcattgtgccctgtgggcccatgtcccctttcaggagcttcttgactagagagttactcgaaagaggccagagctgaaacttgtgtgtacattttgattgccagtatcagtttggaaaaatgtttaaacttaggtttaactttttggcatggtggcgcacatctgtaatctcagcactttgggagacagaggcaggagaattgtttgagtctaagagtacgttaccaacctaggtgacataacaagatcctgtctctaccaaaaacaaaataaattaggcaggcgtggtagcatgcacctgttgtttcggcctcccaaagtgctgggattacaggcgtgagccatcacacccggccaacatgttatatatgggatagaccctgggtctatcttaactttccaaccatgcttgttcctttcacgcaagattactacctaaacttgtcttctttcttattatggagtgacagttaaaccctatgccttgatttaaggtctcacttcttgtggaaaacagaacttcacctgaaaatcgaatttccaatgc

SEQ ID NO: 550720 - DNA, 414 bp, Homo sapiens
tgatagaagagaagaaacaccaaggctgttcctgtgtggctcaattgccttggccattccatacttcacatctgcctgtatctatgcccttcgctgtaagacttggcagtgtttctcaccaaaaagatctagtttgtttttttatgagactcgatgagagcagaaaatttctgcctcctccctgactcctgccaccgccatggcagcattcctctgtaggaatataagagatacaagaaggaaacgtagatcttcccaaatgaggccatcctggatcacttagccccctcagtgtccaccagctgattacagattccttagtgaacctagcaagatcagtagaacccagcccatatcatcagaactgctggattcatgagaaataataaataattgttgtttaagccaccaaaa

SEQ ID NO: 550721 - DNA, 521 bp, Homo sapiens
cttgtaaatattcttgtttggattttctgtatacattgaggaagcattaccggaatgaagagaaacaacccagtgttgcctttcaagtgtgcattgtgccctgtgggcccatgtcccctttcaggagcttcttgactagagagttactcgaaagaggccagagctgaaacttgtgtgtacattttgattgccagtatcagtttggaaaaatgtttaaacttaggtttaactttttggcatggtggcgcacatctgtaatctcagcactttgggagacagaggcaggagaattgtttgagtctaagagtacgttaccaacctaggtgacataacaagatcctgtctctaccaaaaacaaaataaattaggcaggcgtggtagcatgcacctgttgtttcagctactcaggaggctgaggtgtgaggattgtttgagcctgtgaggtcgaggctgcagtgagccctgattgcacaactgcactttggcctgggcaacagagtgagaccctgtctcagaaaaac

SEQ ID NO: 550722 - DNA, 266 bp, Homo sapiens
cccgatagcccgacaggacggaaaataaggccgggttgctggaccttgcctgacgcatctgtaattggctggagctccgatgatagaacacaggcagtgggcctgtatgatgaagatggaggccgagctcgtcccctccgaggtgctcatgcaccaggccatccagaccatcgagttctgcctgggctgcgtctccaacaccggctcctacctgcgcctgtgggccctgagcctggcccacgcccagctgtcgggctagtcggtgg

SEQ ID NO: 550723 - DNA, 147 bp, Homo sapiens
  misc_feature (110)..(110): n is a, c, g, or t
agccaacaccccccactgggaaacagcagtgatacctttacataactaagctatactaaccccagggttggtcaatccgcaacggcgtaagagtgtttagatcacccctnccaggcagcatgtgctattgaaacttctaaaactagg

SEQ ID NO: 550724 - DNA, 206 bp, Homo sapiens
attcgtagttttgcacttcagcctgggcaagagagtgagacttcatcttaaaaaaaaaaaaacgggaatttagttatatttaacaagtaatcattttgggaggccgaggcaggaggattgcttgaacccgggaggtcaggggctgcagtgagccaagatctcattactgcactctatcctgggtgaaagagtgagaccctgtcgca

SEQ ID NO: 550725 - DNA, 174 bp, Homo sapiens
tgttccgcggaatggatgacgccacgctggaagatcgcgtcgtcgggccgacccacccctacagggcggcgtggcctcacacaccacgacgctcgcccacgagctcgaggcgggcggtcacgacgtgaccctggtgtcctggagccacctctacccgagcttcttctacccggt

SEQ ID NO: 550726 - DNA, 1444 bp, Homo sapiens
  misc_feature (285)..(285): n is a, c, g, or t
tccactcagacacttatttaataactggtaaaaatccaaaaaaattagcatcaaatcttggaatgtctgtggatgtgagaacgctggcgggtgttgggtttggacgtgggcgctcagccactggacgctggcctcaaccgggccaaggaacggggatttatgagatgagactatggcgggatcttctattattggtcttcatctcatgggtggtggtattaagtggtatttataggttctcaattaacagcgcttttggtcccaagtgggcctctggagacgctnggagaggagaagagacttaaaggagaactggtgtgtacgtgagatctcttgagatgtaacagattgtacagaccttacggcgcgagccgagagagctctatagggggggggggagaagagatatttcacaacaaagagttcctctcatttctgtctctaaatatatatcccgaggaatagaggtcctagagagagttgggcgagttcccctatccacaagaggggggtccctatatggaggcgcgctaaaaacagaggggccctcgcgggtgtgtctctctgagaatcttatgagaagaattctgaggggtcaccctcccgagggggggacgcccaagggaggtctttggacacacctgggggagacgttttcgcgccagggagatttgtgaggccacctatgagaccacagggtcaatatttctgggagtcctcttctaaatcccgagcaaactctggcgacgccccatctttggattcgattggggcccgtgtcacgcgtctgagaatggcctaaacaccagcgacgggtcggcgctgtcccaggcaaagaaacccccaaatttcccatagaggggaactcccaaattcccaaaggggccggggggagagacacccagtgtctgctcggtgggggaaccacacgccctccacgtggggccgacaacacactccggggcactcggtgaaggaaaccccaacggggggaggaggaaccacccaacagggcggcggggagataaaacccctggtgatcccgcattagtgtagacacaacaaagggggcgtaccacaccaccgctgtccacacaagcaggtcaaactatcagtactatacactatgatgtacaaccaacgacaacagacaaacacagccctcaccccagcgcccacacccaaaaataaatgagagagcgcaggcagcagaggttgttaaatacagacgaccaagcaagcaaaacgtgttgttcaatgagagagaggagtatcatatgacagggagtagcacccaaagttatcttgctcgggctactaatggcaccctcacacgctgtcgactcatgatacttacgagcagcgtggactaagatggcgatactattcttaacgtgtagactacatctgcagcttcgtgcagcgtatgatcgtatctgtatgt

SEQ ID NO: 550727 - DNA, 430 bp, Homo sapiens
  misc_feature (41)..(41): n is a, c, g, or t
  misc_feature (81)..(81): n is a, c, g, or t
  misc_feature (176)..(176): n is a, c, g, or t
  misc_feature (181)..(181): n is a, c, g, or t
  misc_feature (241)..(241): n is a, c, g, or t
  misc_feature (260)..(260): n is a, c, g, or t
  misc_feature (268)..(268): n is a, c, g, or t
  misc_feature (278)..(278): n is a, c, g, or t
  misc_feature (367)..(367): n is a, c, g, or t
  misc_feature (378)..(378): n is a, c, g, or t
gagcggcggcgccatcgagacccacccaaggcgcgtccccntcggcctcccagcgctcccaagccgcagcgccagcgcccnttcagctagctcgctcgctcgctctgcttccctgctgccggctgcgcaatgggtatggcgttggcggcgatggcggcggtcgagcggccatgcgnacccnggtaccagcagttgcagaatgaagaagagtctggagaacctgaacaggctgcaggtgatngtctccaccttacagcagnatttctgnagagagcgcngatattttgactacaaggatgagtctgggtttcaaagccccatcttacaatgtagctacaacactgcccagttatgatgaagcggagangaccaaggctnaagctactatccctttggttcctgggagagatgaggatttctgggtcgggat

SEQ ID NO: 550728 - DNA, 412 bp, Homo sapiens
cacctacaagtccacccatccttcgtactcactcaccatacaatccatgaccattcaactgacgaataatccatcagatagatctatccatccaaccaaacaccaaatccgtacattttatccttccatccatttatctacccatctatctatttaactacaccctatctcccttaacgtctgtccacccaaatcatccatccagacatccatccacccaaccactcatctaaccaatcagcctatacaactaatctacctaaccatccatccataccatccatccataccatccatccttccataccatccatccatccatcaatccatccatccatccatccatccatatataccacaaaccaacaagttgaaaacaaaggtgatgaaccaaataaataaggaacattga

SEQ ID NO: 550729 - DNA, 100 bp, Homo sapiens
gtatcccctattctcattgtccatggatgccaggacagccttacggatggaggtggctttgtagtgcagcttgaggtggtccagcatcagggtaccgagc

SEQ ID NO: 550730 - DNA, 722 bp, Homo sapiens
tgccatggctcatgcgtgtaatccctgcactttgggaggctgaggcgggctgatcacctgaggtcaggagtttgcagccagcccggccaacatggtgaaaccccgtctctactaaaaatacaaaacaaacgaaacaaaaaacaccaaaaattagccgggtgtggtggtgcctatagtccccagctacctgggaggcacaagaatcacttgaccccaggaggtggagattgcaatgagctgagatcaggacactgcactacagcctgggttacagagcgagactctgtctcaaaaaaaaaaaaaagggaatttgggaaggcccctaagtagaaaataagactatattggggaagtaaatttgtggaaacataactaggtcatatgggaattattaacaaagggccagggggttcaataagatacggaaatgtctataacttagggccttaatcggtgaaggctaagggataatttcctcagggggtaatggagggattaaattaagattaagtaataaaaggtgtaaaggataagggccaggcaattaagctcttaatataggtgaatggtatacctcgggtataaatattttaacagcggggtaatgacactgggtacaccttttggctttaagaaataattcttaatctgggtaaagatgtcctgccagtataaccattttaatgggtaggtgcacctaggaccctaaggaagggaataaa

SEQ ID NO: 550731 - DNA, 916 bp, Homo sapiens
gatacgtccgaaagaggcatcatgatactgcgatctataaccgattactgatgaatcgtctggagaggttgatagcctggcagcgggaggacactgtcacgaagtattatgctaggtaccaagagcacatgggtcgccattgtgctagctgcatgaataagtgcaacttttggtcaggcgtccgatgtaacggtcttacagtcgaggacaggccgttcaccatactactataaatctcatggcctctgataattaacgacccacactgagtgaaatatgtggcatgtcgaaacatgaatagcatgcagttatcaccaaggacattgataagtacgaatcttggtagagaacgggtatgagtgcgaacaaatttgtacaactgtggtagaagggctacatactcccactgtttgtccatgctgttatcggtaattgagtaccgcacaatgggtgggtgcagttcgccttttgcaagagcacgggcggcaagtagactgctaatgggtgcgcaatcattgctggtgatactatgggaggccaaaaatatgtacgaaacacttaaatggccatttagaaatagtacacgaggcaccctggaggctatttggctcaaacgggtggggcaaattgatggttgctagagcactctagattgggcatcccaatgttaccatgatggaatgattcggtggagtgaagtcaagtatagacggcggtctgaccgctggttggaaagcagagtttcaaggccatgagtggttgaagactaacagtgacctggtacacatgaagttgagacgttcactcgaaaggggttgcatgaaaggcagaggcgcagcttaaatgtgacaacgaccgggtgagagtcaggggaaaactcccgaggaaaatcctgacggacagcttgtagacccag

SEQ ID NO: 550732 - DNA, 163 bp, Homo sapiens
gggggggcccccccccccctttgggggttggccccttttttccggggggggcccccccttttggggggcccggggttttttttcccccccccccccccccccccttgggttttttttttttttttttggggggggggggattaaataaggggttttttttcca

SEQ ID NO: 550733 - DNA, 407 bp, Homo sapiens
  misc_feature (2)..(2): n is a, c, g, or t
  misc_feature (107)..(107): n is a, c, g, or t
  misc_feature (114)..(114): n is a, c, g, or t
  misc_feature (116)..(116): n is a, c, g, or t
  misc_feature (366)..(366): n is a, c, g, or t
  misc_feature (376)..(376): n is a, c, g, or t
  misc_feature (404)..(404): n is a, c, g, or t
tnctacaacataccccgcttccacctcaaggctcatggatctatgttgaaatgtgtatgagagtcagaggtgatggatggctccatggaaacagtgtcttctagatncaacatngntggatacacatatgaagtcacaggaacagtgacaatatgaacgaaaccaatctacccaaactcaagctatataaaatggcagcctggaggaggaaacagggggataaagtcagacccctaggtgaggaactttgatattttattgctgctggaagagcacaaagtcagttttgttcaatagagtatcacctgggcttacaaccacactcccaaagacacgctccatggcccacaaagttgggacaacgcnaacttagacnttgaggggaccagaacttttggggattnttt

SEQ ID NO: 550734 - DNA, 182 bp, Homo sapiens
cggttgctggtttggggtttctttctggggtgaggaagtgttttaatattggccgttggtgatgtttgcacccctctgaatatgctaagaacaaaaaaattgcacactttaaatggatgaattgtatggtatgggaattacacaattatgtctcattaaagcagttattttaaaaatctaaa

SEQ ID NO: 550735 - DNA, 148 bp, Homo sapiens
gacactgcttttttgatctcttcaagttttttttctgtatctatcaaagcctcttgtaaattcttatttttttcttccagaatctgcagctaaggagaatgtttacagttattacacatgaatattaatacgctctatagaactgtac

SEQ ID NO: 550736 - DNA, 102 bp, Homo sapiens
caggacatgcaagctggggcgggaggtggaggaggaggaggaggaagaggaaacaagatagtgacaaggtgatgcagatgtgacctaggatgatggaccgcc

SEQ ID NO: 550737 - DNA, 942 bp, Homo sapiens
ctccagcaggtcgatgaggtaggcaggcctgatcctgggtgactatcctggtgtatctggacagaagtgatggtcgagtgagttggagcaggggcatggatcactgaccaagcactggatcacccgctaccttacagggctgagggagctgcgttcgagaactggcctcctgtcacatctgctttctctcactgactggctacatgaacggaagcagaggctagagctgggtgacatctcagaactggcatctggacctccctaactgggccccgcatggtcccatttgctcattagaatttcctctcacatcagtgggatacagaattcagtttctcccttgccaggtccttgggatggttgacccctgcctctgacagtagacttttgtgagtctgctaaggtagactcatcacaacaccatcggctctggggttgatacctgagcctgcaatagagccctgaaatcaagagcatggttgagtgtgtgaatatgatgtgtgcacatgcttaatgagcgtgaaagtgtgcaacgttttgtggagaggacggtgttctggctgagaaaggtaaagaagaggattgtccagtaactgcttttgcaaggcgtggtgtttgcatctttacccaatggacccatgcaacccagaaattggggagtggacaaagaacggaagatctttatgtgtagcccaggactcagaaaatttgatctggagggctatattgatgtattaaccaggtaaaagctccgatgggcaaactgatgtgtgcacgataggtgaagatacaagaatgagctattaagatcattgaaaagactaatggtgcagcgacaaattatctatatgtagtaaacactattaataaaagaaaaatgtaataaatattgttaagaaaaaaataaagaaaaataagaaataaagagaaaaataaaaaatt

SEQ ID NO: 550738 - DNA, 1037 bp, Homo sapiens
caaccccggtcatctactctaccattcttggcgggcacactcatcacagcgctaagctcgcagtgatggtttagctgagtacggcctagaaataagcatgctagctttattccagttactaaccaaaaaaataaaccctcgttccacagaagctgccatcaagtatttcctcaggcaagcaaccggatccatagatcgcttgtaataggctgatcctcttcaacaatatactctcgggacaatgaaccataaccaatacataccgaagtcaatactcatcattaataatcatgaagtggctatagcaataaagactaggaatagccccctttcacttctgagttcccagaggtttacgccaaggtcaaaccctctgacatgccggcctgtcttcttgctcacatgagaaaagactagcccccatctcaatcatataccaaattctgctcccgtcacgtaaacgtaagccttctcctcagtctctcaatcttatccatcatagcgggcagttgaggtggattaaaccaaacccagctacgcaaaatcttagcatactcgctcaattacccacataggatgagtaatagcagttcgaccgtacaaacctaacataacattcttagtttatctatttatatgatcctaactaataacgcatacgatatgcaattaactcagaacaagaacctactaatatgtcggagctgagagaagctaacatgataacacccgtaattcatacagcctctcttctaaggaaggctggccccggtacgggtttggcaagtggcatattgagaattttgaaaaaaaatggtcgttttccacaataatggcaataccccttagtattataacaaagaataaatccaaagaagaagatccacttatagaaaaatggagtgggtagagaaacccttccacaaggagaagcacatccttctatttttaaacaaaaaaggggggccgcggcgcacttagatcgtaatagggagagtagttatctatagcaatatatatatcgtcaaaacaaagta

SEQ ID NO: 550739 - DNA, 368 bp, Homo sapiens
tactcctacctctctctgggcttctatatcgaccgcgatgatgtaggctctggaactgcgtgagccacttcttccgcgaattggccgaggaagaatcgctgagggctaacagcgtctcctgacgattcaaaagcagcgtggcgtccgcgctctcttccagtgacatcaagaagccagctgcagatgagtgggtgtacaaccccatacgccatgaaatgctgccatggccctgtagcaaaagctgaagcaggcccttttggatcttcaatgccctgggttctgtccgcacggacccccatctctgtgacttcctggagactcaccttcctagatgcggaagtgaagcttatcaggaaagatgaggccca

SEQ ID NO: 550740 - DNA, 229 bp, Homo sapiens
ctaattggttcttcgatgacggatcccatgttgctgtggctatggcgtaggccagtggctacagctccgactggacccctagcctgggaacctccatatgctgcgggagtggccctagaaaaggcaaaaagacaaacatacacacacacacaaaacctcacaaaaactgtatttcagtgcaaaataccaagtccaacgtcatcgaagacgcacttaggggtacgagctc

SEQ ID NO: 550741 - DNA, 333 bp, Homo sapiens
tgtgaaagcacaccttggctgagagtcaaatcaagaacacagggcgtatttacaatagtcacaaagaaaatcaaatacctaggaacaccaagaaccaaggaggtaaaagatctctacaaggagcactataaaacactgctgaaagagatgaaagacaacacaaataaatggaaaaacattccattctcatggatatgaagaatcaatgtcattaaaatggccatactacccaaagcaatttacagattcaacgttattcttatgaaactaccaacattattcttcgcagaattagaaaaaactattctaaaattcatatggaaccaaaaaaga

SEQ ID NO: 550742 - DNA, 245 bp, Homo sapiens
  misc_feature (204)..(204): n is a, c, g, or t
tggtggccgtcgacctcggcgagggcgccgatgcccgtgacgttgcggaacgcggtggcgcgcaagcgcggcacatcggttgcatcgacgtggcgcacgacggcctgagcgagaggatgttcggactctcgttcgagtgcgcccgcgagcgccaggacccgatcgcgatcgaagtcgccgacaatgacgtccgtgacctcgggntcccccttggtgagggtgccggtcttgtcgaagacgacggt

SEQ ID NO: 550743 - DNA, 112 bp, Homo sapiens
ggtgctactcctcctcaaatgaacttacagctggacaacgtatgaaccctgaagatgcctcttctagtccagttgggtctcctcaattcagacagatcagcaggctccacct

SEQ ID NO: 550744 - DNA, 189 bp, Homo sapiens
tgtacctgtggttccagctacttgggagactgaggcaggaggatcatttgaacccgggaggtggaggctgcagtgagctgagatcatgccactgcactccagcctggttgacagagcaagactccatttcaaaaaaaaggaggcctatgagggtaccatgctgtggggattcaggagcaggaggatgtt

SEQ ID NO: 550745 - DNA, 142 bp, Homo sapiens
tagctaggattacaggcgtgcaccaccactcctcactaactctcgcatttttagtagaagcgaggggttgactatattagccagactcagctcgaactcatcaccttgggatacgtgagccgcctcctcctatagtaataaa

SEQ ID NO: 550746 - DNA, 1062 bp, Homo sapiens
atggagcccccggactgcacctggcccaagtgcttgctgcggggccccgctggctgctgttgctcgcagtcctgctggcgtgcgcaccacagatgcccagtgctggagtgtgcgctatgtcttgtacccccgctggtggagtgtgatgcgaggaaagtctgtcattctggactgcacccctacgtgggaacccacgaccattatatgctggaatggttccttaccgaccgctcgggagctcgcccccgcctagacctcggctgagatgcagggctctgagctccaggtcacaatgcactgacacccggggcctgcagtacccccataccagctggactcccaggggctgccttggtgctgtgcttgaggcccaggtgggcgacgagcgagactacgtgtgcgtggtgaggtgcatgggcgggcaggcacatgctgatgtgccactgcgcggctcagcgtgtatgcaaagccagaggccactgaggtctcccaccaacgaaatggacactgtctgtggatggaggactctgcccaggagatcgcaacatgcaaacagcggaacgggaacccggcccccaaggatcacgatggatatcgcaagcgggcagcgccatggaggtgcccggagagactgagcccagagggctacagtgaccagacggaaaggaccgggaggaccaacggggcctgatcgacgcgcgcaagccactggaacacacataagataggcagagtcaccgacagcggacttgacccgagaacggcgcagagagatccaaggtagcagccgggccgaagaaagccagacttgggccagaggagagcacggcccaacaggagacggcacataggaacagagcaaccacagacatataccaaccgatcaaaccccaaagaagacaagccgcgaagagggagccacagagaagcaggacgagggagtgggagcgagagcggagccaaagccaaggcaaaggggaatgggaaacaggaaaagggagagaagagggggcacaggagagggaagagccaagaaggagacggagaagcagcaagagcagg

SEQ ID NO: 550747 - DNA, 349 bp, Homo sapiens
ggctcacttcagttccttcagagaaataatagtgagctccttttcctgcgttttctgtggctggaacaacacggagatccagtgcggagtctggatccaggaccagggagtgcgctacactttgtctgtcagggctctggaggacatgaacagagaagtggtgaagactgactctgctgccacaaggattcctgagctagattttgaaattcctgcctttagccagaaaggagctctgaccactgttgaaggattgatcacccgtgctatctctggcctggagcaggaccagcctgcacgaagggcaaacaaagatgctacagctgaaagaattgatgagttcattgtc

SEQ ID NO: 550748 - DNA, 512 bp, Homo sapiens
tggcctcttctctgaatttgctctcccaaactttttcacagtttcccagaacaagctccaaactgacatgattcttcctcaagattctcgtcacttctgtttccctgggttggtttccggacaaagggttcctttttttgttaactttgtttgtgtgtgtacttgggggagggtgggatcggggtatgggttcagaaaggaggcaggcaggcatgcccttttgccattgcaggaggaaatagcagtccagggacaggactgttgagaaagcagccatgagcagcctgttgggctctttttaaagccgcccaactccaccctgcagcatgagaatctgagaaaaggatagaaaacagtcatttccaggcaggcgtggtcgctcatgcctgtagtcccagcacttcgggaggccgaggcgggcagatcacttgaggtcaggagttcgagaccagcctggccaacatggtggaaccccgtctctactaaaaatacaaaaaatacaaaaaaaaaaa

SEQ ID NO: 550749 - DNA, 640 bp, Homo sapiens
tcagacactatgcttgcctccccaccaggaggagggagagtgtgccgagctagaaacactggagagctagctgagcgctccgatgccgggcctgctgatccctgagatgaaggagacctaccatggagcgcttgcgggcagcccctgagcaaggtatatctgaccagctcaactgggcagctggaccccagtcacctgtgtgctccctgtgctgacgcccccagaccacgtcctttcggacctgtgctctcccgtgggcatgccccgtgagcatggctcgcgctttgcgcacctcttcgctgcaggtggctttcatgccccaatggacttcgtagccgcttatacgcgtccgcaccagtccgcggtcacctgtccacatacaggctgcgccgcgcccacccctgcacccttgcccggggcttgcgccaacccgctcgccatgtctccctcgttatgctccgtgcagcgcctgtctgtcgctcaaagcacctgccaatcaccggccgcgcaggacggacagatggtgcaccacgactgacagatcgtgctccccatagcacggcattacccactcagtggcacggtccttcatgcaccctcccagcgccacaccgtgtcctccttgtgtccacgttggctc

SEQ ID NO: 550750 - DNA, 135 bp, Homo sapiens
gtcccacttcatatagattgtttgggcatactgtccgcatgcgccgatcaagacgtagtttgacgttttatgctcaccctgcatcagaggattgagttaacgcgcatacgctagatgtggctaaaattaatagga

SEQ ID NO: 550751 - DNA, 228 bp, Homo sapiens
gtaattactgtaatcacagagcggggtggggcttctgcaccccagtgtcccggacacacttcctgtcaaatcacagagcaggatggggcttccacaccccagtgtcctggacacacttcctgtcaaatcacagagcaggatggggcttctgcacccctgtgttctggacacacttcctgtcatctctgcccctgtgtcggaggcttcaccttctctgctggatacctt

SEQ ID NO: 550752 - DNA, 1522 bp, Homo sapiens
  misc_feature (903)..(903): n is a, c, g, or t
  misc_feature (1279)..(1279): n is a, c, g, or t
tttgggatgaagacaattttgtgggtggtgtgtgattatatttttgttaacgtgcccctccccttttgtttggtcccctcctaaaggggtatttttcccctctagaagaggttgtgtcttcagagtagtgctccgttgtgtattattgaggttcgctgctgttgattttctttcaaatgggggcacacaccgacatagtgagtgtgtgttgagagtgcggccacggcaggaggaattgtttttaacccgtttttaaataagcccttttccccccgtataaaatggtcctcccacgttgggggggatatgttgttgcgcccccgaagatgttgtgaataacattggggtttccgcttatttataagttgttgggggaggaagaattaatttaaaaagacggctcttttttttttttaagagccctccccctctgggtagaagcgccctatattaattgtatttaaggggtcccaccaaaaattaaggtcttgtttaaagtatatattataacggtgataatcttttcgagaataatatagggagaaggaggtcccccccccccaacaccaccgtagtctggtggaggggcgactcaccggagttttatgaagagttttttcctcgcccctcgtgtctcttgttgttaaaatgagaggattttatattgtttaatatgttgcaaaatgttgcgtttgtcctccacctcttatagaggccccctcatcttttatatttataaataggagatgtgttaaaaaaagatatatttttatcagctccgctgatataaagatatttgttttctcccccaaccatgtggtaagtgttatagagtgggccgcaccactttgggactttgccccacagcaaaggtgtctcggctcgttttttgtcacatggagncctctggcacacccacacagtgtgtatataagcctctgtgagagagataaatttctataaaagggggtgtatatttgttttttcacagcccccgcgccactctggttgtgtgctctcacaccgccgctctgtgtaatactcgcccgcgccacctcttttgggggagaggcccacacacaggttgggtgttgggaatctcacacgcagaggtcttcacagagagagagtctcacacgagcccactctctctctgggtcacaccccccgcggtgtgacaccccccgctcttcttatctctataagatattatagagaaaaaatttatcgcccgggcacatatagtgtgttgtggtcgcccctgttatattctccccancgctctatcttctgaagagaggcgtgagggccacggagagagaatggcgtgaaacccacgtaaggcggaggcttgccacgtgaggccgccaagatggcaccccctgcacactccacgcctcgggcgacaccagggtgagactgttctccacaaaaaaaccacacaaaagggcttatttttcacttgtatatttatgttgtattcaggattttatgccattaaatctctctttttattttccca

SEQ ID NO: 550753 - DNA, 375 bp, Homo sapiens
  misc_feature (13)..(13): n is a, c, g, or t
  misc_feature (19)..(19): n is a, c, g, or t
  misc_feature (21)..(21): n is a, c, g, or t
  misc_feature (24)..(24): n is a, c, g, or t
tgattacgaattngagctngnctnccaatatatccggcctatcctttacttttaaaaagtaaagggtaggctgggcgtggtggctcacacctgtcatcccagcactttgggaggccaaggtgggtggatcacctgaggtcaggagttcgggaccagcctgaccaacatggggaaaccccgtctctactgaaaatacaaaattggctgggcatggtggcgtatccttgtaatcccagctacttgggaggctgaggcaacagaattgcttgaacctgggaggtcgaggttgcagtgagctgagatcacgccgttgcacttctgcctgggcaacaagagcaaaactctgtctcataaaaaaaaaaggaaggaaggaaa

SEQ ID NO: 550754 - DNA, 299 bp, Homo sapiens
cttcacattatctgcttcgttttagccaatagttcccctcctctaggctattgaatcagcgcctttggttgcagcatatgtccagggcttcagctcctccacgtttaccccagcgccacttccctgatctatgtttccagaatgcgtcgtcaacaatgtgtgtaacgtgattgatacggttggagcagtgtgcaaagatgacgtttttcccgcgcattaagacactgattatcgctattgttcgtctttcgttaagtatacttctaggcccctttctctacgcgtttccgttatgcacg

SEQ ID NO: 550755 - DNA, 336 bp, Homo sapiens
  misc_feature (25)..(25): n is a, c, g, or t
  misc_feature (37)..(37): n is a, c, g, or t
  misc_feature (109)..(110): n is a, c, g, or t
  misc_feature (128)..(128): n is a, c, g, or t
cggtttgtgggcgcccgccccatgntgccatattggntgttggtgttcttggctgccctaaatgccctgttgcagtggttgttggggccattggtgttttaggcacccnntgtgaacccccttcaggntggcggtggccaaccacccccttcccggtcagcaccgacaaggttaagcgccatttgggttatgagcccctgtttttgtgggagaatagccggacccgcaccattttttgggtacaggccgttacgggttaagcccagtgacggtggggttggggcttggaggcccaaataaagcaccctttcacccccaattaaacccagaaccctt

SEQ ID NO: 550756 - DNA, 136 bp, Homo sapiens
taaggaccctatggaatgccaatgtacctgcgtaggggcacaactccatagtgtatgctttttctatttctgtcacgtggttcatcattctgaccttgtgccttgcacatatgcaatggtgtacctgagctctgaa

SEQ ID NO: 550757 - DNA, 224 bp, Homo sapiens
ctgacagcctcccgagccagccctgcaacgaggtcaccccgccgatgtacgtgggcaacgcgctctgtggctcaggacatccccaagctgcagagtctaggcatcaacactgtgctgaacgcggctgagggcaggtcctttatgcacgtcaacaccaatgccaacttcttcaaggactccggcatcacatacctgggcatcaaggccaacgacacacagagatt

SEQ ID NO: 550758 - DNA, 413 bp, Homo sapiens
atctcactactgtatcctagctcattttactgctgctgataaagacatacccaagactggacaatttacaaaagaaagaggtttattgtacttacagttccacctggtaggggaggcctcacaatcatggctgaaggcaaggaagagcaagtcacatcttacgtggatggcagcaggcaaagagagcgcttgtgcagagaaactcccgtttttaaaaccatcagatctcatgagacacattcactatcacaagaacagcacaggaaagacccacccccatgattcaattatctcccacctgggccctcccacaacacgtgggaactatgggagctacaagatgagatttgagtggggacacagagccaaaccatatcattccaccccaacccctcccaaatctcatgtcctca

SEQ ID NO: 550759 - DNA, 1456 bp, Homo sapiens
ttttttttttattggctttcaatgttaaaaatatttattttttttcctaaaagatcacacaaaagtgtgggaagagaaggagtgttcaattagacatacatctcaaacactcgtgggcagaggggaggacagaagagcgtgcctaaagaaacgtgggtaccgtgggagcaaacgtgcagagatctcaagagtgaccctagttccaggggaaaccagcgagcccgaggttcagcacacattcagggagcaccacgcgagagcacggcagggaagagcaaagtgtgcgtggccccaattcattcctccttttctcagggccaggagaaggccaagagagctctcaacctctttataagaacatgtgttccctgtgacgtgggctctgtggtgcatctttctcatgtggacctgttcttccacaactgcgcgttgcccattgtgaatatctcctctcagtgtgaaccaaatacttcgcgcaacgagagtggccctcaattccgagagaccagagtggaggcgcgcaaaatctccggaagagaccctcgccggggggcattggaactcggtggacagataatgagaaaaggcctcgtgaagagcgccacaacaagtcgtacgtatcacgagcacaggggatatgtgacgtgagggcccttgcgggtgacacgatatgtggagacagcgtgtgttaaaagctcgtatacaagtgagtggccatcaagtactctcccgcttctcaagggaagccttttgaacacgccggaagtagacgccgtgggagaaacaagatgtggaaagtgtggttcacataactatccagggcgcatctccgttctccgtggggaccaacgattggccgtggtccacaatgttcgacggaggtctccacacaaattttattatgttgcaaaaggttctgatggcattggaaaggggccccccaaaaaatttttcacaaaaaacggaaacattgttggcctccccaacaaggtgtgggaccatgcccctccccttgggtgtgttggcgttttccaccccccgaagcggccccccgtggggggttatattatcagcaacacgggggtggtttctttagccacgtgggtaatgactgttggtgtgcaagggagacaccccccccacttcagggagaaagaggagtaaagaacgaggacatgtaacatgcagacccagggaagttgcctggggaggaaacaagggggtaagctcccaccacgaaacgagccacacccccccagacgatggcgtcacggcgccccagaggagtcccccaacgagggtttgtgtagcacgcgccacccgaagtgacaacagcgagtacaaggagggatcacacgagacaacagaacatagcactcaggaagagagaagagacggcgtgaatatagtatagatgtcacagcaatgacaatccagacagccaacattacagagg

SEQ ID NO: 550760 - DNA, 527 bp, Homo sapiens
atagcgacaccgtacccccagcactggtcaacaacccgtctacacagcagctcactcgacttgaggatgcctcccacgaagcgcgaatatggccgatatgatcctaaaaatataccgaagaaagagaggaccaaccagaattccctttggacatttgtgtttttatgttttttaattttgttttgttttatcttcttcttcttcttccttaaagacatttaagctaaaggcaactcgtatccaaatttccaagacacaaacatgacctatccaagtcgcattacccacttgtgaccaatcagtggccaagccaaccttggctaaatggagcatcgaaatctaacgagaaactgcactttttaaaccctcttcagagcaagcgtggaggatgatggagaatcgtgtgatcagtgtgctaaatctctctgcctgtttggactttgtaattatttttttagcagtaattaaagaaaaaaagtcctctgtgaggaatattctctattttaaatatttttagtatgtacggt

SEQ ID NO: 550761 - DNA, 305 bp, Homo sapiens
gttatctgatgtattacagaacgaacttaacaatctggcccgttatgttgtaaaatcacaattctgtttatcaggtatctgaattagcttatctgaatgcatgggttcctaacactggccgtcatcaaacatctgaaacctaggctgggaaccatgtaacccaggccaagaaagtactttaaagtgtcttagagttgtaatcaacttagggggaaacaacagattccattacatcccataaaggatttgttggtgtgtgaaaaagggcctgatgtaatctaggttaaactcaggatgcttcttga

SEQ ID NO: 550762 - DNA, 159 bp, Homo sapiens
actggatgcgccgccggcgtcgccagccgctggcggctggcgaaggcgcatccggccatcgcgtgctggccgatcgcttcactgcgatccagcaggcggtggcggcaccggcctcgcgacccgccgatgcgctgcgggcgctgtttgacgaggtggaaa

SEQ ID NO: 550763 - DNA, 289 bp, Homo sapiens
  misc_feature (129)..(129): n is a, c, g, or t
gcgtcgaccttctcctctttggctctcttgtcccctccttctgtggccaaggcctccgatttcccccaggctggtagcgggctcagaaagtgacttgagggcatggcagggctcaggctcagtttggcngtgtacataaactccagcacctgccccaggcctgcggcgttactgatgtccaggtgcacccacgtccttctggtccaccgaagaggcaatcttgaaagtactcgcgtgcagcgccgccagcaactgcttttatggagcctttaaaagtggaacaaccggt

SEQ ID NO: 550764 - DNA, 1195 bp, Homo sapiens
  misc_feature (793)..(793): n is a, c, g, or t
aaccagtggtttcgatagcgtcagagtggccatttactggtaacggggcgccaacacgggaactaatctcgagtgcatgggttgagtgattcagactgctgtttagccactggggggaggactgggatctgtgcgtctttcaagacaatgacatggtgagggagagtaatcatgctcatgtgaactacacgtgcacgtaagccgcctgatacactactcgtctttagtgataagctcaagtgtccttgttgacttgaaattgtcgtaggtgggaaatagacttacggagcgagagccccaagtctcaatggccaggacgctatcataacattggacaccatcgttgcctttcgtaagggtatctagatacgagttttggcgttcccccttcattgggcaaggactcataagagacgcaagccataggacctaagcttttggaggattgaagggcgtgccttgtgcattggagagaggtctaaggcgggaataggtaagcaaggaatagggcgataagggtgggaactttagcgtggcaccgtgtaatccggggttatgtctacgattaaattgcagcgagctatattgcaatggaacttatataccaggaaaaattatggaacagtgacgttggctcaaatttgattctaattaggagggcttcactgtgtcattacgggttgttcgagctttaagaataaagtggagagttttttgcaaaactttatttttagcgacgtaaaagggtaagggtaaactttatgaggtaaggtataaacattgtgttagcttnaataccaaagggaattgtgggttggcgcgagcgcacatgggtggcttccgtcgtggtgggtttacttcgttccctttgggttctttatgtgtatcttgcagtgttgattcttcagattgggtagggtggacacacattttaattcccaggtagggaagcaccattcccaagttaattggtcttccaattaataggcaatatgctccgaggagcgcagatgtgggtaagcacaacggttggaagggcttagaccagttttccaactgggggggaaacagccacaggccgcatgggtcgttcacggctgtgtggtggggcccacggagatgtcgacgcactgcattttacatttacgtggggtgtaactcttgggagagttggcctcgtattatttggagccgc

SEQ ID NO: 550765 - DNA, 854 bp, Homo sapiens
ggttcgcgtgcgcgtggaggctgctcccagtctgcgcccgagtcagactcgggtgggggtccctggcggcggtagctggcgtgcggaggtgcgatgcatgtcgtgagctcttcggcgttcacaatgggccccaaggtgtgaagtgcgctggggccggccgaccgagcatattgccgggctcgacgcgatgacactggggaccgcagggcggggccgtgggacctgcagtgctatgaggcagacctgagcgcggacagccccaaagagacaatagtggcagcaagcattcgaccccaacctggaacatggagcgcgcctgccctacggctgtggcgcgccgagctgggatgcacttcgctgttacagcgctaaggatggccctgaactctggcagcaggatgcacggatgcacgactgcgtggcagatttggagaccaacatgtcctaagatcaacagctggacgtgctacattggctgcacactacctcgggatcacatggcaaatccatcccatcccatctccaggagataccagagcggaatatcatcttggccctccaggccgtcgttggcaggtaccctcgggtgacattaccagggcatacgcctgccgagccacagtcccgtggcttgacagtcgctctgctagtataatgacgagtaacgcacagaacacgagcaggtatcaccttcccaggtagtattgtgtaccacttcgccttgggctacctgtcatacagcctgcccacagatagacttacacagaggttgactccctaggccccgaatcttgcacgcccctcatacatcacagttggtaagaggcacattctcacagcgtgacacatgtgtg

SEQ ID NO: 550766 - DNA, 507 bp, Homo sapiens
  misc_feature (74)..(74): n is a, c, g, or t
ctcagaggacggtgaaattgtagtttgtcagctgccgaatatataacagattttcagcaatggggatgattttntccataaggggggggggggagagtattcaaaaattacaaaccaaggggattccatcgaaaccagagaagcgacccctattttaaaagtattctgatatggggaagtatgtggccttaggctgaaattttattattctacaaagcatacaagagcacgcatcacaaccggggggggcaccaatggagaaggggaaccaaacacatacaatttatttctgaagctgtgcggtcagctctgggattcctgggtggagatcgaatgggatgacaaatgattggatgggggtgggaatataagcataatatatatactttaacaaatttcaatgagaaaggtaagaggggaaactttcttatcagtgatggggtggaatgagtatgtactaggggattataggagaaacataaaacaagtaccggtgaacggtacaat

SEQ ID NO: 550767 - DNA, 188 bp, Homo sapiens
cagtatctcagctgaaaggctttactcaagctgaaagggctactacctcaagctgaagggtactactcaagctggaaagggtactacctcaagctgaaagggctactacctcaagctggaaagggctactaactcaagctggaaaaggctactaactcaagctggaaagggcagtgtcacaagatgaa

SEQ ID NO: 550768 - DNA, 471 bp, Homo sapiens
  misc_feature (14)..(14): n is a, c, g, or t
gggattacaggcangtgccaccgcgcccagctaatttttgcatttttagtagagatggggtttcgcccatgttggccagaatggtctcaatctcctgaccttgtgagccaccgcgcccggtctgggggggcatttctaaacaacaacatctaggccgggtgcggtggcttacgcctgtaattccagcactttgggaggctgaggcgggtggattactggaggttggaagttcatgaccagcctggccaacctggtgaaaccttgtctctactaaaaatacaaaaagattagccagatgcggtggcgtgcacctgtcattgcagctgctcaggaggctgagacaggatgatcacccgaatccgggaggtggaggatgcagtgagctgatatcatgcccctgcagtccagcctgggcaacagctacactctgtctcaaaaataaaataaaataaaataaaacaacaaaatccc

SEQ ID NO: 550769 - DNA, 204 bp, Homo sapiens
  misc_feature (5)..(5): n is a, c, g, or t
  misc_feature (8)..(8): n is a, c, g, or t
  misc_feature (15)..(15): n is a, c, g, or t
  misc_feature (19)..(20): n is a, c, g, or t
  misc_feature (29)..(29): n is a, c, g, or t
  misc_feature (32)..(32): n is a, c, g, or t
  misc_feature (35)..(35): n is a, c, g, or t
  misc_feature (54)..(54): n is a, c, g, or t
  misc_feature (90)..(90): n is a, c, g, or t
  misc_feature (105)..(105): n is a, c, g, or t
  misc_feature (112)..(112): n is a, c, g, or t
  misc_feature (115)..(115): n is a, c, g, or t
  misc_feature (147)..(147): n is a, c, g, or t
  misc_feature (159)..(159): n is a, c, g, or t
  misc_feature (172)..(172): n is a, c, g, or t
  misc_feature (178)..(179): n is a, c, g, or t
  misc_feature (183)..(183): n is a, c, g, or t
  misc_feature (200)..(200): n is a, c, g, or t
ctcgnccncaaagtnattnnttgcaaacntantgncattttccttaagatggtnacagctatgtaacctgtattattctggacggagctnattaaaatagcaaanagacaanaanataaaacaaaagcttgagcttctattggaccntgacacattttntgcgtgttacagngcaaanngcangggtccaagggaaatgntttg

SEQ ID NO: 550770 - DNA, 173 bp, Homo sapiens
gatttctggatgatatggtagtctatatttagaggaacctttgctttatactgttttcatagtggttgtaccaacttacattcccaccagcaatgaaggagggttccctcttctccccacgctctccagcatttgatgtttgtagacttgttaataacggccattctgactgg

SEQ ID NO: 550771 - DNA, 1353 bp, Homo sapiens
  misc_feature (1119)..(1119): n is a, c, g, or t
ggttctcaccaccacttatgcccctataaggtgaatgggagagggaaacgtgccctctgttatgatccttgcttttgtgacggatttattgtgttcctgttctattgttaactccacaaggttaccgctacctggataacttcttctaaagaaactgtgtgtataaactatcgtgacgctctccctgtcctgtgatcacgacccatctgttcgctcctcgtaatgtggctcagggctcacaaaaggacatcggttgcggtcgaggcagaggcaacgcattcacaggcacaccgtgtgaccatactgcatgacctaggcgtggcgccaatctgccgcacgcggcgagtcgagtgcgcccaaccgcgaacaaagagacgccccgagacagtccggaagtatatgcactcgtgtgtgctcatgcgagctaaccgtatactagggcacacacagagcgcactaggcagcacgatagggtgcgcctcgtgagcgcgaaagaacgcctgagggtggcgacgcgtggagcgcagaacgagccttcacagaagacccctctcgctaaaaagacccccaacatattggatccactgagattgaagctagaccattcgagcgactttcagtggttgtctggaagcgagtgcatcaatgctatatcaaacgactttcgagagtcccacttttgtataacatcagtatgatgcctgaagtgttccgatctctgctctatgaaagaactcgtgtctgcgcattcacttacacatatctcgctgacctgaggtgtgccagctaaccccacaccttcttccccactttggtctcacaatctgcgtcaaacctcctctggtggcacgtcaatccttgccgcacttcacatcacgtgcgatgtacgcctgtgctctgtcatctcacatcttccttcacccggcattgcggtgcacgtatcatcgtgccaccctttgttctcatcgtccgtctaaactgtctctagcatgatgtcccgttgtgcctgctttgattggcgcccgctccgatagagcacctctgtcgccctcggtgtgtgcgtcactccaccgatttagccaaagcaaccagacactcctattaccctccctgtatcangacgtctgtgaaaaacctaccacgcctctacacttatctcaccgtcaatatgcaatatcgtctcgtgagttggtgtacatataacctacgctcttccttatacgaaccaccagaagtgcaccatagctgtgtgactccctagtaacgatctcctcagactgacatacagcattatcagcgtctagccacaacgactagcaacagcacgaatatcagcactagagtcaacggata

SEQ ID NO: 550772 - DNA, 784 bp, Homo sapiens
  misc_feature (1)..(1): n is a, c, g, or t
  misc_feature (65)..(65): n is a, c, g, or t
  misc_feature (95)..(95): n is a, c, g, or t
  misc_feature (97)..(98): n is a, c, g, or t
  misc_feature (133)..(133): n is a, c, g, or t
  misc_feature (153)..(153): n is a, c, g, or t
  misc_feature (155)..(155): n is a, c, g, or t
  misc_feature (167)..(167): n is a, c, g, or t
  misc_feature (170)..(170): n is a, c, g, or t
  misc_feature (182)..(182): n is a, c, g, or t
  misc_feature (188)..(188): n is a, c, g, or t
  misc_feature (191)..(191): n is a, c, g, or t
  misc_feature (234)..(234): n is a, c, g, or t
  misc_feature (311)..(311): n is a, c, g, or t
  misc_feature (318)..(318): n is a, c, g, or t
  misc_feature (322)..(322): n is a, c, g, or t
  misc_feature (388)..(388): n is a, c, g, or t
  misc_feature (399)..(399): n is a, c, g, or t
  misc_feature (404)..(404): n is a, c, g, or t
  misc_feature (451)..(451): n is a, c, g, or t
  misc_feature (461)..(461): n is a, c, g, or t
  misc_feature (478)..(478): n is a, c, g, or t
  misc_feature (496)..(496): n is a, c, g, or t
  misc_feature (544)..(544): n is a, c, g, or t
  misc_feature (565)..(565): n is a, c, g, or t
  misc_feature (577)..(577): n is a, c, g, or t
  misc_feature (582)..(582): n is a, c, g, or t
  misc_feature (637)..(637): n is a, c, g, or t
  misc_feature (744)..(744): n is a, c, g, or t
ngcattctatttttggtgggaaaaaaatgtaacatacatttatttagcacgacattgtgaaatanacaaaaaatgtaactaaaaaaacaggaatntnntattcctagtccatttctgagggctaaatcatganctgctcccaatgtgattggntntttcttacaatngtngggcaccaagtntaaggnttnttaattttctcctctcagtataggcggcaattcaccattttcnttcagttccttcacaatatccaatcctcccaccagctcccctttcacatacagctgagggtatgttggccaatttgngtcagcntttnatccttgccgaacttcttcatcctccaatatatcgcatgtttcatattcaacaccagttctatttngtatttccagnttttntttgctgaatccacattttgcttcctgtttgtttcctttcataaagngcgtcacagnagctttatttgtcagcnctttgagcctttcctctnatttgggagctttgggacaaattgtatctagttcttcagatgcttctngctccttaattatatcaagtnctcctatgagcnctccnggaacatagggctgggggtaggtaggccaactgggataggctttgagtgcctgtngacctcttcatctggggagatatcggaactgctaaactgaatattatgtttgtgaagaatttccaccatctgcttgctgaaaccacagcgtgtttcttgaggagttnctttcataaacagcatgcagggggaagaatgagtaaattt

SEQ ID NO: 550773 - DNA, 807 bp, Homo sapiens
gtctcgtgtctccgcgtctgccagcctggctggcagtccgtctgtccatccctgccgtcgccgcggcgcacgtctagtgctgtgagtcggtggagctatagtgctgtgcggctggcctcgaacgcgagtgagtgtctgtgagttgggtgtgcttggacccagagtgcctaccctcgcctgcctgaggcctcagtttccacatactgtcacaatggagggagtgaccatccctagccctgcttggctgccagcgagctggctagtgacgtcttacagagacgtggaatgcatgcctaggagggaatgccataagggcgcatatatcaacaaggccatagagccattcacacactggacggggagtggagaccagcaatcttgaaagagggacgctttacgtccaatcaatacacccttgcctattgctactatcagtaggacgctcaggctgctagcatgaggagcatactgtcgaatcccatgcccttgcacttttaactcagccgatgcgcagtctttcaccggcaacacacctatccccttgtttgcaacaacccacaagaggacaattccgtatcaatgacctaatgcaacgaggaaacccataaacaggaccaaacagacgcgataacaccaaagagggcaccatatgcaaggaggctttgccacaaggtcacctgaatgcttggcccattcccataggcatactatagcaccataacagccaccttggggcttcacaccattgcaccggtgacccccagcgccattaacaacgggacatcccatagaatagcgagaagaaag

SEQ ID NO: 550774 - DNA, 197 bp, Homo sapiens
gaggacaccaaaaccgtggactctagcgagaggaaggagtaggggaggggccaccaaagcccctgggccccataccatagccctgacctgaacctgcgcctagggactccaacctgggacctgcccggcaagagacggggggtagccgagtgggccgcagatagggccatgctacttcactttgggccagcacagga

SEQ ID NO: 550775 - DNA, 921 bp, Homo sapiens
ggatgaggatgattgtaagagagagagcgccgagtgacaaggcattctggaccctagctacgacattcctccattgagagagaggctctatggccgattaacccagattaaagggctcgttccagaaggagcgagacagctggagagagaacgccttgcgttctgtatgatgcccaggggcttggtcagttgtgcctcagctgttggtaggttcagtgccgggagtggttcagacagtctctggtgcagagtctacataagagatcaggcatagtatagtctggttcttggcataatattagtggtgcgccttattgatatatggtaagggtgtacataggggcatgtaggcatgcatggtgagagcaatgaggaaagatgaccaaagaggtaggtggatagggaggcttgattcttatggtgccaaagtgacttgagagaattacctttcggtttacaaagctatgatcaacttattccattaaatagatacattaaaaagagttgagaagactgaaaagaaataccacacacgacgagagccaaaagacaaaacacgaacccaccaaacgcggccccacaaaagaaacacatatccacaagagggacacatacagcaaagacatgcacgcccagccaccaaaggggggcaccttggaagacacgcgccccaccctgcgaacacgcggccaagcgaacataacacacagcgatgccacgcgcacaaggagcgaaccaaccaaccatcacatgaaaaaggcacctacggccaacagaccgcaacgcacaacgcggcacccggcgacaaacaaaacgccacgaccaacggcacacaccacccacgccacagggaaacagagcagcaaccaccacaccggagagtaaaaatcagaaacgagaaccagcaaacaaactcaaccg

SEQ ID NO: 550776 - DNA, 205 bp, Homo sapiens
tgctgcggtgatctagaggtcccgaagacgtggatcaggcactggcaggagaattgcttgaacgggggaggtggaggttgcagtgagccgagattacaccactgcactccagcctggccacagagcaagactctgtctcaaaaaaaaagtattgggggagaatacggactccccggccacagtcttcgccggatagcatgtatag

SEQ ID NO: 550777 - DNA, 436 bp, Homo sapiens
tctctgagaatagattttagctgttaatattatattacaacttcctacatagttgtaaaaatttaggttaatgattcctgtgaatttatttttatttttttgaaatggggtctcactctgttgcccaggctggagtgtagtggtgtgatctcagctcattgcaactttgcctcccaggctcaagcgatcctcctgcctcagccacgagagtagctgggattacagattcacgccactacacccagcaaacttttgtatttttagtagatatgaggtttcaccatgttgtccaggctgttctcaaactcctgagctcaagtgatccacccacctagacctcccaaagtgctgggactacaggcatgagccacctgtgaatttaaagtaaattaatattatgtacacagaagttacaataaaaatgcttctatttgga

SEQ ID NO: 550778 - DNA, 149 bp, Homo sapiens
tgttgaacatacaagattgacactttgataggtcgctaagtacatgattagtagatgcacatctcaggaatctattatgcaaatcccctccccaatagtttctatgaccatatagattgtccgggttattgtgtccgagttatagtcgt

SEQ ID NO: 550779 - DNA, 461 bp, Homo sapiens
cctcagctggttccagccgaccaacccacagctccctggcagccgccaccctgaactggagtctcgccataaccctgggctgcgggccctgctgggtgaggaagagaatgcttaggtagctgcagctgctgacccggaggaggaacctcttttctggaggcattcatcccccattctaaggaaagggaatggcccacttgagcccaggagttcgaggcaaggcaggacgccctgaagggatggggcagctgtgatctgtgggaagtggcttcctgctctacccgtctcggaacaggaggctttgccgtcctagaaacgcgttcggaagatgggacaccttcagcttactcaactcacccgcttaaatccctgagttaaaaaaaaaaattaactgatcgtccttaggagatcccggcaacaagcttacatttttaaaattgataaataaaagaaaagaatca

SEQ ID NO: 550780 - DNA, 572 bp, Homo sapiens
ctacgaatccaatccaaggttcccaaatcgcccgcacatccacggtcgctaaattcctacctaccgcgactttggtctaaacggtccgtggagggacggggaaagctaggactaggggaaggtgctgggatccgtataggaggaacggcggggaagccaatttctgggactacggggcgcctgagtgcgccattcgggtaggacatgaccccctagatcgtcgctctgaggaggtctatgcgtcgtcgaagctacgttactcgaacgttttctgggctctgggtttgcagactatgcgggggggttaatcttattatttgtgataacgtctcgtatttaggcccaaataatgtcccgcgattaagttcgattaactataggtggctacctattttcctgggtcgggcccgtcctcgggaagtaggagctcgccgccgtccgaagcgttcgaggagattcgctacgagtactacgaatgatcctcgggggtaaattccgagggtattttagacgctaacggcgtgtttagggtggataggtgttatcctataggggaggtgacgaagcttttg

SEQ ID NO: 550781 - DNA, 359 bp, Homo sapiens
  misc_feature (12)..(12): n is a, c, g, or t
  misc_feature (176)..(176): n is a, c, g, or t
cccccccccccncccctaatagggggggttccgccttgtacgggttccaaaggtggtccctaggaaaccaaatccccccgtcccccaacttggagatttaaaaagcccggggtagggagggggccccccaaaacccccgggccaaaggggggtttgggttggcccccgtttttttntccaccccaaaggcccccccttttttccgggggggttttttttttagggcgggaaacaaaaaagggggttttttttggtaaaaaaaagaaaaagggggggaacttaccccgccccttttcccgggttcccccgggggggtttttttgttttttggggccaaaaaaaaggcgggccctttccga

SEQ ID NO: 550782 - DNA, 357 bp, Homo sapiens
atccccctggctttctcaggtctgtggtaagggttgatatagtgggttgttagaagaaacattagtcatattgagtgatgggtgatggcctggagtacggttttgtatgaattgaaaaactaaatggcaataagagaaggagaaaaacaggtataaaaagactaagaatcgggaggacctaggacatctaattagagagtgcctcaggaggttcagcatagtcctgccagcaaagattatttatttacttcaagagttaagagtggcagttaggggatagcaggaggagatatcagctgtgatggcttggagaaacagtgtaaaccggcagtgtaaacaagagcagggcaagccagg

SEQ ID NO: 550783 - DNA, 1351 bp, Homo sapiens
ccgtgttgtatcttgtggttcttttgtctctcttgtttttgctcttctctgttgcgtgtcgcgctttttctgggctggtgtgtgttggtgttttctgcttgttttgctgctctgttgtttgccgcgtgcgttggttcttgtttgtttctgttgtgttttttgctctctctggtgtcggctcctgtgttgtctccgtcttgtctcctctgtgtgtttctgcttctcttttgtttttttttttccttcgtgttttgttttttgttttctctccttttcttttttctctttcttctcttgtatttttcctgttttcgtttattttaggtttttcctggtctgtgttgtcgtgctgctagtggtgtcgcttctccatgtatgctgtccccttgtagtaggtgtccagtcacatgtgtcatgtcctaatggctttacttctagtttttgttatcatcttatgttgtatttctttgggggtcgacttggctgttgctttttgtctatcattgctctctgttgtctcgctcttgttagtcttccgttgttcttttctggccctgtcgcgctccgtgctttccatcttctatgctatgttggtagtttgtgtattgccattttgtgcctgctagatctagtatgtgtttgttataattcattctatcgtccctggtctgtatcctctgtgtctgagctcagtgatcatctgtgggtgtcttctagttgggttctggtcatccctcgtctgccgttgaacgcattgtttgcttgtatagtgtatttacttgttacgtctcagccctggctctcttgtagccagctaaggggccagcttcataaaggcacaatggtatcatgggtgataacgttgtggtctcagtcatcagtgttgtctccatcttctttctcccatctcagcccaccagctaaggtgcactgagggatgatcttgatgcagtatgatttcattttatgggcctggcccatgtggtctgtatagtccatggccgtctcaactgttactgatgagccatctgcgacttcgctccagctagcattatctccatgacgagagtcaagagagggctttctcatcagtcccagggtatctccctgactgcctctctcgcctgtctgcaagactgcaaggcattctgatggggtcaaacgtggagtgaaagggaccacgggatgtcatgggatgtttaagttgtttcatcacaccatccccgtggcaaagaaacagtcagtcctcttcaggtgtcttctggatttctggtatactggacagagaaaatcattgatcagatgataacgaggggctacaaagataatgatttctcacctcccccttctg

SEQ ID NO: 550784 - DNA, 1293 bp, Homo sapiens
ttcagtttggggtttcgtgttcccccccttaccccttccccggggtctagggggtgacattgcaccgcgcccctcgtgggagtcgcgtatgccaccccacgctggactccccaagcatggcgctgccccatacccattttgcctgtacctaggatacaggccacccgacgccctgacatatacccacactgcatcagccaatggagcggctagcaggatagtacaaatactgcgctagcacatattcgtactgctgtactggtcgacgtgcacatatctgactgactaataatactatagcatacaccttgctagagactagaggggagccctgtctatacggcggataaatacgataacactaggatacaggcatgtgaggcaactaatatatactaggactaggtacataccccataggctccccatagagccctacatggttagtgtacctgtgcgatatacaaataacttataggggtaacccaaatagtctgaagctctagacagacgggagtgaccaatgagaattagccccacgtggcacgttcccaaagagtgtaacaccgagataacctgatcgacttagcgaatatcacaacctatgagcttagcactaagaccttcacgagaccctatactgtaggtacaccattataacatgtacgcaaggtggcacggggataggctaaccccagaccgttaatgtgccgaccttaacccatcacagcacagggtcagtcggctgattacacaacgcagaatcgaggccgatgcacttaggacggcgtagcgatattaacaggccaactttcccagaccatttggtacctactattggcgctagccagcacatgctgacagtggaagctccgaaactccgcaaaataccacttacccaacttccccctcggcccacatggcacgttggcggcgccattcagtatggcttatctacctacgggcggatacaatcccttacgcccattgtgcccgacagcataaacataccaactttccagacgtctatgccgtcatatgttaccactaccaatcactctgagctacaaacgttcccccaccgtaacatttccgtggacagcccgtagcgaaatctcggccacgcagttataggaagagcagccacacaacgaccgacatggatagatagacaatcggcgtgggacttcacccaaaatcggggcaaggaaaccataccaacactacaccaatcaattatacaccttattccacagtagtcaaccactcatcacaagccacccgctcttcccc

SEQ ID NO: 550785 - DNA, 165 bp, Homo sapiens
cccccaataactcatctccctgtcatcagaactgagctgcagccactggttctaagcatagctcatttgtctgccagagaagacacaccttaagatgttcccgagaacgcctggagtccggaatacattccctgttttcccaggaggagacctgagcaagccagg

SEQ ID NO: 550786 - DNA, 1154 bp, Homo sapiens
cggagccccgaacgaccccgactgctaatactaactatcgtgatcgtcctaccccgtcagcaatcactgggcaagcgcaggcgcccactgtaatgcgcagctggaaccgaccaagtcagcgaaataaaatactcgtgacctctctatactgaagtgcgccctacgaaatctccgttgaattatcacattcagagccagcagaaacttgagtcatgtcatctattcttcttcagaaagccacaagcatgtaatcgcccaagcgccttggcgtatcaatcgagcccgatgagggcgaagccgagcctagagacggccttgaacgcagggcgacagtacgtatccgtatatctcacacccgtaggagtgcgtccgctgtccaccttaggtcgatcggcactgaagttgtacgacgtgcacgagagcgacccgcgtgagagcgtcactagaacaattctgactaacgtcgagctgcgtcactggcccgaaggaacactatgcaaagctcccttgcaagcgcaacaactgtaatagggctagctgactacgatagcttttatagtcaagatacctctttacggagcgtcgcacttatgactaccctaaagcccaggtcgaagcccccatcgctgggtcaactagtactatgccgcaggtactcttaaaaactaggcggtataggtataatacgcctcacactcattctcaagcccctgacgaaacaacatagactacccgtaccttgtgcatatccctatgaggcatagagtcataaccagctccagccagctaacgacaaacacgagcctaaaaatccgctcatgggatacatcaacaagccaggcacaaaagaccgacggaagacaacaggcgaactcataccaaaccccctgaagctccccgcggcagacaatccataaacgcccggactgacaccaccacaaacaaaattgggcgcgcaaaaaacaactacagaaaaggcaacacaaaggccaccaaaatagctcacaaggaggcatagcatacacccaaaagattggaacagaaacaagccctagacaaggtaaccccaataaacggaacacggcacagaaaacaccgaaaacaccacagacaccaacgccacaccacatcaacggggagaacacaacagacac

SEQ ID NO: 550787 - DNA, 215 bp, Homo sapiens
tcaggagtttgaggcttcagtgagctaggatcgtgccactgcactccaccctgggtgacacagtgagacttggtctctaaaaaaattaataaaatgaaatgtagaaatttttaaattttttcatgggtgtttgggaaatgttgagtaacctgttttaataaaatacagattacagtgggtgcagcaaataaaggatttatgtatacatgaacacg

SEQ ID NO: 550788 - DNA, 186 bp, Homo sapiens
gctgagccatgtatcactggggcatgtacttttctcaccgtcccccgattagaataccccaatacttcctttctcctcttttcttttacctggggtcccacactcttatttggcgttctttctcaattttctggcatgtgtccccttcccactatttcctggaggttgccgagcaaccctcatggg

SEQ ID NO: 550789 - DNA, 162 bp, Homo sapiens
taatttcccccggaaccctttttgttttccccattttgttttccttaattccttttttttccctttaaaaggggattgtttcccccttccttttttcctccgggttttttgtgtttttggaacggagcttttttgaaatttttttaggtcttttaaggtgga

SEQ ID NO: 550790 - DNA, 914 bp, Homo sapiens
tgtgcagtggaacacaggggcccaggttcaggatcgtgaagccaatgatgctgggttcacccacatctccaaagccaggagttaatgcccagttcttacctggattaatgggggatagacagctccggtgactccacaacctcgatcaagttagtggcccttcagtaggagtaaatggaaagtgagatcacctttacttgccggtgtgggtccacacacaacagttgtaccagcgtcataaagataaaatggtgggctccaccagttagaagtatcatcatgatgacatttctagcccaggacttggatcaacacctttaacttcaagaagacagccaagacatttcagtaatgcagagtcctcttgtgggagttagcatcgtactcctggaacgagggcaaagtatgtcaagtccagcaagtatcggtcagccacgaacagacgacattatctcctgccagttggatccttgtgatactcaaggagatgctttgacttccgaagatcacctcgcttgactctggggtgacgactcgggtactccaggcatcagttcctacatatcactagcactcggccaggcatgggaatatcttcaccaccatgggaggctcattcccggagtagtgtacgcctatccggaacaattctaccggagggcctgaaagcctaagacacacatgggggagtttgtcgaaccacatgacgtggtgtcagacccatgttggaatcatttgtttgaaccggtgtaacgtgacacaatcaaggccaacgggttgggctcacaaatctatggtggcaaacgtcatgacagagcatacgagcctgcacacagtgacatcggaacgcctgcagcaccacatgtaccagattggcacaaggccgaacgacgacacatggggccaataggcaa

SEQ ID NO: 550791 - DNA, 302 bp, Homo sapiens
tctctggcaggtggaatcaggacggtgaaattaatttgtagatcgggctttaattatatattttttttatttaggaaacaaaatctcgggctatcatccaggctgcttttaggggtggcaatctgggctcacggcaacctccatctcccaagttcaagcaattcttcggcctcagtctccggagtagctgggactacaggtgccggtcagaacaccgggctaattgtttggattttaagtagagatgggtgtttcaccatgtgggccaagctagtctcaaactcctgatttccaccttgcca

SEQ ID NO: 550792 - DNA, 161 bp, Homo sapiens
  misc_feature (1)..(1): n is a, c, g, or t
ntttatttgagaggctaaaaatttcaaagtattaatttaagccactctaaccctgcatggaaaaattggagtaagaaatactgatttctagagaccaacgtataaccagtgaaaaattaagcttctggaggtaaatttctaaatttaatgcccctggctta

SEQ ID NO: 550793 - DNA, 320 bp, Homo sapiens
gagacagggtctcgctctgtcacccaggctggagtgtaatagtgccatttcggctcattgcagcctccccctcccaggttcaagcaatcctcctacttcagcctcctaagtagctgggactataaaagtgtgcccccccagccagctaaattttttagttttgggtatttgtttggaaaaaaatggggttttgccatgttgcctaggctggtttcaaacttttggcctcaagcaatcctcccccctcagcctccgaaagtgttaggattacaggcatgagcccctgcgcccacccttaggtgcttttatataaatttcca

SEQ ID NO: 550794 - DNA, 1150 bp, Homo sapiens
aggcgtcactcactctcaatgccattaacaagtgcctcctgcgtgaatccctggcggcccctgaccttctcctacgtgactgagccctgcgaaggacatctgctcctgaaccgtgctgtggagtcgcgtgaaagaatggagaaccgtgaatagtctgctgacaggatggcagtaatgtcaacgcgaggccctggaccagaccagtttctttgtcatgtcaaggaaagttacatctcctgaagctggactaggtcgtggtggctgcgtgcccacgtacagttccctctttcagtgtgtcgtaaccaacgactcctatttagatgcggagtgtgttcccgagagcttggcccgcaaacacgtatattgcccgtagtcaaccaatcgcccacatccctatggaaggacgggagaggactggtcatcgcatctggaggcctcccatgggacttggcgtatgccggcagggcggcaatcagttccttttcactcaatcggttaaacgatggttgcgctggtgttcggtggctcgtccttagttggaactgcgaaaaggttcccagtcaagcactttttccaggacataccttgatccacggacttaataccccggcgtatacttttttgacgcgagcgggacacacattacgatgtcagatttgcacaccttcgtgcaacccgaggagctaaccttccatgataggcatgtgagaggtgcggccaaggccctttcacaaaatggactctccttctagagagccgtgtgtcacagcatttgcattttcggatagcgcggctatagcagatgagttatggccagtacacaccttagtggcagtgcaacccctcacaagtacattaccagataggtatccattgtgcttgcggaaacgcgcaggggggaattcaagtgaagcgagaagggcctcgacttaatgaacaaagtccgagcgcgttcgcgcgattgtgaaccagaaagtaaagaggcgtatcgcccgtttacgcgaagctcccttactggtagtgacacacctcgaacaaaggaagcggccccgcatcggaaggttaaacaatataactcggtgtcccaagtcagttctttcccgttttaacatggaggatctattacaacacggcgtacgtagcgtgcgag

SEQ ID NO: 550795 - DNA, 474 bp, Homo sapiens
  misc_feature (296)..(296): n is a, c, g, or t
ggcatttatcctgtcatcaattatatgttttggctgtcgtatagcttgctttgtttgagacagagtcttgcgctgtcgcccaggatggagtgcagtggcgcaatctcagctcactggaacctccgcctcccgggttaaagcgattctccggcctcagcctcctgagtagctggattacaggggctcaccatcatgcctggctaattttggtatttcaagtagaggtggggcttcaccaggttagccaggctggtctcgagctcttgactttaggtgatcgatccgcctgcctcggnctcccaaagtgctgagattacaggcgtgagccaccgtacctggcctcagggtagatgcttaatgccttttctgtggtacacttattagcattctaagtaacatcattttaatgggtaatgagctggcataatcaatatttctagctatcatggtttacaatcttaccatgcttccaag

SEQ ID NO: 550796 - DNA, 135 bp, Homo sapiens
aggtgtccccacagtgagcgatgccctggtacacacgtgctaggggtcgcggaacgtcggacgatctggagcatatgaacgtcttgggacgtgccactctgacggcgtctctggctacaacaacggcccagtcca

SEQ ID NO: 550797 - DNA, 191 bp, Homo sapiens
acatgtccacagttgtcaaaaattgtaatactcaaatgagaaatcacgatggcttttcagtttttacaaataatttagttatgctgttgtctttcatctttcctggttaaaccaaactcaaattgcggagctaacaaaacaacatcatattattaacttgtaaaatgcagtaaatctgggctgcagaccag

SEQ ID NO: 550798 - DNA, 357 bp, Homo sapiens
  misc_feature (10)..(10): n is a, c, g, or t
  misc_feature (61)..(62): n is a, c, g, or t
  misc_feature (75)..(75): n is a, c, g, or t
  misc_feature (77)..(77): n is a, c, g, or t
  misc_feature (81)..(81): n is a, c, g, or t
  misc_feature (83)..(84): n is a, c, g, or t
  misc_feature (123)..(125): n is a, c, g, or t
  misc_feature (128)..(128): n is a, c, g, or t
  misc_feature (132)..(132): n is a, c, g, or t
  misc_feature (144)..(144): n is a, c, g, or t
  misc_feature (154)..(154): n is a, c, g, or t
  misc_feature (156)..(156): n is a, c, g, or t
  misc_feature (163)..(163): n is a, c, g, or t
  misc_feature (202)..(202): n is a, c, g, or t
  misc_feature (205)..(205): n is a, c, g, or t
  misc_feature (216)..(216): n is a, c, g, or t
  misc_feature (222)..(223): n is a, c, g, or t
  misc_feature (257)..(257): n is a, c, g, or t
  misc_feature (267)..(268): n is a, c, g, or t
  misc_feature (273)..(273): n is a, c, g, or t
  misc_feature (275)..(275): n is a, c, g, or t
  misc_feature (277)..(278): n is a, c, g, or t
  misc_feature (281)..(281): n is a, c, g, or t
  misc_feature (292)..(292): n is a, c, g, or t
  misc_feature (313)..(313): n is a, c, g, or t
tacacacaanaaaagaagctgttaccctcttaccatctggctccaggggcctccagttcannattcctccttctncncttnannaagtggggccacatgatgggacagccaggaatctgggannntancacnaaaacagactanaaaccccgcnanatttcanaaaagacagttatatatacttcacactggtgtaacaaantanaaatacaaaantacaannaaaataaataattcaacataactggcctaaatanataggaatanngaaangngnnaanaaagagactanaagaaggactctagaatccancaaagaacaggaacaacacaaatagagttggtaaagccgaaaac

SEQ ID NO: 550799 - DNA, 660 bp, Homo sapiens
ggggcagaaaccttctggctggtcgaggcctgggtttgaatcggccgagggcgcgcgcgagagagagagagagagagcgagagagagagcgagagacgagagagagagagagagagagcgagacgagagagcgagagatagagcgcgcagacgatgagagagagacgagagagagcgccccgccggcggggaggcgcgcccctcggcggcgggcgctgccgctctggtctctctcctcctgctctgtcggtgtgtcgccgcgccgtctcctctctctctcctcgcctcgtcggcctcctcgggcgggcagctgctgtcgtgcgtctgtatcttctgcttctgcagctctgcgcgcggctccgctgcgccggcccctccgcgcgctgccctgcgtcttctttccccgtgaaagccggtgccgctgatagctcgcttcgtcgctctgcttctcacctctgcccccatctactgccgagaggccagagagtccctcctcgtcatctacatcttcttcctcgttccttgcaggacgttccgccgtccgtcttcagtgctagatcattcattcctcattcacccacgctcgaataggtcgatggtaggacagacgccactcagcagccggcgccgacgcgggaggcagcatcatccttcatcctg

SEQ ID NO: 550800 - DNA, 1187 bp, Homo sapiens
tgggtatttaaactatttattaacaaacaaggcctacagatcttatttcttctgggacacacccagcggggcggccacgggggccaggggctctggggtggtgcgtggccctcggacacaaaggccccaaaagtgtgacgcagccctcttagtgggcccgaattcttcttaagtcgctctccaggtcttcagcggagcctgtggtgtgctccaaaccactgggcttaggaccgtggcgtgtattttccatccttttacattcctttcgtggtcgtgttcaaaaaccaggtcgtgggatctggatacgtggcggtggaattcgtgcaataagggggaatcacaaggtattccaccttcaatccttcgaggtgaagattcctccgcgcccctctggggggaaggctcaaggctcgtgctttacccctcaaaaacccacagtggaagcccatattcttctcggaccccacaaccccttatagaggtgcgaggtcattggcacagagggcatattattcaccggcgcgtgccacattcgaagtgttgggggtgctggaaagatacttcggccaaaaaatattgcggtggaacacttttcccagggggactcaccatagcacagaccatgtgggccgtgacagacaacaaaggcgggcgggggaccgacggagagaagagccccgggcaaagcgcgccgggagagcaccccgggccgtagaaacgcaccgtgggggcccccaaccgcagagaccggggtgccaaacacagtgcggggtgtccgcccgcgctcatcgtctagcgcgacatgaaaccccctcagagagacagcgcaaaaggggggggccaaggagcccagtggggaatggcgcacacaccggccttcccgggaacccggaaataaaccttgcccaaaacccaagggggggaaggcaccaaggagaaacatccggccccacagaaaggcactgcaacacaaatctggagaacacaatgtgggggccccgaagggaccccggggggaaatagacgaccacccacaagaatagatgtggccacgaaggcaaccatgctggggaaaaagaggaacaaagaagccagaggcgtaaccaaacaacgatgacggataacacacagaggacaacaacaccactacacacgacacgaaggggacagaacaacgacacaacctc

SEQ ID NO: 550801 - DNA, 117 bp, Homo sapiens
gttacgatcgaaaggctatccatgccgagggagtcccaggcttgcagactgaactccattcctgagcgagcccacgtaggtctatcttatatatccacgggcatcacgtccacgtaa

SEQ ID NO: 550802 - DNA, 730 bp, Homo sapiens
  misc_feature (369)..(369): n is a, c, g, or t
  misc_feature (383)..(385): n is a, c, g, or t
aggtttttcccttttgaagcgcaatggggacaaaccggggcccccccccgggggaaaaagggtggggtttcccagccctcccgtagattcccctccctccgcgggaacccggggtttttttgggccaaatgtggaaaaccaaacgtggtccaggccaaaaatgttgttaatccgcgggggggtttggccctggggtgcgcctcccaaaaaccgcccttttttaaataggccttcctttgggaggccccggggtggtctcccaaattcccccttcttgttgcccttgtcccccccccccctctccaggggggcccgggggcccccctttttttggcgcgccaattggggggggtgtgggggttttgcctngggccccctaaaannnccccttttttaaaggccccccaggaaaaaaaaccccccccccggcccggcgggggggggggccccggggcccccccccttttttttttttttttttaaaaaaaaaaaccttttaaaacccccccccttaaaccccaccccctttggttttttgcccaggggattttcccatttttttggggttttttttttaggggggggggattttttccccccctaaaccccccctttttttcccccccttttttttgggttgggggggggggggggggggggggtttttttttttttttttttagggggggggggcccaagggaaaaaaacccgggggggggccccttttta

SEQ ID NO: 550803 - DNA, 905 bp, Homo sapiens
gtggacatccccaagatggtggatgccgaagacggtcgtgggaacgtgcccgaccggatgagaaagccatcatgagcgttacgtgtctagacttctaccacgccgttctctggagcccagaaggcggagacagtgagctcaatcgcatctgcgaaggtgttggccgtcaaccaggtagaacgagcaggcggtatggagagactagcgagagagctggccagtggatctgtaggtaggtgggatccgccggcacagatcccgtggctggaggaaccggggtggccgaggaacagccatgcatgccatgcaagcagagagctggaggacttccggggaggtaccgggcgcctgcacgagccgcccaaggtgcaggagaagtggcagctggtagtatcaacttcaagcacgcgtgccagaccaatgctgcggctcacgtgaaccgggcctgccttcatgcccatctgagggcaggatggtctcgggacatcaaccaatgcctggggcttgccatggagcaggtggagaagggctatgaggcagtggtctgctgagtgcgatcctggcacggctgtggcgattggatcatctgacgggaaacatggaccgggagaagaggattccagtgccgacgaaggtgcgtggactgagtggagatgagggtcgaatggcttggggatggacgggactatgaagatcgcagactggtagtaaaatcacggggctgttaaacgacaggtggacggcttcgacgaaatgactggtgggcccaagtgatcgtgttggcagtagagtgtggggcatggcagggggtcaatggaggggttgttttgggaaaccattgtttagggagagaggaaaaaactgggcgggggagaattgggggcttaggctaaacaaaggaaatt

SEQ ID NO: 550804 - DNA, 220 bp, Homo sapiens
gcaacctttatattctagattctaagacattgtacagagaaattcagaagtgtaaaaatattgcacattgacaaataccaaggatttttgcggatggttatattggattggtcttaataatggggaggcttttaaattaggtcttgccaaccatggttattatagggggtattattttggtaaaattgctcttagagatagggtttatataaagtgtgat

SEQ ID NO: 550805 - DNA, 524 bp, Homo sapiens
tcatcctgtggttttcctaatggactttcaggaatttggtaatctcataatctttccaagctctccaccacttctccataaatctcttaaaaacttttaattgtgacagtttctcaattgtgaagggtgcgtgttgtgtagactttaacacccagtgtgaaagcccagccatcagtgacaaatctccttgaatgtgtctcttaagaaaaatgtgatgtgcgtggctcatctcgcagctttcagcattcctcctgtgtttttgtggagtgcttggggcctcccttcgtgcgtgatctcctcagtttctccgtggccttttctccttccccttcagcccctttcttcaccccttttgtggcgtgctccgtggtgttaggtgattgtgggggtgaaggaaatctcgttgtgctgtgcaccccttttccccacagaccccatctttatgtgaggttcctcaaggttttttattatatgtgggcaatttaaagcggtgccttaatgtcgccgggattttatctcccttc

SEQ ID NO: 550806 - DNA, 359 bp, Homo sapiens
tcccatacatcgtcgctgcttatattgcaagcatgcataatcaactccgtgcagattgtggaatgagccacatttcctccaggctcagaccttgcctgtattgttccttctgcgtgcaccagtctttaattcttagttttatactcttttgcctgaggcattttctcaaagaccccttccctgcacgtctcactcttttcccagatcaggtcatgtcccatatttaaatgattaatagaggaatgactttaaggtgtatctccatcactgacctgtaagcccctctcctgttcaccactggatcccagcaccaaggcacttattatttcttgggtgcgaacactgctcacatctcatat

SEQ ID NO: 550807 - DNA, 285 bp, Homo sapiens
ggaagaatcctcaggtttgaacgcggttgtgtgttggtgcaggcaatgactggagcagtatgactgagggcacccactgtttggcggagccggtatcaaagagacggtcaaatcctgggcaggagttccgatgccgatagtgccgaagtaactccatatccaggtaagttctccaggggctgtgcatctaccagggtgggagcctcccactgggggaagtactttctggctgggctgaggttgtgcttcttcaggaagtccttcagcagagcacacgcaactggt

SEQ ID NO: 550808 - DNA, 915 bp, Homo sapiens
acgcaagaagcaaagtcaggaagcaaagaagaggatggaagcagacaaaagttgtacgcacgttgagaacctatatgcctccggacatttgccggggcaatgttgcgtgcaccgggcgactctcccgccgctttggaaagtagggcgtccagataagttttgggagccacccaggatcatgcgtgctgttaaggcgcagccgttatttccgaaggcccctttgaaatgggccagacaacgcagggttttttttagggagccaaccccaccacttttaaagaatctgctccgcaccggggcctttatactcgggtggcttccgacgccaatgcccttgcccgggatactacatccgccctgtcaaccagccatgggacgaactacacccggcgtgccccccgcgggaattatgtagaactttttagtcgcccgcctatatttacgaggcggcattttatgaggccacacatcgtcgtgacgtcccccaaaacaaattgcttctttccatgcgtgtgtgttggcccccgacaacgtcccacaggggaaataagcgtctctcacaaaagatgctgctcaaaacatcgcacgtctaaatagtataaccctgaagaatggcgacatgtcctcgttcatctgagggcaaggatcacccacccggttctcacaatgggcggctgaaaaatgattctgtattgataaaaatatgggttacaagagaaatactccgagcgtgtcgaacaaagttgccagcaataaacaaatgggggaaaacgaaacaaaactggagtgcccctccatggtggtaactgtggtaaaaggaaacttttctctacgaacaccacgtctggtgtagaaaaaacaacttccagtggacaaaaaaccataaaaataaatttcctacttctcaacaaaaac

SEQ ID NO: 550809 - DNA, 422 bp, Homo sapiens
ttttttttgaaacagagtctcggtcacccaggctggagtgcagtggcacaatctcggctcactgcaacttctgcctcccaggttcaagcgattctcatgcctcagcctcctgagtagctgggattacaggcacaagccaccatacatggctaatttttgtattttttagtagagacggggtttctccatgctggccaggctggtcttaaacttctggcctcaagtgattctcccgcctcagcctccctaaatgctgggattcagccatgggccaccacgcccagccacccgtcaatgttaactctcaacaaatcgcttcatcctaccaccagctatttgggactccccactgcgaatactaacctcgcgacatactccataacagtgcaacgactttcagcaattcccaccatactacgcat

SEQ ID NO: 550810 - DNA, 332 bp, Homo sapiens
  misc_feature (81)..(81): n is a, c, g, or t
  misc_feature (100)..(100): n is a, c, g, or t
gggggcgccccaggggcgggtgcccgaggcgcgggtgagtgcccggggggccccggggctcccggagtaactcactattgnttgccctcggagtttcagngctaggaaaaggggattttttcatttttataatggaaaaactgttttgttgctttcccaacagcatggtggtggaacaccccgagttcctcaaggcagggaaggagcctggcctgcagatctggcgtgtggagaagttcgatctggtgcctgtgcccaccaacctttatggagactttttcatgtgcgacgtctacgttattctgaagacagcgcagttgaggaatggaaat

SEQ ID NO: 550811 - DNA, 454 bp, Homo sapiens
  misc_feature (78)..(78): n is a, c, g, or t
gcagaaaaactagaatctgaagaagatgtgtccccagctttccttggaggctgttgctgaggaaaagctcatgtaaanaccttatttccctaagacccttcgcgaattagaagttgtggagggaagtgctgctaaatttgactgccagattggaggataccccgaccccgaggttgtctggttccaagattacccgtcgatcagggagtcccggcacttccaaatagactacgatgaggacgggaattgctctttaattattagtgatgtttgcggggatgacgatgccaagtacacctgcaaggctgtcaacagtcttggagaagccacctgcacagcagagctcattgtggaacaccatggaggaaggtgaacggggaaggggaagaggaagaggagtgacaccaaagccagaagaaaagcagtttctcagtcatattacaaggcctattct

SEQ ID NO: 550812 - DNA, 306 bp, Homo sapiens
agtgctgtaatcccaccactttgttatgcgagggtagaaggatcagctgcggtcacgagttcgagacccgcctgggcattatggtgaaaccccatctctactaaaaatacaaaaattagccgggcatggtgcgcagttgcctgtaatcccagctactcaggaggctgaggcaggagaatcgcttgaacctgggaggcggagatttgcagtgagccgagatcacgccattgtactccagcctgggcaacagagagagactcagtctcaaaaaaaatcaaaattaaaaagtaagcatgtcttggcaat

SEQ ID NO: 550813 - DNA, 513 bp, Homo sapiens
  misc_feature (40)..(40): n is a, c, g, or t
acgaccttgttagccctctctccacacacaacttcatccnttgcccaagttccacagggtcacccacctcactctacccacctgccccgacgaacttcaacacaaacaactgaatccacttccatctcatcatttcccatagtaaagcaaaatgtcaactctagcctctagcccaaactgctcttctaaattacagaactgcagacacaactgcctcccctactcatctactgccacctggcatatgtttcatgagccttcaaacataaattgtccggaactaaaagacgctactctaccaaaagccatattacgcatatcctctaacctaccatatgcctagtcactcacgtaaaattcataaaagttttccaggaaccctcgattctcggtatacaaaatctaagacttaatcttgtagggtctagctcctaactcggtttagtatctgtccttagaattccaaccctcctcacttcttttttgtattactaacacagcttcctaatcaga

SEQ ID NO: 550814 - DNA, 686 bp, Homo sapiens
  misc_feature (27)..(27): n is a, c, g, or t
  misc_feature (74)..(74): n is a, c, g, or t
  misc_feature (90)..(90): n is a, c, g, or t
  misc_feature (135)..(135): n is a, c, g, or t
  misc_feature (162)..(162): n is a, c, g, or t
  misc_feature (182)..(182): n is a, c, g, or t
  misc_feature (196)..(196): n is a, c, g, or t
  misc_feature (211)..(211): n is a, c, g, or t
  misc_feature (213)..(213): n is a, c, g, or t
  misc_feature (264)..(264): n is a, c, g, or t
  misc_feature (304)..(304): n is a, c, g, or t
  misc_feature (346)..(346): n is a, c, g, or t
  misc_feature (351)..(351): n is a, c, g, or t
  misc_feature (366)..(366): n is a, c, g, or t
  misc_feature (389)..(389): n is a, c, g, or t
  misc_feature (391)..(391): n is a, c, g, or t
  misc_feature (429)..(429): n is a, c, g, or t
  misc_feature (435)..(435): n is a, c, g, or t
  misc_feature (442)..(442): n is a, c, g, or t
  misc_feature (506)..(506): n is a, c, g, or t
  misc_feature (591)..(591): n is a, c, g, or t
  misc_feature (606)..(606): n is a, c, g, or t
  misc_feature (617)..(617): n is a, c, g, or t
  misc_feature (648)..(648): n is a, c, g, or t
ctcagggtgcagtggtgcccggatgtncagtctgcgagttttgctgtccttgtcgatgaactccagacgcagcngggggaggcgcttctnagcctggggtgagggcagtactgggcttatgagtagctgcatgtntgagtactccaccgtgaagcgcaaagnacagccccctggcagcaggncctgcacaaaggcngcagcaagcaggttnancaaacggcgttctacctaaagtttgaaggagcgggcgccaaagtgcacaangtagccgtggaccagcacaactgcaaacacgcggtcccanagcagcgtgaagtagtgcctttgcttggctcttttggcccanaagtntagtaccttgtagangagttggatgagcaccgagtggnanaaggggaggaagtagacgaactcattgaaccgtcccanaaactnaaccctncggaagtaagcatacaggatagggcgaataaaaaactccttgaagtactttgagaaggtgaacnagtaactaaactggacaacccccaggttttcggcaatacggttacggctcaactccaaagcttcctgcctaagcagcagcgcgtncagtgcgaactcgtngctggccacantggagggcatgatgaagaaggcgttcttgcnatcaatggtcttcccttttccatctgttagccggccct

SEQ ID NO: 550815 - DNA, 483 bp, Homo sapiens
cagctccatcaaaggaaaaaataatcactgtgaaatgaatgcacacattaaagcactgagacaaataagtatctcagaaagcttctttacagtttttatctgaacatatttcctttttcagaataggcctttttgtgctacctagcatcactttgcagattacaaaaaaacagtgtttccaaacagctcaatcaaaagccacatttaagtcagtgagatgaatgcacactttacaaatcagtatctcaaaaagcgtctgtcttgattttttccaaagatatttcctttaacaccataggcttcaatgtgctcccaaatattctgttgtagattctacaaaagcaatgtttccaaactctcaatcaaaaaataggtttaactctgtgagctgaatgcacagctcacaaagcagttcctcaaaaatattttttctagtttttacactatggtatttccttttccaccataaatattagtatgctc

SEQ ID NO: 550816 - DNA, 199 bp, Homo sapiens
  misc_feature (63)..(63): n is a, c, g, or t
  misc_feature (66)..(66): n is a, c, g, or t
  misc_feature (89)..(89): n is a, c, g, or t
  misc_feature (93)..(93): n is a, c, g, or t
  misc_feature (144)..(144): n is a, c, g, or t
tgggtgatctagaggatcccgaagcacagaggaggacaggtaggagcaggcatggtcagctanatntggtgatacgtcaggataaggancccnagcttcccgacgctttgacccctggcaaagatctctgcacatcgcccgggnaagaaagcaggcccttctgatgctttgatcacatatccctcctctgtgctgtcca

SEQ ID NO: 550817 - DNA, 1858 bp, Homo sapiens
gcgcacagccggggccgctgtgagccgagaccgcgggccgcgcgagctcgcggcggccgcgcgcgcgagaactttgttccatgttgaagcagctggcctccctctctcctaactttccacgcactcccttgcagcgcttctcagcgcagctcctggctagcgctgacacactttctcataaccatcctacagcgacgcaaaccacgcctaccctggcctccgattcccctccacagccgccacagccccgtcccaccttgccctactgcgcactacgcgcacagctcccaccctctactctcctgtgcactactctcgtctaccctactctcacacgctacactctcgcacacagaacactcctccacaggcacccaacgcgcggcacacacgacaccctcaccacgcacgcacgaccaccacaccgtccacccaccagcgacactacaccccgacctgtgccacgccacgcggcctcacgacccctacgcctcctggctccacccaactttcgaacacgcgtcccccaactctgcgccacgcaccgccgccccgtggcctccgcgcgcacaccacctgcactctccctaacccttccgcgacacccagccacgcgcacaccggtctccaccgccgccacctgcacgccacacccttggacgcgccgcaccgcagcgcacgcccgacccacacccgacgaaccaacctccacaccaccggtgcccaccgccctccctcgcaagccccaccaagcgcctacgtaactcgctcccacaccggcaccgcggcagccactctcccgccccaacgcggaagctccaccgccccacaccgcgccacccaccttgccgcacgctgcaacccacctgctcgccttgcggcgcgaccctgtgagcttcttgccctcaccccacctgtcccattcacccccttcgccgctggctcccttccgagagccccggctcctcgcccccccttgcctctcttacccccattcctgccggacccccctgtccccatcaacggctcttctcccccccccgattcccccgaccacgtcgccgcgctatgaacttttctgggtccccccgcttcctttccaatcttctcccgccgctactcgcctcgtctcagcgcctcccttgacacccgcacaatcctctgcgcgctattgccccttggcccccacccagtccgtcggcccaaccctctgccaacgcgcccccttgtgcacacacacggcgcccccccctttctgcgcccctctgtggggtccctcgctccaacacactctgatctcatcacctctgcgcctctcgcgacaaccgagcgacgctccgcgaggccgcatctccaccttccatgcgctcagaacgttctccctttgccgcccccaacatctccgcccgccctcaactctttctctcccagacccatcactcgcctttctcccccgttctcccccgatcgtcgttcgcctcctgtcgtcggccacctgctcgtcgcacttgtcaacgccgcgcggcgcgcaccatcgcccctcttcgtgtggcgacgcgcacccacacccagcacccacaccacgcaagcagcacggcccaccacacccaccgacctagacacacagcagaggccgccggcgcgagacacgacccacaacccacgccctctctagcgggacacactgaccccctttctgacgcccccccaaccaccacgcaagcgccagcccactagagcgaactctatccacccgggctacgcgcgcgcaccaacatccccccagcgacttccggccacccacccaccccacctctcactcacccggcgcccccgcagcgccgccgcgaccacccgt

SEQ ID NO: 550818 - DNA, 88 bp, Homo sapiens
tatacttctgtgctctgagtgattcatacgggccttcctgtaagatcggggggatgttccgtcggtacaccgataaactcatctttgg

SEQ ID NO: 550819 - DNA, 456 bp, Homo sapiens
gctatacagcttcaacctccggggctcaagcgatctgcccacctcagcctccatgcgccagcacatccagctcattcttgcaattcttggtacagatggggtggcccaggctagtctcgaactccggggctcaagcaatccacctgagctcaagagttcgagaccagccgggccaacagggtgaaaccccgcctctactaaaaatacggaattagcggggggtgggggcacgcaccggtaatcctagtacttggggaggcagaaacaggtggatcacctgagctcaggagtccgagaccagcctggccaatagggtgaaaccccgcctctactaaaaatacaaaattagccaggcttgggggcaaacacctgtaatcccagctactggggaggctgtggcaggagaatggcttgaagctgggaggcagaggtggcactccagcctgagtgacaggg

SEQ ID NO: 550820 - DNA, 706 bp, Homo sapiens
  misc_feature (58)..(58): n is a, c, g, or t
  misc_feature (61)..(61): n is a, c, g, or t
  misc_feature (63)..(64): n is a, c, g, or t
  misc_feature (80)..(80): n is a, c, g, or t
  misc_feature (90)..(92): n is a, c, g, or t
  misc_feature (100)..(100): n is a, c, g, or t
  misc_feature (119)..(119): n is a, c, g, or t
  misc_feature (145)..(145): n is a, c, g, or t
  misc_feature (153)..(153): n is a, c, g, or t
  misc_feature (155)..(155): n is a, c, g, or t
  misc_feature (157)..(157): n is a, c, g, or t
  misc_feature (168)..(168): n is a, c, g, or t
  misc_feature (176)..(176): n is a, c, g, or t
  misc_feature (179)..(180): n is a, c, g, or t
  misc_feature (200)..(200): n is a, c, g, or t
  misc_feature (209)..(209): n is a, c, g, or t
  misc_feature (222)..(222): n is a, c, g, or t
  misc_feature (224)..(224): n is a, c, g, or t
  misc_feature (243)..(243): n is a, c, g, or t
  misc_feature (250)..(250): n is a, c, g, or t
  misc_feature (254)..(254): n is a, c, g, or t
  misc_feature (295)..(295): n is a, c, g, or t
  misc_feature (341)..(341): n is a, c, g, or t
  misc_feature (353)..(353): n is a, c, g, or t
  misc_feature (357)..(357): n is a, c, g, or t
  misc_feature (361)..(361): n is a, c, g, or t
  misc_feature (367)..(367): n is a, c, g, or t
  misc_feature (386)..(386): n is a, c, g, or t
  misc_feature (470)..(470): n is a, c, g, or t
ttccggcttttggatatagttaattatacagctaggatgacaacacaataatgaagtngcngnnagcagcgcaccgcccntgctggaaannntgcctgcngccatcagtgacatgagcnggccccccacagtcgtgacctttganttccaggntngncactggggtgntggggttnttnnaggcccatggtccctgaggnccctttggngcagcccttgttntnagaggtcccttttcttttntacctgntgcncagagcacactaggccagggagtttggtgagagggtgaganttgacttcagctctcagagaggtgcaagctccatcgaacccgtgtncagagagctctntgtntttncaaatnttggcaaatggttattttntattcacctgatacagaccataagtggatgcatcttgcattagcctttttggcaggtaggaaacaaagctagaaaacctctgtnagcactgactgccatggcctgttcccctttctttcagtgagacctgggtgtgggatgctaggaactgctgagtggagaatgccatcacagccatggacacagccaggaagggaggcatggtggggatggggcagggccagctttctagtgtggacggcctgggatgggccttagctggccctggacagcggctatggcagccgtctgtggcctgagggtgccagactgccccatcc

SEQ ID NO: 550821 - DNA, 872 bp, Homo sapiens
  misc_feature (30)..(30): n is a, c, g, or t
tgaacacgcgcatatataaatactcactanacacactagcgagtgcagagtagacatgaatcacacagacacacccccattcgactccccatgccgaccccaccatgatcgctatggaacacgcgaggaggatatctagaacagtggagccccgggctgcaggaatacggtacgagccacagtccagcctaggtaacagagcaaaactctgactctgaaaaaaaaaaaacaaccttgaaaattcaaatatggatggtgactctatcttcaggtgaagattagggattactaggacacaatggagctggaaaaagtacttccattaaaatgataactggggcacaaagccaactgcaggagaggtatgcgacatgagaaggaaattttattttaaatatagatgacatctttctataatacctatcagaaaatcaaatatcatattaaaaaatagatgaaagaattataaaatgactcttgcgaatccaaaaaatattgaagcttaatggccacatttaactcctatagaagaagggggattggagcaaaaaccaaaggtggaactgacattcatagacatgagcaggaggagttacaaggcagcagagcaatagaaggaaacagcatgacaacagcctcaagatcatggggaactgccacaggagaacctactgcggcccaagctaacaatgaaagagcactaggagacgaatgcacctgagaaaggaacgcggaaaagaagatgctgctcttagcattcaagggaccagaaagaagcatcaaaattagaagcaagaggaaagggaaaaataggcaattccttcactaaaaattaagaaggaaatattacaacaatggcttttatcacggcg

SEQ ID NO: 550822 - DNA, 353 bp, Homo sapiens
  misc_feature (65)..(66): n is a, c, g, or t
  misc_feature (88)..(88): n is a, c, g, or t
  misc_feature (160)..(160): n is a, c, g, or t
  misc_feature (216)..(216): n is a, c, g, or t
tttgatttatgccagagggtgctttcaaaggaattatcaaaacaatggcatgattaatgtggccnncgtatcttttatccttctgttnaaaaaataaacagcaaaatcattactcctctcctgtttgaactagaaatgttgggaaacccctgagtgcttntcaggtgaagttaagcagtggtgagtggtggtcacatgagcaaggtcatgcttgcncagccgtgttagttgagagttattgaggcatctgtttaacacagtggtgtcagccgctctacaatgttaacgcagtcatgaaggtctcttatcagaatggtataagaaagagaaaatagagtccctaagtgaggtct

SEQ ID NO: 550823 - DNA, 190 bp, Homo sapiens
gggatggcactgaccccttccttggtgacagtggagcaatgtttacctttggcctcaaccagcacagtatatggtttctagaatatgcgagatgttgagtgttcgacttaaagatgctctcatacagacccttgggacttatcaacaaattcgcctcttcaaaacccatggctttcagtgccacctgact

SEQ ID NO: 550824 - DNA, 465 bp, Homo sapiens
  misc_feature (11)..(11): n is a, c, g, or t
  misc_feature (50)..(50): n is a, c, g, or t
  misc_feature (102)..(102): n is a, c, g, or t
  misc_feature (107)..(107): n is a, c, g, or t
tgcctatcctnaccccccttcccaagaaaagtaagtagactggttaattnattaggatccttgaatgtttggtcccccatgttaatgcctgctttccatgtnaaaanagagcccagcaaatttccttgaaccatcaagataaagaaaagatgggtgtcccaaaaaaaatccttgggaactgcctattttccttttttcccagaagtttattccttagggccgggtgtggtggctcatgcctgtaatccccagcgctttgggaggctgaggcgggtggatccctcgagatcaggagttcgagaccagcctgaccaacatggcgaaaccccatatctactaaaatacaaaaattagccagtgtggtggtgcatgcctgtagtcccagctactcagggggctgaggcacaaagattgcgtgaaccttggaggcagaggttgcggtgggtggcagcgcgactctgtgcc

SEQ ID NO: 550825 - DNA, 608 bp, Homo sapiens
tcaggtgtcatcaggtccctgcagccagcgaagttcccctgatggaggactcaaggtgggcagcagagggaccccccaagaggcctggaggctcctcacccctgaatgctgttccttgtgagggtccacctggctctgaacctcctaggagaccgaccacctgtccgccccacgatggggacagaaaggagctgccgccgggagcagccgtctgcctccctggcccgcatgtggcacatgaactgatcacgaagcatacatgaaccgaggacacagagccttggccccagttcgtgccatcccgatctgaccatggtcccccgaagtccagatttggcagctaggtgcacaaagtgacctcagaacatatacagccctatgtggctagagagacacgcttgaaaagccagagcaaggagactaacagcgatcaggtcactgacggccattccatgatatcacgacgactgggcagcgtgcttcccaagtgctgctgcagtctgctgagccacaatccagagaaccgtggattctagggcactgtgtcccgagagcccagctcctcaggccagcgcctgtatcctgaggttttctatggcagtgctggg

SEQ ID NO: 550826 - DNA, 424 bp, Homo sapiens
  misc_feature (3)..(3): n is a, c, g, or t
gtncgacgtgcattgtctcaaaagctaagtgggcatctgcatctgaccctggcctggagggtgacatgccacggggtggaaggaattctttgcatttggtgatataatgcaaagtgcctagaaattgggaagaaagtgattgtatcattttttaagtttgcaaatcctaggacaaagaaagctgggtcgttacaaatcatctcaagaaacaatatgagtgattaattgaagaaaccagcatgaatgcataagatataaacagctgttctactgaaatgaagtaaaaataggtaacagagaaacctattctaagaatgtatttgctggccgggcgcaggggctcacgcctgtagtccagcactttgggaggccgaggcgggcagatcacgaggtcaggagatggagcccatcctggccaacatag

SEQ ID NO: 550827 - DNA, 529 bp, Homo sapiens
tcaggcttaatacgttcctcgctcttggaagccaaacacctccagttttcctccaggctattctttactctgaagtaacttttcctaagtgatgagtcctagttggttcactttccacttggaatttactaagagtgctactgggaggtgaacaggacattcgggatgtagtctaagtgggacagagtatcatggaactggttctgggtgccattttttttttattccaacccagaatggtgttacctttgggggcgggcatatcaggcctatggaggattttggcggcttaagtggtctcttaatatgtcggtatgtgtgccggtgtgtgtattggtgaaattaactttcctatgcaggaataaattacatatctttttctggagtaggcacaggtcaccggtgtgtatttcaaaatacagtcaggggcggcctaaggaggtttcggtcaaggatagaccttgtttacaatgggggcccataagattataacaacattttttactgtaccttttctatgttagatacc

SEQ ID NO: 550828 - DNA, 1734 bp, Homo sapiens
  misc_feature (135)..(135): n is a, c, g, or t
  misc_feature (360)..(360): n is a, c, g, or t
  misc_feature (462)..(462): n is a, c, g, or t
  misc_feature (485)..(485): n is a, c, g, or t
  misc_feature (494)..(494): n is a, c, g, or t
  misc_feature (499)..(499): n is a, c, g, or t
  misc_feature (503)..(503): n is a, c, g, or t
  misc_feature (547)..(547): n is a, c, g, or t
  misc_feature (572)..(572): n is a, c, g, or t
  misc_feature (580)..(580): n is a, c, g, or t
  misc_feature (604)..(604): n is a, c, g, or t
  misc_feature (773)..(773): n is a, c, g, or t
  misc_feature (775)..(775): n is a, c, g, or t
  misc_feature (783)..(783): n is a, c, g, or t
  misc_feature (812)..(812): n is a, c, g, or t
  misc_feature (917)..(917): n is a, c, g, or t
  misc_feature (921)..(921): n is a, c, g, or t
  misc_feature (1039)..(1039): n is a, c, g, or t
  misc_feature (1055)..(1055): n is a, c, g, or t
  misc_feature (1088)..(1088): n is a, c, g, or t
  misc_feature (1118)..(1118): n is a, c, g, or t
  misc_feature (1120)..(1120): n is a, c, g, or t
  misc_feature (1124)..(1124): n is a, c, g, or t
  misc_feature (1379)..(1379): n is a, c, g, or t
gtgtgcggtgttgtttacctgcatattgcaggggcgttgttctcagcggcctgtgtagaatctggtaccgtcgtcgtatcatcgggggagattgaatgtaccttctgagggaatacctatttgacgaaaacgtcnccataggcccatgtctggggtaacttgccgtcgtgtgctagtgtccgaacaaagccgcagaacgacgtttgctccctccggatcgtcctggggactcgacgtggtgcagtccggcgcacagcggaacccgtggtctcgcttcgctgtgaccgagcaccaacggaatgcgcgtcgaccgtgggctgcaaccctttcgcgaatccacagagctgttcgtgaaggtgngttcaatagcgatctttgtgctaagcgtctgggcgaagaaattataggcggtggcgtctgtaccagtagggacgccggatgtggacgcggtgcccatggatngtgcggacagacggcatgctttngttctcggnacagnaacncggcggcagaaccataagaggcttgcaagtgaactcccaattgnggacaattaggtattcgtgggtgtncttcctgngcctcatctatacatcggtatacngatgcaagacgcggattcgcgtaagtacccgcaagtgaggtataagttgggaaggggtaagctctcgcgcttttggggaagaggtagggcggcagtccacgaacccgcatctttcggcgcccttgcacagaattccctgcaactttggaggggctgtggcattcctcangngaagtttngtgataagacaatgttggctagcaacaanccaagcgaattggcaatggcgagaaaaaggaaaaaggccaataggtcggtttcggccggaaaagatagaaaattgtggcttaggggtccccgtattgtaactttntttntccgaagaggaagcgaaaaacttacacggtggttctttggctttacggcttccattggcggaacgaaggggtccctgttgccggcaatgaacttcaaaaggcaccatccgaaatggtnagacctccaagtggangtggcgtttcaccatgggaggcggcgcagacanggcaggtagtgtccctccacatggtgaatncncctntttgggtatctggcctcgagacatgcgtaagtcgcgttgttgttcctcccaacgcgccaaactcggagttaatcatggaaattcgtagtcgtgtggatttcatgcccgggattggttacctcaagggtggacaagggttataacgctttgcatttactagcgaggcgacttggggcaagcgatggagcttacatccccatgcttcagctgctgtctcgccattggcacatctgccgcgccagcgcattcggccantgggtgaatcggtatgtgccccttgttgtcgcggcgcaacccaaggtgcgtcacgcaggcagcgattgccttttgcgcctttgcatagcggaaagtcaagcgcgaagaaaggtgtgagcatcacagaaacgcggattgcaaagcgcggcggagctgcaatgtgcaccagtcgctagcacgagcaaggggcttcttgggccgaaaaagcgtggaagaagaacccgcggtggcccccagagaacactcacagagggggaggaggggggaccaccgagagggcgcacgcaagcgtgggcgcggagaccacctaatgtgatcagacagaaagaggaaggcggttcacgtcacccgcgag

SEQ ID NO: 550829 - DNA, 370 bp, Homo sapiens
  misc_feature (87)..(87): n is a, c, g, or t
  misc_feature (347)..(347): n is a, c, g, or t
cagtaaaatgcccctttaccagggaagtgaagataatttaagtttagaccataaaccaagcctgaaagaacagatttttgaagcccnctcaagcacaccttatcctgcctttaccctagtgcctgaagttttagacagtatcctctgaggggttatcctaatctcaacccctttcaataggtaaaatctttgggaggatccactatcgttaattttgttctgtgtataatttgtgctattggtttactgttcgtgtgtaaaattggaaaaaatattcttcaatccaatcgtgatcagtgccaacctatgattgctatggttcatttaaatcagagaaaagggggagntgtagggagaccccctgaaacta

SEQ ID NO: 550830 - DNA, 400 bp, Homo sapiens
  misc_feature (141)..(141): n is a, c, g, or t
ggcaaaccccccactgtccccttcaaagttacaggccccttcgggtttgtggtgggacccctcatccctgccccccgggggcctgggattgtttccccccctgtgcctaaaaaactgctcattaagggtgggattgatganttttaccccccaacccgggggtgccctgcccccctggggaaattttcccagggcccccctttatgccctttttaaaacccacaactacctgaccccccccctttggaaggagactggtttcccccagtttccccatcagggggttcctggcccccccgtccaaaccccccccaaagtttccgggcaaggggatcagggcccccctgggggtcccccaaaggggttttttcccaaaaaaaaaaaatgaatttagggggga

SEQ ID NO: 550831 - DNA, 191 bp, Homo sapiens
ggtctaagctggaatctggtcaccttccatccagtgcaacaactgtgttcaaaattctgtgacaaatgacaatgaagctcaagtgtgcatatggcattcaatcccacaccatcgatcatagcaccaccttatcagcactgaaaactctttggcattaagggatcatggcaagagcagcgtgactggacatt

SEQ ID NO: 550832 - DNA, 321 bp, Homo sapiens
tagctcggactggtgttgaatatattggtgagttctagagatggctcatgcttcacgtacaagggttttcccatgaaatttacattgagttgtccacctccagcttatagggcttctggaacagagtgggtcttgctcttaagtgattccatgggagaaaatggaattgtaggtactagtagaattcagggaactgtcctgtcagagacttcgactgtcatggatttggagcttaccttgccagttgcttgagttactgaacagagcaaacatagagcccgctatgctatgtagtaatatggcggataaagagctaatgtc

SEQ ID NO: 550833 - DNA, 128 bp, Homo sapiens
gcacttggaaagctatactggcgtgttttacactgaggaaagagctataactggcgtgttttaactgaggaaagagtatagatgggccgtcgttttaactgaggatagagctatgacggggcgtcgtt

SEQ ID NO: 550834 - DNA, 1191 bp, Homo sapiens
agcggagtggcgcgagccggcgaacgaagacgggccacgatcgcgcgtgagtcctggagtttccctggcccgtcctctatcaatgacacttccctgcggccggaaccctgcctcgtcggggctaaaacgtctgaccgacggactaccagaaggcgagctgtgggggttgacctcgtagtaagttgcggactcgatggcaccaacatatacaggaacccttccagaactgcagctgcagtccgatacagacatgaatgacggcaccatggtcctttgtcctcgagagaagcttcattgagtgtgcatgcgtgtagacatggtgatggacgggccaaatcagaccgtttcgctcgcgtgagaccggtgcgggggcccactcacgtacgagcggtgcagctccgcgccgctacggccgtcaccctatccgagctagttgtcctcggttgctacccggcaggaacgcatgatacgcattgctcgtgcggaacgccatgacagctctaccattccctagcggatgccttgccagggtcgcggtcaatcttgcgcatatgatccccgtaggctacaagtgttccgcgtacccgaacgctgccttctcccgctgggacttggttcatttctatccacctctcaggacatgggtcgagcgggattggcttatggttcggcacgagtaggggcacaagttgcttgagcgacgctggtgctcgaactagcggctacgcgggagctagatcacgggcggggagtcgacgcgaagcgcgtacgtttggccctagcgcctagggtagcctgcttcagggaccactagaccgtggtcaaggggaaccttctccacaggcttccgacctggcccggatacgagtcttcccctcgtggccaaattcaaaacaactaacgttatcgtcgcctggctgtcctctctgagagtctccgagggtcctcggaagggtcagttaaaagcttacctatgagacccccttgcgaaaggcagttagaacgtggtgaagagcccccattccatttggaaacactggagtcgtccgcaggggtgttctcttaacctactttctatacccgttccttatacccttccacttaacctttaggtatgtagagaccatttcagattctaccttcccgttttgtgactccaacggaccaacacccgaaggccaatgtggggtc

SEQ ID NO: 550835 - DNA, 251 bp, Homo sapiens
gaatatgtcatgcagagatacgtgactacaggcagaccagtatcatgaaagtcgccatggttaccaaagtcggcacattctcttacgtccaacaatgcacacttgaagtttgtgatgtacatgcgataacaagtgataaccacaaagggacccaggttagttgttttgttttattattatactttaagtcttagggtacacgtgcacaacgtgcaggttggttgcatgtgtatagattgttgtaaatggcg

SEQ ID NO: 550836 - DNA, 291 bp, Homo sapiens
  misc_feature (18)..(18): n is a, c, g, or t
  misc_feature (20)..(21): n is a, c, g, or t
  misc_feature (74)..(74): n is a, c, g, or t
  misc_feature (144)..(144): n is a, c, g, or t
  misc_feature (172)..(172): n is a, c, g, or t
  misc_feature (187)..(187): n is a, c, g, or t
  misc_feature (198)..(198): n is a, c, g, or t
  misc_feature (213)..(213): n is a, c, g, or t
  misc_feature (224)..(226): n is a, c, g, or t
  misc_feature (260)..(260): n is a, c, g, or t
  misc_feature (280)..(280): n is a, c, g, or t
  misc_feature (282)..(282): n is a, c, g, or t
aagaaacagataagtacncnnctgcttctgttgcaactgttgcctcaattcaggtgaatcttgaggtgttccangttgcaacagaagcagcagtatactaaccagcttgccaaagaaacagataagtacattaaagagtttggntctctgcccaccacccccagtgaacagngtcaaaggaaaatanagaaggatcgnttagtggaagagttnaaacatcactnnncaaacttccagaaggtccagaggcaggctgctgngcgagaaaaagagtttgttngncgagggggg

SEQ ID NO: 550837 - DNA, 322 bp, Homo sapiens
tggagcaggttgccattcttgagctgcgactcgatgatctgcaacgaggagaactgctcgcccgtgcgccgaccgtactcctgcatgacttcacccaacccattgaacacctggacgacccggttttccggccagtcgggcaacgatgtcagtacccgcaagcgcagatcgccctgctccagcgttcgcgatagcgcgtcgggtacctcgccgataaaatcgctgatggcctggtcgatcctgaagcgcttgatcgtatcgagcagcagcgcgggcaccggctgattgtccgccagggctttgcgcaagacaatctccatga

SEQ ID NO: 550838 - DNA, 191 bp, Homo sapiens
tctgtaagtcactatgaaatggtcaggctcccggacgtccctgctcctggctttatgccctgctctgcctgccctggcttcaagaggctggcgcctgtccaaacctgttcctgttatccagtgcttttttgaccacgctatgctccacagcccatctgcgcgcaccacgctggccattcaactgcctccga

SEQ ID NO: 550839 - DNA, 1146 bp, Homo sapiens
gatagccgtgccgcccttccatagggtgtggacgagtcgggccccgccctgaaggggcaccgtgggctgtgtgggcctgtttcgtgacgctaggctaccggtggccgagctccggtgaccagtgaaaggtccaaggctcatgtcccctgatgctcgaggacaactacatgttacctgtgctcattctgacggagcgtcacgcgcgaggcggtggccgctggacgtggctgtggtcccaagaggcttgctggatgatcgtgggccgggagggggtgtctctgagccgttgtgctgaccacccaccgatcattgtggacctcgcgtcggggacacacccggaggctggtcgtcggcttcgtcccgggctggcaggtgcttgggcgctggacgacgtcgcggtctgtctctgcgtgactgcgcagagctggtctgcgacggggcatggatgctgctgggttgtagacgcgcgactccccggggtaggggcaggcgggaggtgcggcgccccgcgtgctactcgagcccgaccacttcaccatggctaccggccgtttgctcctcccgtgcgacacgattcagggcgccccagtcccagcaggtcgcgattgcgcgtccgtgaccgacgcacgggttcacatcgcgtgcgggcccatcactgtaggcttacctttccatgttggccgaggaccggattggcccctgtacccctccctgaccgtgtttcctcgtgtgcggaccgccgttgatcgaggtgggccggggtggctagcgtcaggtgcgcttggatgtgtgcaagtggtccccagtcaggattgttagccaacgaagtgctttgggcccagagccgtggggttaccccattagacccaccccgaaggaaccgaaaggggtggttcataggcgggaccacaggaagcaccaacggctttaggaaaccctgggaagttgtgccccagaacaagtgggagccccctgataagcggaccacggttgagaagccacaaggctggtcctggggctaagaaggaggggatgagggattgacgtgacccacttgatgccgtccgaactcttgggcgaggaagcggctctaagaacccctttcttgacgggtggaaaaggaagccggttgcgcaagttcaacgg

SEQ ID NO: 550840 - DNA, 719 bp, Homo sapiens
cagacttggtgggggagcttttgggagatgcaagaagctcagcttataaccatcccaagcatatgtgcactgactatatagacagaggtgcatgtgtgggtgtatatatgcacacacacactctgtatattgtgtctgtgtgtgtgtctcactctctattactctctaataaaagagactcagtacactcctgcttgctagaagaagctgactaggcaactctcatgggggttcccgatagtatccatcacagtcccaagactggagttgtgaggaactcactggagcacaacactgatagcgaactggtgagagcgcgtgatactagctcacctatagctagagctcttgaaaccaatttactgagaactgatgcgctgaaagttattgacagacagactaatgtgccaaaagctcaagggcgatctgggtgcgtttatatccatatacaagtgcgatactgttttgtcatgcgctggacattagacgaatttatatctatacatccaagagtacttctgagctcttatgagcaacataaactgatgaaatcagcacaactctgtcacagatgagactgctggctacaactatagacgtgtgtccctatagtatccaccatgtagaaactcttgttgggtgaagctgctagcactaactacactcagagcacacattctagtggatatgttttttgtgtcttaatactatcacccctt

SEQ ID NO: 550841 - DNA, 265 bp, Homo sapiens
  misc_feature (31)..(31): n is a, c, g, or t
  misc_feature (108)..(108): n is a, c, g, or t
  misc_feature (149)..(149): n is a, c, g, or t
  misc_feature (220)..(220): n is a, c, g, or t
  misc_feature (235)..(235): n is a, c, g, or t
tttaaaaactaaaaactaaaaactgcaacangcaaaaaagaaaaccaaagtggtccacaaaacaatctcctttcgtactgaaggattaacgaagacattgtaataatnaaccagtattttactacaaaacttaaatggccaatagaaanaaacagtactgagaacgtactaccaccactgaataagagtagggatggcaggaataagggaaaaaatacanttagccttctgagcnttctgggcagacttggtgaccttgccagcc

SEQ ID NO: 550842 - DNA, 427 bp, Homo sapiens
  misc_feature (158)..(158): n is a, c, g, or t
ccacagccctgaccacacccagcggttccgcatccttgccttgcttctgggcgggaagccccccagcccttcaaccctgtgtcctggcttctctcctaaagaggaggctgcagtccgtcccgcgtgtctctgagcacttggtggacgtgtgggagatncccacgtggtgggacctcccagcctgtagagccctgagctggagggcctggtacagcctggggtcagagtcctcactgccccagcctaaccgtgtaggcctgcggtgcctgggaggcggcaaactcgggatttcaccgtgtggaggtgcgacatgaggctgccaggcaagtgggtcctctccccagggcccaggcgagtgaccctgaggacgctctggccagcgcagtgtctggaacccagcgcctacccagccgtccctctgcggccc

SEQ ID NO: 550843 - DNA, 1666 bp, Homo sapiens
  misc_feature (23)..(23): n is a, c, g, or t
  misc_feature (427)..(427): n is a, c, g, or t
  misc_feature (825)..(825): n is a, c, g, or t
  misc_feature (1244)..(1244): n is a, c, g, or t
agcctgtatcatccgcctcgtgntgtgccttggagctcgcgggcgacccgcgtgtgatccatgcagctggtttgtggggcgcgtgcccgatattgttgcgtcgttcgttgtggtactggcggctgcgttggggggcgatgtgtgcgttcggcgagggtgcccgtgttctgcgctcgtggtgtccagccgttcgtgttggctctcatgtgcgtaccgttctgcatggtgtctgttggcgagcgcgacgtaaatttgttttgtggcgggtatataatacactgttcgcgacctatgtggggccccaccaaggcttgttggttggggccccgccgtctgcggggggtgttttgttcagcagcccgctctggctgctgtggtgctcccgctactagtgaagatggtcgtttgttgttagcgctgccagtantggttgggctggctccttttgatcttctctctcctgcccacacgcgtcgttgtgacccccgtgtcgacggccgccttgtgtttagccagtggcactgctgggccctccagaagtcctcgttgtggggtgttcgtcgttcaacctactgtccgggggtgcttgttggttgagtgagcgtgagtggtggagagccccggcccctcctgttgctgccgcccaatttgtccgctagatgcccccccctttgggggtcaaaaaccggatgcagaatactctattaggggcctcccgtctcggctaatggttgtaagttgtctgtaggcgaccacctcttttttatggcctctttaactcgcggtgtttgtacactgccaagatgcaccgtgcttgggaacctncaacagggggttggagcccaactcctacaaaactcttcccaaaactgttatcgcccccgtagtaatccgtgcccgcaccaacttgccggatgcccactgttttgcgcccccctacacccgaagtctgttcaaatagtggagaggtccccccctttatgcccccattcaagtgtgctgtacgtaatttcacacccaatgtatcgtataataaagatgagccctcccacttttaaaccccgtttgtccccacaccccctggtatttcgcccccgacccccccagggaccacccctcctgagtgaacctccgtgcccactcacgtggaaccccttgggcccacataaatatgtgaatttatatcctccacacactctatgccacgaggacccacacctcgagaccccccctgtctgacaccnttgccagcaaagtggggagagtcccgagaactatgttctcacggcttctaaacactctgaattatcgcccgccacggccaccttctgcccctatatttcttgcacatatggccgagaatatcacccacaccacttatattaatataataaaccacccctcacccacctaccacatcttcctaggaaccaacatatgacgcactcttcccctgaactcttacaccaacatattttgtccacccagaccctacttcttaacctccctgtttttatgaattctgaaccagcatacccccgattccgctacgacccactcatacacctcctatgtaaaaaacttcctacccctcaccctagccttacttatatgataagtctccataccccttaccatctcccagcattccccctccaaaccttta

SEQ ID NO: 550844 - DNA, 599 bp, Homo sapiens
gagctcaggagtcgataccagtccgtgtgcacagagtgggcaaagaccccggaagtgggttgcagtgagctgagatcgcgtcactagacctccagcctgggcaacagagccagaccctgtcttaaaaaaaaaaaaaattatccctgatgatagaaagcgggtcacctctaggaagcaggaagccctccctggggaggagttcagtgtggatactggattaatggagcccatatgttaagcagagtttgccttatttatggtccttagggaaacaagatggttggtgggcttgggggtcaggttagggaaaccacaaaactatttacagctggccatcttgagtgatggctggtcaaaatagagtttgctataattttttttccatagactcctagagttccagagtggcacaatatattggtctggataatggcatgatcttaataggtatttaacctcctttagaaaaggcagcataaccaaaaggtaggaattatcccctataattctcatgtcttcctgtgtgcagaaatggggcagtgggaatagtctccttgtagtgcagatggagccattatttattgatttgacaatcatcg

SEQ ID NO: 550845 - DNA, 189 bp, Homo sapiens
gttttaaaaaaaaaaaaaaaaaaaaaaaaaagggaaaaaaaaaaagaaaaagaaacggtggccttttggaataaggcccagacctttgtggggtgccggtataaccccgcccccggttaagggtttaattttggtttaaccctaacgggccaccaaaggttttcccccggttggcccttccaaaagaaa

SEQ ID NO: 550846 - DNA, 649 bp, Homo sapiens
cattcctcaaagcttttttttttttccctggctggggggcgggaagggcagactgcaaactggggggctgcttacttgcaggaggcgcggtggggctgcgttggaggagggggccacgttgtgagagagaagaaaatgtgggtggccggaaattgggagggcccaaggaaccctccttgggagggggcctgcatttctagtgtgggtgggaattgggactgggcttgacgcccgtgcatttcagccgtgtgtgccttttccgtggggttccttttctgtcctttccggaggagagggcccgaaaaggggccattaccagggcgcggcgctgggtgccacatttgggaaagcagcccggagcttgggtgctggggaaggcggggcgcgttagccttcccgccgccctgcggttgggccggttggaggcccaggcgtttgctaggattgcttcagtttccctgttggccctattccttttggtaactttggccctgttgttgaagtattcggaatctcctccttgctctgaaatttcagggatcccatggtgataagcgcacaaacagcactgtctgtcggtaatcggtactactttattacggatttcctgttacactgtatagtatccttggggccaccctggaggact

SEQ ID NO: 550847 - DNA, 1292 bp, Homo sapiens
agcggggttacctggccgcctctgagtccagccggtcgacatggtgaccgtgatgggagagtgcagggggcgccgtctcgtacgctttgtcccgggcgtggtgttcgtagtgtgtctgggtcgccgtgctgcgttgccaccgcgtggcgtccgggagacggacgcgatcgagtcgtgtagtcggggcgctgctagcggacatcctgggcatccgtggcgcctatgtactgatgcgggccttggcgctcgaggatgaaacccccttggcgctgcgaccgctcggagggcgttttctccacgtcggagtcttgtgagtggacagtgggcgtcaacgcgtggtgcgagagtaatggcaggcccctagtttgtggccgtggtgagactttgggctggtacggcatgccgtgatggggcaaaaaggcttgagttaatccagagaggcgccggatgttactgccgccatactagtctgggccgctaacgttttcgtctgtcgatcccatcccaagggagctgattgcacgtagggtcaccctctcagagtgggagagaaggaagtgccagtgtctgggtgagtgtgagagacacaatctctctcggagtcataagacttgaataagtctattcagggtgaaagaggggtggagaccttttcccactgttgtgaactgagcgaaggggggtaaggagacactattatgagggaaagatagcgctatagagtgtgcttggctctcggcgcggggtagataataggggatctaaggtctttagaattgcagcggaccagtctccacggatggggtaggattctcggggggggcaaaggaaatcggataatgggtttaaattactcgctggggatgggtttttggcagtgctggatggtttatgtaaccacaaggggatactttaaaacagggcatccaagtttaagtcccttcgggtgacacagaggaggtccaaaccacccgggaatccctaaaggggagatttatgggcccttatgttcccttagaacaaaaacggtaagctctagaacgtggaaattccttgggcacattggcgagcactaagggactataccgtaacaatgggaaagtggctcgtgtaataaacctatttacccaattttccaggttgagccccaaaggtggagggctaggaccttgttgaaccaattaccggaaaggggaaattcgtttagagaatagccccgagagcgattggataagcaaatttcccttttggggatagtaacacgccgagttcgtgaatggggaattactcag

SEQ ID NO: 550848 - DNA, 190 bp, Homo sapiens
acccactactggcaatgccccaactaaatactaccgtatggcccaccataattacccccatactccttacactattcctcatcacccaactacacaagaacagaaaaacaaacaccgcatgttctcactcataagtgggaggtgaacaatgagaacacatggacacagggaggggaacatcacatactgg

SEQ ID NO: 550849 - DNA, 357 bp, Homo sapiens
tgctacagtccacaatagctctctcttcctacataacaaggttgtcgttgggctctttttctagaaagcgtctgcatgtaatacatagcattcacaatttttattaagctctttgaggaagacacacaacactgccatgtgtgctttgtgttttagaagaaatcctttttatttttatttttgtatggttggcagttgattgcttgaaataagaaatcttgtgaaaaggagggtcaaggcattctagagattatattggtattctttaggaacggaaacagtcatggagaaaattggcataaatatagtgtgagctctaaaatgttgtattgtagtcaagtgaagatagcaagatca

SEQ ID NO: 550850 - DNA, 1636 bp, Homo sapiens
acgatcaatctggtcggcgtagcaaggatatgtgttgggagttaagatacaaagagtgaatgctcagtaatgtgtgttccagatgtagtgtgtgtacgtacaccgtggttgtagatagcatataagaataattagtggtatgtgtgtggattgattatttcttctctggttggaggaagaatatactaataaatgttgtatctgtgttgtacgagaatgatagtgagtagagtgtggtggtgagtggggtctatgagattgtgtatgatgagtagatagcatagaggatgtgtggtgttagtacacaatcatggtgggttgtatttggtcgtgctatggtagcatagtttagaataaagttgaagatggaagtcgacatgtgttgttgttttgtatgattgtatgatatagcttagagtgagtgtcacaattagtgttgcaggtcacaacatgaggggagggtgtggtggggggcacaacccaagtgtcgacgtgattattttggttttggttggtaggggaaatagagctgatctctgtaggtggtgcgtgtggtgtgatgtcaagacacggacgcgtacgtgttgctgattgatagtctagtaggctatgtatagcagtctgatgtgtgtgtactatcctgccactctaatctggtgtcgatccgatcgtgatgagacaaggcgtcgttagcttggtcggtagtgagtagtgtggatgaatatagtgcctgtcctcctccatcggcagggatgtcttttgttggtgcatacctactcgtacgctggggtgggagtgcttatagtacgctttgtgtgcgttttgtggtttatattaggctccgcacgtacacgtgtttataagtagggggtcgtgcatgttggtggtacgtgacgcacacactctagcggtgtgggtcgcacatccaactatcagtatggagtatgttgtgatgtatgatacgcgcaaccgaccgtggcttatgattaagaataattaggtgtagatgttgacgtgtgtgtgctcacgaacagatagatgtcgttgtaacactagatttcttcatcttcagcggtctcctctcttcgacttcgtcacggtcgctgtgtgggtgtcggacactcgtgtgggcatgtgtgattatatgtgatgtgtgtggttgggtcctcctctctacttgggtgctgtcttcgacggtgatgattgttttgtcgtgttgtaagatgtcgacggcgatttgtgttgtcgtctgttggtgataaacagatgggtccgcgatattgtgtgtaggtatgagtagtgttgttcaccaaagtgaactctctctcatcgtgtgatacacctctatagatattgtttgtgtgagataaacaatggtgtgtgtctctgtgtatagtaagaggggtggtgggtaggttgataggagtacggtcggtgtgtgtgagaagtatgatgattgggggatgtattatgattagtataatagttgtgtgtatgatgatatgtagggaacaaatgagggttgttattgtggtgtgtgtggtagaaagaacgccctcgtgtgggaaaataaaagttgttggtgtgcaaccctctctggttaaaaataaataaataatataataaatataaataa

SEQ ID NO: 550851 - DNA, 537 bp, Homo sapiens
cgtactccccggttggtggggcctggagcatcattctgggccactgtttgactgtgtcatcatctttgcatatctgcgcgtggaatcgccccatattgacatccaggccttgtattcggtctcatctgattgggcagggcagctaattgatgatttagcggtttgtgattcgcgcgttagtgtaagagcgaatcacacaagtgggctaagagaatagattatgctgaaccacaccgtggttgtgcggtctgggctgggcttccagggccggctccatgtccatagcaggagcttgactaccttctcaaatttgggagcatgaagagcgtatccaaggatcgaagaaccgaggtggataaccatgaggatgacagtagtgtgattcataatgacaatgaggccatcgctcggctgttggaccggaaccaggatgcaactgaggacactgacgtgcagaacatgaatgagtatctcagctccttcaaggtggcacagtacgtcgtgcgggaagaagaaactttgggggaaattgagcga

SEQ ID NO: 550852 - DNA, 823 bp, Homo sapiens
ggaactcgagccaagaaagtgaagatggccaccaaatcatgccccgagtgcgaccaacaggttcctgtagcatgtaaactcatgtccttgtggattacgaatatttagttagcagaaaacttttaacatgcgaaatacacgtcagtagaacgtcaccaccttctacagagaaacacggaaaaggaaattgacatctatgctaacctgtctgatgaaaaggctttcgtgttgtcagtcgcctgggcagaagataaatagagaaaattatcaatcaaagacttattctctgatacttgtatgcaaaatctggctgaaacttctggtcaggataacatcagcaaattctcaagacatgttatggactctcaggagcatttctgactgcatcaataagggccatcgatcgtttctttctcgcctgtcagttgacgcctgtgccacacttcgggagcaaagctgtgtaggcttggactggtccgtgggatttccttgtttacccaaggagtatggtcagtgtctggtcgtcgggatatacgtaagtgtattctgccagcaacaaaaaaaaaaccaacaaaagaatgctgatggatgttcccggattacacacgtgatcgcgggtatggggtacagtatgacaacctagggtactaacgatgcctgcatgcttccaggttggcaccagtagatgcactttgtaacctcctgtcggaacagcgtgctttccacactctctttcagaatgcaggcaccagatgcttattccgcattacctattaatggcaccatttatgccgggccaccatcccgcatcgccccgcattcg

SEQ ID NO: 550853 - DNA, 111 bp, Homo sapiens
  misc_feature (110)..(110): n is a, c, g, or t
agagagagatagagagagagagagagagagagagagagcacaggtcctaaacctaccaaacctgcattaaaaatttcggttggggcgacctcggagcaaaaccccacctnc

SEQ ID NO: 550854 - DNA, 1026 bp, Homo sapiens
  misc_feature (45)..(45): n is a, c, g, or t
  misc_feature (89)..(89): n is a, c, g, or t
  misc_feature (98)..(98): n is a, c, g, or t
  misc_feature (119)..(119): n is a, c, g, or t
  misc_feature (124)..(124): n is a, c, g, or t
  misc_feature (129)..(129): n is a, c, g, or t
  misc_feature (223)..(223): n is a, c, g, or t
  misc_feature (232)..(232): n is a, c, g, or t
  misc_feature (306)..(306): n is a, c, g, or t
  misc_feature (399)..(399): n is a, c, g, or t
  misc_feature (407)..(407): n is a, c, g, or t
  misc_feature (454)..(454): n is a, c, g, or t
  misc_feature (474)..(474): n is a, c, g, or t
  misc_feature (482)..(482): n is a, c, g, or t
  misc_feature (509)..(509): n is a, c, g, or t
  misc_feature (542)..(542): n is a, c, g, or t
  misc_feature (573)..(573): n is a, c, g, or t
  misc_feature (606)..(606): n is a, c, g, or t
  misc_feature (614)..(614): n is a, c, g, or t
  misc_feature (621)..(621): n is a, c, g, or t
  misc_feature (628)..(628): n is a, c, g, or t
  misc_feature (638)..(638): n is a, c, g, or t
  misc_feature (648)..(648): n is a, c, g, or t
  misc_feature (660)..(660): n is a, c, g, or t
  misc_feature (673)..(673): n is a, c, g, or t
  misc_feature (702)..(702): n is a, c, g, or t
  misc_feature (720)..(720): n is a, c, g, or t
  misc_feature (753)..(753): n is a, c, g, or t
  misc_feature (757)..(757): n is a, c, g, or t
  misc_feature (763)..(763): n is a, c, g, or t
  misc_feature (766)..(766): n is a, c, g, or t
  misc_feature (781)..(781): n is a, c, g, or t
  misc_feature (786)..(786): n is a, c, g, or t
  misc_feature (798)..(798): n is a, c, g, or t
  misc_feature (807)..(807): n is a, c, g, or t
  misc_feature (829)..(829): n is a, c, g, or t
  misc_feature (842)..(842): n is a, c, g, or t
  misc_feature (850)..(850): n is a, c, g, or t
  misc_feature (858)..(858): n is a, c, g, or t
  misc_feature (865)..(865): n is a, c, g, or t
  misc_feature (876)..(876): n is a, c, g, or t
  misc_feature (909)..(909): n is a, c, g, or t
  misc_feature (912)..(912): n is a, c, g, or t
  misc_feature (916)..(916): n is a, c, g, or t
  misc_feature (933)..(933): n is a, c, g, or t
  misc_feature (936)..(936): n is a, c, g, or t
  misc_feature (940)..(940): n is a, c, g, or t
  misc_feature (944)..(944): n is a, c, g, or t
  misc_feature (947)..(948): n is a, c, g, or t
  misc_feature (953)..(953): n is a, c, g, or t
  misc_feature (963)..(963): n is a, c, g, or t
  misc_feature (1002)..(1002): n is a, c, g, or t
atgtgagtggggagataaagtgtgtgtgtgcgtgttctctgaggncacagggtggcataactcggcacactcataatgacacagccgtncacccagcnacagatagtgagagggcacanatggngaganccacatgtgcggagataaatctcccccaccatgatatgggttgagagaaaacacgcggcagtttactctagtatgtgtacacaatcagggaganagggccgtncaatgcatgtgacctacacccacactgagagtgagatctgctggaggtgctcagacacagcgacccaccgtganaggccgagactgatatatgtgagatgagagaggcatgcgtgcgagattgactgtgactgtgagtgctattcattcatcacctttctgggaganacactganatgtccaccctttgcaaaatgcacacacacgcgcgcgcgcactcgcncatgcacgaacacacgcgcncacacgcncacacacgcgcgcgggtgtacacacanacgagccactacgagaaaattattcaccatgantagaggtttttctatacgtgggaagaggggnaggttcacactaggctgggggggggggtaattncccgtttncgttggnaggtgcngccccatctnccaagttgtngctttggctgcnacaatgttctctnatttattgaggtgagggctgtggcatttnctgcagcccctccaagantttctgttcctttgtgtaaatgttttttatgcntgcnaatgtngtntctaaactatcaatnttgcncctgaacatggngatgctctnctgaacggaatcccagcctctnttctgtttttttncgcatgcntgttcggngtttganataatacaaanctcccttttaaagcccagcagccccttggacanctnagcntttttcaccatgatganggntganaggntgnngcggnggacaaaggncagggccagggggatgttcaggctcaggatggctctttncaaaccagcgggggaccggggtgg

SEQ ID NO: 550855 - DNA, 466 bp, Homo sapiens
atatttttttgttttcttgtattttttcaggggccaaaaattttttggccaggttgcattccatgctcaaaagccaccaagggcgaattttggcggcttctcccctggggcataaagttgacatgcttgctcattggtgaaacttggccaagggagtggcgcgcaaaccaatgatactgatggcttgccttgctgcataacactttgggactgttccctgctaaaagaggccaccggtttaactaaacaggttttcaaatccattttaaggtcagcaataaacctttgtacacttcctatgcttcaaatctttgacacctggtgccagatcgagaaaaactctacggtggtatacggctcatgtgattaacttaatcttagtcttaacggccgcctatttggcacgtgccattcaagagagctctgtaaagaaacatacccccaatggcttgcccaatggttagaa

SEQ ID NO: 550856 - DNA, 351 bp, Homo sapiens
gactctaatttatgcgggggataatatggctgttagctttactcttccacttccgggcctggagcttgtgttgtataccaagtcgctatggtgtgctttgcctaagaggaatacctctatttcacctgttctggaggcaccagaccttgaaaagaaaatgctcaaaataaaatgttatctgttatttttgtaaactcaaagttaagatgatcaaagttctaaaattccaagaatgtgcttttagacggtctcaatctaaaagccacttcaaggtgttcaaagggcaaccagctagggtgctacctcagtgtagtagtttctgatactttatgtctttgctcaccctcatcc

SEQ ID NO: 550857 - DNA, 155 bp, Homo sapiens
tcagtacgaaagatgccgtagcatatctgagacacagcgatagctaagacccagactgggattagatacctccactatgcttagccctaaatctcaacagttaactctacaatactgcgcgccagaacgctacgattgactagtatgtgtggcgc

SEQ ID NO: 550858 - DNA, 210 bp, Homo sapiens
ggccccccccccctttccctggtatttttgggccccgcccccccgggggtttgggggttttcccgggccctttttccccttttttttggggtggggggggggggttttttccttaaaaggggggggcccccaaagctttttttttttttcctccctccggccctggggtccccccctttttctttaaccccggttggggcccccccccca

SEQ ID NO: 550859 - DNA, 111 bp, Homo sapiens
acggccgtgtattactgtgcgagattcggagtccggagtcctccccatctcatggttcggggatcaaagtcggttggttcgggttggttcgacccctggggccagggaacc

SEQ ID NO: 550860 - DNA, 322 bp, Homo sapiens
aaaaggcacaggcgggtggatcacctgaggtcgaggagataagagaccgagcctgtctcaacataggcataacgcccgtgctctactaaggatacaaaaaattagctgggcatggcagcagacgcctataatcccagctactcggaaggctgaggcaagagaactgcttgaacctgggaggcggaggttgcagtgagccgagatcacaccactactctccagcctgagcaacaaggcaagactccatctcaaaaaagaaaaagaaaaaaccactgaactaagctcaaggaaggtagcaactcgaagtaaagaaaaaaacttt

SEQ ID NO: 550861 - DNA, 324 bp, Homo sapiens
attcgcggccgcgtcgactttttttttttagacagggcttgactctgtcactcagtcttgaatgcagcggcgggatctcagctcactgcaacctccacccccagggctcaagggatcctcccacttcagcctcctgagtagctcagaccacaggcatgcatcaccacaccagggttttgtctttttctattgttattagagacagggtctcaccatgttgcccaggctggtcttgaactcttgggctgaagagatctgcctgcctaggcctcctaaagcgctgggattacaagtgtaagccaccgacgcccggacaataatagt

SEQ ID NO: 550862 - DNA, 401 bp, Homo sapiens
  misc_feature (1)..(1): n is a, c, g, or t
  misc_feature (118)..(118): n is a, c, g, or t
  misc_feature (129)..(129): n is a, c, g, or t
  misc_feature (372)..(372): n is a, c, g, or t
  misc_feature (381)..(381): n is a, c, g, or t
nctcctgtacgtccattctgaaagaacactgtgcaaattcagtaccctgcacaccaacacacctacgacacctcccttaaacgtggaaccggaagcctggaattgccctggaggcagncgggacttttngctgcccccccaccggccttccagagcctccgaagccccctgcatgcatggcgccttggggcctttgcatggctgccccctggagctctgcgcctgcccaaccccttcactttgttaattcctgtcctgacgcggctcagacgtttcatctgggaggatggtttcaggtgcacaccaccccacccagccaatttttcaattttttatagagatgggagtctttctgtgctgctcaaattggtntcgggctcnggggtttcaggtgattcctc

SEQ ID NO: 550863 - DNA, 154 bp, Homo sapiens
  misc_feature (64)..(64): n is a, c, g, or t
  misc_feature (68)..(68): n is a, c, g, or t
  misc_feature (83)..(83): n is a, c, g, or t
ctggtgtaggatatgttgttcgtcatctcttgagttatggtgaccacaattcagagctctggtntgcnagtctccactgcgtncatcactggtctatggtaagttccgtctgacagaaaatcgagcacagcatcaactcatgcaaaccaaggtt

SEQ ID NO: 550864 - DNA, 321 bp, Homo sapiens
  misc_feature (2)..(2): n is a, c, g, or t
  misc_feature (313)..(313): n is a, c, g, or t
gncttcctgattccatattcgtctaagatttgcctctgaaagttgcttttgaaatacacattccgtatgggcgtggtgcctcacgcctataatcccaggactttggtaggccgaggtgggcagatcacctgaggtcgggagttcgagaccagcctgactaacatggaaaaaccccgtctctactaaaaatacaaaaattagccgggtgtgttggcgcatgcctgtaataccagctgctcgggaggctgaggcaggagagttgcttgaacccgagaggcagaggttgtggtgagccgagatcactccagcctgncaacaaga

SEQ ID NO: 550865 - DNA, 928 bp, Homo sapiens
tcaggaacacacaaagaaaacacttcagcacaacctgatagattaggctcaaatgaagaatcaatacatatgtctggctgatcattataaatttaatcttttaaaagcctgacctgctctttatactcagcttgctatgtgctcaatgtctacggtatctcaatagctattctaagatgaaatgattacaggtcaaatctttagagagagatcaacttagtctcatatgcaggtaaatgatagggcgcccagtataggtgtccctaccatgtcttctgcgtctcggctgcctttgttgacattattgcaattgtaccgacagattcgaactaccgagactagagaaaagcacagtacactgctgaatcttgtacctcgacaatttatgctcaattcacgtaggcagaatttattagctctcagtgagtacacatgttctaaacacattctaactaaaatagtctatagatctccacctttttatcataaacacgaggagaccttccataattcgtggatagttctccatcatagtgaaattaggctctggatgatggcaaactgcttcctagaagcattgaatgtaagcgtagacatgaacaatggggaacgagagaccttcttccttaggggaattaggaagagtatcattagtggggttgttgtaggccttctatgcacttgggcgcttatgtccgaagacgcaaataccatcgggcgcgcacaagtcttacatctggctcatccttgggtcccactttcgtacacactctggtttaagaccaactggaaaaaacaccctggcaaggcaagatgggggggcagcacgttgtggcaatcgcttttctttgctttgacttgggtaagggttgggtaaaagggctcgttatgaattgtttgttcaaaaagcaacaaggcctccaataaa

SEQ ID NO: 550866 - DNA, 115 bp, Homo sapiens
cgtcacatgtcaacaccgggaatatttggccaagagttaacctgaccaccaacacgattgctgtgactcatactctccctaatgctgcctaattataaccgcttttcatatgcaa

SEQ ID NO: 550867 - DNA, 923 bp, Homo sapiens
  misc_feature (142)..(144): n is a, c, g, or t
  misc_feature (215)..(215): n is a, c, g, or t
  misc_feature (221)..(221): n is a, c, g, or t
  misc_feature (223)..(223): n is a, c, g, or t
  misc_feature (229)..(229): n is a, c, g, or t
  misc_feature (241)..(242): n is a, c, g, or t
  misc_feature (246)..(246): n is a, c, g, or t
  misc_feature (249)..(250): n is a, c, g, or t
  misc_feature (252)..(252): n is a, c, g, or t
  misc_feature (254)..(254): n is a, c, g, or t
  misc_feature (258)..(258): n is a, c, g, or t
  misc_feature (265)..(265): n is a, c, g, or t
  misc_feature (755)..(755): n is a, c, g, or t
  misc_feature (904)..(904): n is a, c, g, or t
ggcacgaggccgataccggggacacagaattatagatgtctgagcacggactctcccaggcctgcatgcatggcatcagactagccacatcctgccaggccgccgggatggttcttctccagttagaatgcaccatggaacnnntgactccagctcgtgtgtcctcatggagaacccaggggacagctggtgcaaattcagaactgagggctctntttgtngnactggnttagaggagtcnngtgnctnntngntcanaattaancagcaacactgcagtcagatcctgttacttgcttcagtggaccgaaatctgtattctgtttgcgtacttgtaatatgtatattaagaagccaataactatttttccctcattaaatagctgccttcaaggactgtttcagtctgagtcagaatgtgaaaaaggaataagataaatacatgcttgcggctcaaatctaaagttcaaaagaagtacctttacttgcaactctcttctaagtgaccttggatgagaagtgtcatgtaaaattttcttcctttgaagctttaggcagagccataatggactaagaacattttgactaagtttttataccagcttaagtagctgtagtgtttcaccgtcgcagctgtgctcatgcttttcaaggcatttgtcttgtgtaatattattcacagtaaattttggactgtctatatcataactatacttgatagtcttggtctataagtgctcaatagcttgaagccncaagaagttcgtagtcgaaattgtgttgctcttgtttaaaccgcaagtgcgtgcatcaaaagcagatacttgagggaaacactagtttccacaagcacatgtatttggagcacacattaaaaatccctcatgggggtttcaattaacanagggattaccgttacctcc

SEQ ID NO: 550868 - DNA, 256 bp, Homo sapiens
ctgatgatcacgaaggctatagttccatacgccctctcaggcgatcaccagttgtaataggttagtagcgctcactaatcatagtctggtaattagtaagatgagtagatttttaaagaactgataattgtttgggtctgagtatatatatcacagtgagaattctatgatggaccatgtaactaacaatgctacaggtataaatattatggagaagtagtctagtctgaagcttagggagagctggatagttagg

SEQ ID NO: 550869 - DNA, 108 bp, Homo sapiens
gaattcctaagaagaggcctattttgagtgccatgagaaacttgttccatggacaacatgccatcgggccaggaacccagttggttagataggaatcccggcggacga

SEQ ID NO: 550870 - DNA, 521 bp, Homo sapiens
gcggaatttaattttttttccatcgctagggttccagagctcaggggagattgtggcagccagcgctctggcatccttggatgggcaccgcgcgcagaggcaattacatcacctatgatcgcctgttacaagtcactagagttgaacgtagcaagtgttggaatgacatggaccatggccagaaagcaaatcatgggggagcaggcccacacaagttcttgcagatcctgcacaagagactcgcagctgacagtatctatatgaccagcaatgggcgtgtataaagaagagccacataggatgctggcacatggtggcagtcctaagaaggccagtgctcacatgagccacgctgaagatagagaccagcagcttttatgacacctactccttgtgggctagcacacaacgctgatggcctgagtggataccgacttgtgaacaacggtgggaaggtgactgcacattcctggaattatcctgccaatcatggacgtggggaccgggcatcgtgggcttcc

SEQ ID NO: 550871 - DNA, 218 bp, Homo sapiens
aatgcttgatcttatgaggatctccgtcattcgccaaggccaatgcagttggggtaaagcagcatggtgcacgatatctagtgtggctggttcccgagtgaagataatcacgtacgaaatacgaaaagctaccatttcgagttgtgcccctctacttggcccttgtccatagtgcaaggcgtaccgacgctcgaacttcgctaatcttcgatcatagc

SEQ ID NO: 550872 - DNA, 905 bp, Homo sapiens
agcggagggggggagcaggcggtgagaggggtagggagcggtgtgtgcccgggatcgaggggcacagccagtgtgcatgtcatggctccacgggcagcgacctactccatttgtcgcgttgaacgaagtgtgcgctggtgacacgctcgctatccagccatatcgcctggccaggactggctcaacagctccatcctccactgcgtgttcacatatgaccacgttacttgccacccgacagtgtttggcctcagctgtgataccctgaggcagctcagatgcccggcaggtcctgctggtaagagggtagtgctggaccttggtcctgtctggggacccgggctgttgctggtgtggccggcacgggaccgtgggtagcctcgtaaccatcgctggcgagctgcgtcctggtctgtatcgaccgcggctggcctgggcataatgtgcgacgtggctcctccaggctccgtggcgcgcccgatgcccgtgccttcgtgccgatccttcctgggagtctcgtggcctactgaggactctaggcctgtcccatcctgtgcccaggtgtcactgctgagtgtcccttcagcggggctctggtgctcgtccccggctgtttcgccctccagactactgggctctgccccagattcccccccgaggcttctcccattcctggtcccaggctgtactagcgtatccgcacattgatgccttcgccaagccagccccgtgcctggtggatccaccagtcctgtctcctggctgctctgccccttgcccgggggctgggaaacctgggagtgacctgagggagggtccgggttgtgttacaccagcaggcaggtgacgagttcctgtgccggaagaactggccagggagagctgcgcctgtggcatctctgcct

SEQ ID NO: 550873 - DNA, 262 bp, Homo sapiens
gaatggaacaggcaccgaagatcttacactggaggacagaggaatggaacaggcaccgaagatcttacactggaggacagaggaatggaacaggcactgaagatcttacactggaggacagaggaatggaacaggcactgaagatcttacactggaggacagaggaatggaacaggcactgaagatcttacactgaaggacagaggaatggaacaggcactgaagatcttacactggaggacagaggaatggaacaggcact

SEQ ID NO: 550874 - DNA, 386 bp, Homo sapiens
tggccaggctagagtgtagtgcaacgatgagcagctcactgcagcctcgaactcctaggtaccagtgatcctctctcctgcctcagcctccaagggtagctgggactacagtcacccaccatcatgcccagtttattttattatttttttgtagagatggagtttcatattgttgccgaggttggtcttgaactcctggcctcaaatgttcccccaacctaagcctcccaaagagctaggattataggcatgagtcaccatgactggcccacactctttttgaaacccttttggatactacttggatttcctgctgacttctcagagcaggaacgcttagggtggcagagatgataccttcatgcttcgccatggagtaaatggca

SEQ ID NO: 550875 - DNA, 105 bp, Homo sapiens
aatcacgtgcattgtgcatggtgtgtgtgtggtgggtgtgtgcgtgtatatgtgtgtgtgtaccatagtcctccatccctctgcagcagtcggaaggggcatgga

SEQ ID NO: 550876 - DNA, 816 bp, Homo sapiens
tataaaaaaaagttttttattttttataacccggggcccttttggcccgagaaagggggggggggccaggggtgacaggccaaatatgaaccccaattttttggggggtgtattccctccccaatttgtgggtgggtctccgggggccacgaaggtgtgcgcgccgggggggagtgggagggtagacagggtgggaaaaacgagggaagaaaagaccctgtggaggaacccacaaggggccaaaagaaaacggggggttgcgggacacgagggacacggctgacacccagagagaccacgctgtgggtcccccggcggtgagacccaaaacgaggaccatgtgggcaggatgacccacagtgtgaggactgcggggccatacaaaacaagagagggggacaaagggcgattgacgacccccagccgacagatgaacagagcagcagggtgtgatcaaaggaccaggtgggcgaaaaaggaaggaactacacacaagcctcacccagcggaataaaaagtggggccacaccaaagagtggaacacagaagaagggcggggcaccaacgcacgcagaaatacgggggggtgcaccccaacgccaaaggaaaggagtaaccccaaggagggtacctaccgggagaaaagttagttggcgccaacaacagagctgaggatgggctaccagagatgtatgtgaggcgacgcgctacaatgaagtcgaaaaaacgcgagaacggggcggctacaaaaaaaatcccacacaagggggcacaaagtaagcgcgtcacccaagctttgcgtgtcacaacggggca

SEQ ID NO: 550877 - DNA, 202 bp, Homo sapiens
cgctcgcagaaaagatcgtcacatgcacatgaagagataaagacgtgactcaagagaggatcctggcatgggtgtggtggcacatgccatgtaatgccagcactttgggaggccacaggagggtggatcgcctgaagtccggagttcgagaacagccggggccacatggcaaaaccccatctctactacaaaattaaaaatt

SEQ ID NO: 550878 - DNA, 419 bp, Homo sapiens
  misc_feature (146)..(146): n is a, c, g, or t
  misc_feature (177)..(177): n is a, c, g, or t
  misc_feature (217)..(217): n is a, c, g, or t
  misc_feature (219)..(219): n is a, c, g, or t
  misc_feature (236)..(236): n is a, c, g, or t
  misc_feature (238)..(238): n is a, c, g, or t
  misc_feature (245)..(245): n is a, c, g, or t
  misc_feature (258)..(258): n is a, c, g, or t
  misc_feature (283)..(283): n is a, c, g, or t
  misc_feature (305)..(305): n is a, c, g, or t
  misc_feature (321)..(321): n is a, c, g, or t
  misc_feature (337)..(337): n is a, c, g, or t
  misc_feature (377)..(377): n is a, c, g, or t
ctggatcattactagtgccataaccctgcttcttcaacatttcacagaacttctcttttatataaaggcaagagcacaaaatgagttcagatgatcacaaacaggtgagttttgttggagaagaaagttggagtaggagactttcncaagtggtttccatggagatagaatgaagcnttctgtggtcaagtaagtttagggagctattcatgtttcncntgctttgtggagattcncnctatgcnctgggaaagtatntgaaaagtcttataataaagaaacnggcttaactttgtgtaagaacnctgtttatcaatgtcntttggctatagaaacnttttctcctgctgattgtgtgtgtgaaacatgtattaacnttccaatgaactagcctttaataaaaagcacacattttgtga

SEQ ID NO: 550879 - DNA, 162 bp, Homo sapiens
gactctagacggatcccccatcgtgagcctcctgtacatgtaggacagcatctacatccttcttcaggcatcacaaactcattctcagcagtggtacgcttgttgatttcatcctcatacttgttcttgatagtcttccacctaggtcctgctatgtttctc

SEQ ID NO: 550880 - DNA, 92 bp, Homo sapiens
actccccctcctggagcagatcgcgggcgaactgccgctcggcccggaagggggaaatgaaggggaccagggtgatgaggccggcatccacg

SEQ ID NO: 550881 - DNA, 123 bp, Homo sapiens
gcacccatgtctgctctgaaaattcatgatctgtctttggccttggcagacagagcatgaacccatgggataggaatagacattgaagctgactcaacagattacaggaagtgaaagtaagta

SEQ ID NO: 550882 - DNA, 1034 bp, Homo sapiens
tgactgcctgagacaaacctggaccctgcaagcaccatgaacagccacggtcactatccaacacagccaaactaccctgtgcagcctcctgggaatccagtataccctcagaccttgcatcttcgctcaggctccagcctatacctgatgctccagctgcctactcagagctctatacgtcctgagctttgtgcagccagggtgctgccacatgatcccctaccatgtacagcctgcaatttcctggagcctctctgtatcttcccatggcccagtcttgtggctagtacgggccttctcaggttccacaataccccatggcttattatccagtcggtcccatctatccacctggctccacagttgctgtgtggaactggagcggtctgcactgcagcgtgccacgatttcggagctgtcgtgctactcgcttgggccaccattcctacctccacctacctgcacttgccctcccaatgctgactcagcttgccactcctgcactggagcccaacgtcctcgtcaactccagcaggaccggccaacttctccacggcctggaccagcatggtgcctcacacctcaaccgactcaccgccaccacaggccacccttcgccgccggcgaactcccctcaccacacccttgcagccctctcctcacccccgctcacctgctcccctcactctcaaccctgacgcctcgctccaccctaccccacacctctcggaccgccgcacacccgcacccgcgctcccccctgcgtcccaccaccactatctaaacctccacttcacggcaccccactgttacagcgtctcacccgccgtccctcccccatgcagcgcactatccgtcccgcgtccccgagcagcattatcccacatcaccgacctacactacgcggtgaagcctcgccaccgctccccaacacagtcattcccgcccttctatattccacgtttcaccatctatagtccacagtccggtgcccactgcgactttctaccattgatacagtctatacatggagt

SEQ ID NO: 550883 - DNA, 233 bp, Homo sapiens
tcataggttcgcaggagtgcagcctggaaagataaaagacaaaaaaaaaaaaattaacttaaatttacaatgatgcaaatgaccttttttacaaaatagaaatagactcacagacgtaaaaaacaactttatgccaaagatgatagcagggtttaggtggagtgtggggttgggagagaaattaggagttggggattaacatatacacactaccaggcctgcaaacctattaa

SEQ ID NO: 550884 - DNA, 105 bp, Homo sapiens
ggacagtgcacgcaggtcgccgttggaattcatggacgacacgagccgatccatcatccgcaatgtaaaaggcccctgcgcaggcgacgtgctcaccttttgagt

SEQ ID NO: 550885 - DNA, 723 bp, Homo sapiens
ctgcgtggctacgctaaccccttaactcatctccgtctgccgctcccgtgcacacccacggtaggtcctcagcacaggggtgggccttgtaaagtgacaccagcagctgctacagctcccagcctcagcaacagtaaaaaccaaagtcttggaagttccccaaagctcccacacgatcggaccctcaccactcacctgtctctctccatctcctatccagttgcacatacacaaccctgcactgggcctacgcacttaccgtctgcactgcctggaaggctcttcctcccctcccccatggcaccctcgaacacccccccacacaccagcacacacacacaggcttacatgctcacacagacacacagatacacaaggctctgcccttcactctgcgcccaacccataaccgctcaggcccttctcgggccatcgcccctgtgctcctgagcctgaggtccgcccttcctctcagtgacccggggcgcgagcccacgcctcaccagagcgtcgtgtgcaccccgtggaatgcggatcgactagtggatcagcgtggggatgtggcgcgacagggatacactactgcctgaacgactcgtggcggaccctgacatgtcaaccctgcatcccaggacgccaaggatacttgacacgatcacgatagatgtaacccacatgacgaaacatgaaagctctcaaagatcttccaaaacaacatctcca

SEQ ID NO: 550886 - DNA, 106 bp, Homo sapiens
gggtaggacagaagattcatagagatatgaagatgggatggaggtggatacacaccaacagttgctggacagtttgaggatgcagatgttgatcactgaaaatgat

SEQ ID NO: 550887 - DNA, 406 bp, Homo sapiens
  misc_feature (6)..(6): n is a, c, g, or t
  misc_feature (31)..(31): n is a, c, g, or t
  misc_feature (44)..(44): n is a, c, g, or t
  misc_feature (91)..(91): n is a, c, g, or t
  misc_feature (129)..(129): n is a, c, g, or t
  misc_feature (167)..(167): n is a, c, g, or t
  misc_feature (187)..(187): n is a, c, g, or t
  misc_feature (238)..(238): n is a, c, g, or t
  misc_feature (311)..(311): n is a, c, g, or t
  misc_feature (351)..(351): n is a, c, g, or t
gcatgnaatgcatacaaaactgcaatatagnagacaatgtttgntaatgaattgttctattaacaaaggaggaggttctaagatataaagncctcagagaacaggaagtaaaaggtcgggtccataagnaagtatgaggttctaaccgggtaagatgctgtctgagnaaggtcagagacagtatgtnggaagtaaatctatcacccaggtcatgtgcactgaatgttccactgaagtngtcagtctacgacaaggatgaagtctttcattttttcaatgttttagcaagccattcctaaacagcccaactngcatttaattacccaatactgtatataaggcaaatatggncagttactttcctcttgcctgttcatatccttcagtgacattgtggaagcagtgt

SEQ ID NO: 550888 - DNA, 454 bp, Homo sapiens
gctgggcacggtggctcactcctgtattcccagcacttgggagactgaggctggtggatgacgaggtcgggagttgagaccagcttgaccaacatggtgaaatcccgtctctactaaaaatacaaaaattagctgggtgtggcagtgcacacctgtaatcccggctactcaggaggctgaggcgggagaatcgcttgaacctgggaggcggaggttgcagtgagccaagatcacgtcactgcactccagcctgggcgacagagcaagcctccatctcaaaaaaaaaaggaaaaaagaacttcaaattaatacatatctaggaggattaaaaagctcaaatggcttttcacttttttctggacttattttaccccactctgaaatgtggtggtcatgggaaacagacttcaaaaaagccaaaagaaaagacagaaaagaaaaacaacaaaaacat

SEQ ID NO: 550889 - DNA, 753 bp, Homo sapiens
  misc_feature (268)..(268): n is a, c, g, or t
ggcgggaggctggagtagagggaagcctgcaaccggaagtgaaggcgcattgtccctccttcgtcagctgttgcgtgccgcgcatacgcgctctccctggtgtagcgtcttctgttagaaatagtatcttaggttttcctttgctgtgcgtcaactcctccatactcgttcaccgcctggtatttcaccgtatgttggcggaggaagcccagtccagatcccgccttcctcttcttcgcccatgcacggcccagattatggcgagagnaacgagtgtggagcaagtgagctcttggactatggaacgtatgactgacggtgtgagacagacagtcgtgggaggagtactgggcgctcgaggcctcctgccagcgaagcggtgtcgataggggcctcgctatgtctccactccagcatgctctggcgttgcgctgactgtcctgctacaggccagagtagctccggggccatctgtctacatggttgggccgtacgcagcatccagtcagaagctctcgatgcagtggagtgctatcaccgtcagtgcctagtcctggcgtaatggatgtcctgtgaccaaggtgcaaagttcggggctagtgggtaataggacgagagggggtcagtcattgggcagcacttgtcatacagacgtggatacgacgtttacttgggcagggtgttctgtgtttggtgacttggtgtatagggactcgagaggtaggggagtacagactcagacatgaggaattt

SEQ ID NO: 550890 - DNA, 856 bp, Homo sapiens
  misc_feature (363)..(363): n is a, c, g, or t
taaattttaaaaaaaccttttttgacggggggggggttaaggattcaagggtggggatgggcccaggggggagaaacagatgtgggacgacgctcagtagggcctgtctggaaactggctcgctggggggtacccaccgtggcgctattgtacgccctcgtttttggcgggtagcctgactctatcgggtctcgagaatgtagcccccgtagtgtcgcccggatttggtgggtcaaaaacacccgtgttcgagtggttcctcacacccaaggtgccgtcgccccaaagttatcatcggggccacagtttgcagagacgccaaagtgtctcttcgttggggacgcaaagtggggagcactacanaggagcggggaagaaattccaccacgtgggatccagtagaatggcgaagtggcaccccagggggaaagggcacacatagaggcctcccctcaatatatagaagtgacatcaaattatgtggccgtaagaaaagacaggagaacggctgccaccaggtgcggaccaaaaatctcgcagagcgctacagaagcaacgtgcttcatagcaacagaggggcatactcaccgaggtggcaggaggagagcagcctactagtaaacagacccacacgtagccacttgaacgagagtgtgagacaaggagagcggcaaggaggctcccacaacaagggtgaaaagcatcctcaccccgggaggagacatactactaccaaaaaaacacgcagcaacagatggggcaggcgaaacacactgtgtggacagacacccccacgcggggagagaaaaaaagaagggtctccccacaaaaaatattttacccaccacatttagca

SEQ ID NO: 550891 - DNA, 122 bp, Homo sapiens
gttttgaaacggctctccaacctgtgggtgccctcagtctactgctccagtcttgctgcagcaaccatcgaccgcttcaaccctgaggattcttccacctaccagtccaccacgagacagtg

SEQ ID NO: 550892 - DNA, 823 bp, Homo sapiens
tggggggggcgggagtcacattgtggggcccccaaatagctttgctcccacggggagagagggttgtgtggtgacgacagagacaacacaggtgctctttatgtggggtcccacacgtcccctttgggcccgcgtgttgccccctccaccacaatttgtcgcgcggtttcgactcccaaaacagcgttgtttttgtctttctcaacacaccgttggtggggttgtctccctgttgtctcccctctcacaggctcccaataagtggtctctgcgtgagattttcccagacggtctccacttggggtgttttcgtcgccctctggcacacacaagcggtgtgttcgtttgtttttggtgtcgtgtgaagggtctgtgtggggacgagcttctacgtgtgcacgcggagatatcacgtcgggtcctctgtgggtcttctggaggaacgcggagaacacatgtgtgtcccgagccgccggtctcacatctcccgtctcgtctccttctccttatggagatgtcacataaaccctaccccttggtctttttttttttgtaaatatttcttttccccggtgagagtgagcttctttgggacacataaaaggataacttgtgaaaatataatatgtgatagcatagtataggagaagaccaagagttctcctagatgtttgtgatcttcgttgtgatagactgccctagagtgtcccacccaggaagacccctttattttggtttttgggacatttttaatgggtgacaagaagtgagccaattaagtggaggaagaaatctatatatgagataatatagattgtattga

SEQ ID NO: 550893 - DNA, 307 bp, Homo sapiens
atcgagctcggtaccagtgctactccacaaacagcacacatcattgccacatacaggtcacaccacacgtactctccactcacaaacgccattgcatatttgcagacaggcaacacgaactcgcacacagtacacaccagacatacatggcagacacaatacacacgtactacacgaacacaccacatacagcaccatgtatgccacagacacacctccagacacacacatacacaccagatacacaccacatacacacacatacacacacatacatacacaccacacacattccactggctataca

SEQ ID NO: 550894 - DNA, 269 bp, Homo sapiens
ccccctaaaaaaggggttttttttcaagggtttaaaaaattttaaacttttggtgaggggcacaacagggttcctttccctgtttttttaaaaggggggtttaaaaaaaccaaaaaaagggggaaaaccatcctttaaaaccaaacaaaaaaacccttccccccccccctcctttaaaatgccccctttggccccggggggggggccccagaaatttttttgggcaatggcccccgttgtttttaaaaaaaaaaccccattttaaatta

SEQ ID NO: 550895 - DNA, 218 bp, Homo sapiens
aagtgcagcacatgccttctaaagaagccaggcatggaacagttctgggaacacagcactgataaaactcttagggatgaatttacctatacctgtgtttcagccttgtgatctgggtttggcacgatgaaatgctactttcagaaagatgagtatgtcagaatccctggtgatttctaacgcttatggaacacatcacataggagcaatttagatga

SEQ ID NO: 550896 - DNA, 345 bp, Homo sapiens
tcgaatacgacggtttctcaatcgccgtgtcctggcatttatgcttgattctgggagcatggacaatagccaagaagtctcttgcctgcaggtatcccgtgacagaaagggaagagggggtggggataggaaagtaggggttccttgtgtgctcttgctacaacttgcaagatttcacctctcccctagatggagctgctagggaaacagcttgcagaaagtaaaatgggaagtctggcatggtggctcatgcctgtaatcccagcactttgggagggtgaggccggcggatcacctgaggtcaggagttcgagaccagccaggacagggtgagatgctgtctcc

SEQ ID NO: 550897 - DNA, 1484 bp, Homo sapiens
actgctgagaatgaagactattctcagcaatcagactgtctgacattccatgaaaatgtcgacattactctgacagtggacgcacagttatcgtgaagtggccccagactggaaccccatgtggatgtgtgacctatcacagtcacatttcaactgtacgacactacactgcctatctgtgggaaccgacaaacaacaatgacgtgctcctgtggtctgaccaaattggtttgggtgtacaccactgaacagggacacccttggcctaccccggtatccgcgacctactctcttgcaaggtacactggtaccaggaccaccactggactcaactggcgttgattaccgacttgtggccttcccgggtttaccaacgcaactgacgggttctgggtgtactttgacttcaacctttatcacacgctatttcaacacaggtcggactttacttcccaaggtgaggacaacttgtggcttcctccattgtgcgtagtgacacacatccccggcaaaattttcattttgacgacgctggacacagcaatgtacccatttctcaggcatggcgcttccggggaaatcgactggacaccccactgcgcattgagtctggcactatatggatataccaccgcttcattccataccaaaatggaccaccactggcaaatatcgtactcgacgatattcacattccccagtttgcacatatctggcacaccgtggaatcccgttctcggaccgccctcttgtatctcactcacaacaacttatccacgccgtgagcccttcactggcccgtatcaccaacgccacaacacaggcccacaaccacaacccagggtccaaacgcccaccgccaacagggggacactaatccaagcggaaccgaaccagcaacggggcccactgcgccacactcgtacaacggctcccgctcaatcggaaccacaacacggtggcaaaacattgagcacccacggccacgctccccctggcactgaccagtcaaccgtcacactcaccaaacgctgcaacgtgattataccccctgtgggtcccgcaaccaacggacacgccgacaccggtactgggccgcacgagaattgtcacaccacgatgaagagcacacgcatcaacgtcaggctggcaacacctctaccacaacctggcacggcaccagaccaaacaaagaagacacccataaataggaccctagcggccaacaacccagcgcaaacaacaacacaaacacaccacgacacacaacgaaccaacacacactagcgagattactggaccgaccaccacgaccaggcacacacaccgcgacgagcaaaacacgaccacaccaatgactccacccacatcgacagaccagaccggagacacgaccgacaccacacagagcgagcagacgagaacacacagcatgcaccaagacagacgaccaacccgacaagacacaccacacgagacaacaa

SEQ ID NO: 550898 - DNA, 122 bp, Homo sapiens
ggccattccagtgccatctgtgcgatcgtgccttctcgcgctccgtatcacctgggcgctgcacatgaaacgggcacatattagccgggacggcccccgcccacctgcggcgcgggccttag

SEQ ID NO: 550899 - DNA, 158 bp, Homo sapiens
gaatgtcgggctcaggcacacctccagaaggcccactcctgccctcttaatcatggactcaggtggtgtggactcaggtggtgtgcacaccacctgagtcctcccagtggcagattgtttcttagcctccctggatctcccagttaatttcctttgtt

SEQ ID NO: 550900 - DNA, 622 bp, Homo sapiens
  misc_feature (20)..(20): n is a, c, g, or t
  misc_feature (43)..(43): n is a, c, g, or t
  misc_feature (51)..(51): n is a, c, g, or t
  misc_feature (80)..(80): n is a, c, g, or t
  misc_feature (108)..(108): n is a, c, g, or t
  misc_feature (122)..(122): n is a, c, g, or t
  misc_feature (229)..(229): n is a, c, g, or t
  misc_feature (272)..(272): n is a, c, g, or t
  misc_feature (343)..(344): n is a, c, g, or t
  misc_feature (568)..(568): n is a, c, g, or t
  misc_feature (607)..(607): n is a, c, g, or t
  misc_feature (611)..(611): n is a, c, g, or t
accaccttaaaaatggtccnattagttccggacatgtttaagngcctctgngggaatggagcctccaaaccacggacacnaaatgtcatctttgccacacggaaccanattttaaggtttanctgaagcccatcaagctttttcttgaattccatgcaggagtatttttaattaccatttaaaacatggcattattttaaaaagtaatctatgtttttaatttaaaagncttacttatgctttacccatggtagagagtacaacttaaggangttttcttaacttgcctccctctttctttttcctaccccttacctaaatcataggctattaaaatgaaatnntgggccgggcgcggtatctcacgcctgtaatctcagcactttgggaggccgaggcaggaggatcacctgaggtcaggagtttgagaccagcctgaccaacgtggagaaaccccatctctgctaaaaatacaaaaattagcctggcgagttggtgcatgcctataatcccagctactcgggaggctgaggcaggaaaatcgcttgaacctgggaggtggagattngctgtgcaccattgcactccagcctgggtgacaagagtnaagntccgtctcaaa

SEQ ID NO: 550901 - DNA, 252 bp, Homo sapiens
  misc_feature (27)..(27): n is a, c, g, or t
ttgcgcagctgacatgccgccctgtgncctcggtgcaggaggaactggccaaggcagcagccaggtcgacctgctcaaggacattctgctgccgccaggccccggcgtgagcacgaagcctgcattgtcgcggacaccccgtcgccgccggccaaccgagccggtgcgcctgcctgagagcccggcgcccagactcgatgaggcgctcgcttgtgacacatgcgatggtggctgcgcttgctgatcgctgtc

SEQ ID NO: 550902 - DNA, 266 bp, Homo sapiens
  misc_feature (82)..(82): n is a, c, g, or t
  misc_feature (104)..(104): n is a, c, g, or t
  misc_feature (108)..(108): n is a, c, g, or t
  misc_feature (137)..(138): n is a, c, g, or t
  misc_feature (156)..(156): n is a, c, g, or t
aaaaatgttgtgcatttctttgtgcttggataataaggaagttaaccataaataccactataatggtcgacgtataggtgantcaaagaattaaatgtgggcancctnatcgaattactactgggaatccagtcaanngctgtcagctgagttgcnaagggtctagtttcaactcaggtgctcatgtgttccctgggctgaatggtgagcacaaaacagagcaacatcaattccagggcatcctgactatgggttcctccagctca

SEQ ID NO: 550903 - DNA, 828 bp, Homo sapiens
taattccggtccagtctaacccttttggtagtcactcataggccaaactaagggctaggatgatgattaataaaagggattgacataacttattaggtggcgaggtttagtgtgttgtgaagggctctcagtggtaggggtataaaagggagggcaaatttctagaactcaaataataagaagaggtaatagctacttaagaaagaaatttatagtggagagaaaaggggaccgcgggcgcgggggagatatattaggggctcagaacgccccgcaccctccgataagggggggtgagatattttctctatatgtgttacgcccagttgagagtgtgtggtggatacgctcaaaatgtgtttatatatattatattatagagatgagtatagaggtgcatagagagaagggggtgtgtgtgcatattattataaccaatttgtgagagcgtgctccgagagagcacagagagtctcgagccacacgcctagatgacacgcgagagcgcgccgcgcgcgttctccccccctttctttcgcgcactcgcgtgggcgggggcgctcccccccacgtgctgtgggtgagcacccccctttctcgcggcgcgagcagctgtgggtataccccccgcgctatattaatgagcgccgggccctctcttcttctcgacaccacgaagagcgcccctctctcgggggggcctgtgccccccgccgggtgatgtgcgcccgggagaggagaagagtgtggggtctccggcccaagaggtggggtttataaggggcgcgggtcaaacgcccaaggcgtgtgtgtaccccgcggggtgtc

SEQ ID NO: 550904 - DNA, 2218 bp, Homo sapiens
ttcagcaaaaaattaaacgatttaaggcaaagcagggccagaacaagttcctttcagagattgaggatgagctttttaatccagattatgtggaggttgaccggataatggactttgcacgtagcacagatgaccggggagagcctgtgactcactatctggtgaagtggtgttcacttccttatgaaggcagcacgtgggagcggaggcaggacatagatcaagcaaagatcgaggagtttgagaaactaatgtccagggagccggaaacagagcgtgtggagcgacctcctgctgatgattggaagaaatcggagagttccagggagtataaaaacaataacaaactcagggaataccagttggagggagtaaactggctacttttcaattggtacaacatgcgaaactgcattttagcagatgaaatgggtttgggaaaaactatccagtccattacatttctctatgagatatatttgaaaggaatccatggcccttttttagtaattgccccattgtccacaatccccaactgggaaagggaattccgaacctggacagagttgaacgtggttgtgtatcatgggagtcaagctagtcgtcggaccattcagttgtatgaaatgtacttcaaagatccccagggtcgagtgataaaggggtcctataagtttcatgccatcatcactacatttgagatgattttgactgattgtcctgagctgcggaatattccatggcgctgtgtagtcattgatgaagcccacaggctgaagaacaggaactgcaagctgttggagggactcaagatgatggacttggtcagtgaccatattggtgattgcactgaacctgaatagaattgttgctgacttgatagtcccgttgctcagaatttgatgcctgtaaacagtatttgaaaagcttgtcaaatattgtgatatattctctggcactttcagttattcaaaagttgttgccttttggattcttacattgttggctagtgtctgttaaacagttgtattatagcagagtgtaatcatgatagtttcactaaagtgagtttcaagtatttgttttaccctttgttcataaatacaggttgatcataccaaatacaaaaatcccagaatccaaaacgttttgagtacccacataatgctaaaaggaaatgctcattggagcattttggattttggattttctcatttgggatgttcaacccgtaagtataaatgcagatattccaaaatctaaaaatatctgaaatctgaaacactctggtcccaagaattttggataagggatacttaacctgtactgccatttcattaactgttgggccaagctttacttcagtgatgatagtccagttatttttcagtgctcataggttttgccatactgtggccagcaggacttgtagatgcaagttctcaatgagttgggtaggatatctggggttggtttagttcgcacagatgcttagaagtttggggcattacagtgcctcagatttgatctggagttttacaccacacttatcccatagtcttccagcttcccaagagatgatcaggtcttcctgattagattttctagatttttttttcagcaggagcatcatggaataacatatcgtaggagtagaaggatttgatttattttctgtctgatactgctgtgtgtgatttcctagtgggaattgcaacatgacctgtcatcctcaggcttcttttcactccatagtttatatagtggttatgatcacttatattttatttttaatgtacatttggaaagcaaagctcctgtcatttagcatgccttggatgatttgatgagtttcacggaagtacaaaaagggtttcaaagtatttttaatgctaatttctgcaggctaatttgatcttttgttaactgagagtttgagatgagaaggagtgttctgtatattcatggccatatgtttttagctgaagactggtattaccaaaaaacacctaaaagctttttgttgcagctgattctctgaaagagcagcttattttattcttaaagagattagaattgccagctatgcttttagtttaaaacaacaaatctagttttgcttaaaggaaaaagtctgactgaattatcctatttagggtgggatttcccatttttcttcctaatgaattattattaaagcgatcctaagatctgtctc

SEQ ID NO: 550905 - DNA, 765 bp, Homo sapiens
  misc_feature (51)..(51): n is a, c, g, or t
  misc_feature (62)..(62): n is a, c, g, or t
  misc_feature (100)..(100): n is a, c, g, or t
  misc_feature (138)..(138): n is a, c, g, or t
  misc_feature (142)..(142): n is a, c, g, or t
  misc_feature (157)..(157): n is a, c, g, or t
  misc_feature (191)..(191): n is a, c, g, or t
  misc_feature (193)..(193): n is a, c, g, or t
  misc_feature (199)..(199): n is a, c, g, or t
  misc_feature (205)..(205): n is a, c, g, or t
  misc_feature (252)..(252): n is a, c, g, or t
  misc_feature (275)..(275): n is a, c, g, or t
  misc_feature (289)..(289): n is a, c, g, or t
  misc_feature (296)..(296): n is a, c, g, or t
  misc_feature (305)..(305): n is a, c, g, or t
  misc_feature (321)..(321): n is a, c, g, or t
  misc_feature (375)..(375): n is a, c, g, or t
  misc_feature (409)..(409): n is a, c, g, or t
  misc_feature (423)..(423): n is a, c, g, or t
  misc_feature (442)..(442): n is a, c, g, or t
  misc_feature (445)..(445): n is a, c, g, or t
  misc_feature (448)..(448): n is a, c, g, or t
  misc_feature (450)..(450): n is a, c, g, or t
  misc_feature (511)..(511): n is a, c, g, or t
  misc_feature (540)..(540): n is a, c, g, or t
  misc_feature (545)..(545): n is a, c, g, or t
  misc_feature (548)..(548): n is a, c, g, or t
  misc_feature (712)..(712): n is a, c, g, or t
gggggggggggggttcaaaggggggagggggacttatggggggtatcgggngattcttagtnggcacaaatgccctgcctagcccccttaactgcgtcanttcacagatggggggtttggtggggggggtggtgaggnggcnggattgccttacacnggggaggaaagaccagcttgagtgaaagtccgcngngttttngatttngtggggatgggggttttaatgcaacaaccagcccacagtttccaagnggaaaaatattcagtagcatcangtacttgtactatnggtaggngcttaaaangaccatcatcaatcanggcatccacaaataagccacctgacacattaattaattcattccatcaaaagancttaaactagagaattaagcccactttatgaagngcgatttcacggcngcttgaaccattcgaattnggnttngngttcagcactttaaaaggttcaactttttgcttctacccagattggcctcaggcctgtctnctcatccatccctttctaaagccaaagcncattngtngcacataatccaggagaagcagaagtaaatgctatgactggtggtatttcttagcctggttttgtagtttttaggcagtaagtagattatgagcgaacaaatgtgaaggttcatgtggagtcataatacctgtgatctaggtatggtcttagtcaagctcaganacaacaaagccttctaggtcattaggcaatggtgggtttctagcaccatagac

SEQ ID NO: 550906 - DNA, 1212 bp, Homo sapiens
  misc_feature (1029)..(1029): n is a, c, g, or t
  misc_feature (1042)..(1042): n is a, c, g, or t
ttcagcaaaaaattaaacgatttaaggcaaagcagggccagaacaagttcctttcagagattgaggatgagctttttaatccagattatgtggaggttgaccggataatggactttgcacgtagcacagatgaccggggagagcctgtgactcactatctggtgaagtggtgttcacttccttatgaaggcagcacgtgggagcggaggcaggacatagatcaagcaaagatcgaggagtttgagaaactaatgtccagggagccggaaacagagcgtgtggagcgacctcctgctgatgattggaagaaatcggagagttccagggagtataaaaacaataacaaactcagggaataccagttggagggagtaaactggctacttttcaattggtacaacatgcgaaactgcattttagcagatgaaatgggtttgggaaaaactatccagtccattacatttctctatgagatatatttgaaaggaatccatggcccttttttagtaattgccccattgtccacaatccccaactgggaaagggaattccgaacctggacagagttgaacgtggttgtgtatcatgggagtcaagctagtcgtcggaccattcagttgtatgaaatgtacttcaaagatccccagggtcgagtgataaaggggtcctataagtttcatgccatcatcactacatttgagatgattttgactgattgtcctgagctgcggaatattccatggcgctgtgtagtcattgatgaagcccacaggctgaagaacaggaactgcaagctgttggagggactcaagatgatggacttggaacacaaagtgctgctgacgggaaccccactccagaacactgtggaagaactcttcagcttgcttcatttcttggaaccaagtcgcttcccttcagaaaccacatttatgcaagaatttggtgatctaaaaacagaagagcaggtgcaaaaacttcaagctattctaaagccaatgatgttgagacgtctcaaagaggatgtanaaaagaacttggnccccaaagaagaaactattattgaagttgagctaacaaacattcagaagaaatattaccgagccatccttgagaagaatttcacatttctttccaaaggcggtggtcaagctaacgtacctaacctattaaacactatgatggaattgcggaagtgctgcaatcatccgt

SEQ ID NO: 550907 - DNA, 214 bp, Homo sapiens
cctgctgctgcggtgttctacgacggactccccacaacggtgtggtggcacggtgcgtaatcccagctactcaggaggctgaggcaggagaatagcttgaaactgggaggtggacggtgctttttttttttttttttttttttttttttttttttttttttttttttttttttttttttttttttttttttttttttttttttgtattgtttta

SEQ ID NO: 550908 - DNA, 133 bp, Homo sapiens
tgccgcttgtggagggcagctgtggttctaggtgcctgagtagctccttgaccctccccagtgcctctcctggccctgcgggtgccactccatgtgcccaccagccttgttcctaataaaattaatgttgtct

SEQ ID NO: 550909 - DNA, 219 bp, Homo sapiens
  misc_feature (187)..(187): n is a, c, g, or t
cattgaggatcccagctcggtgtcgctggcagcctcgcttcgctgcgcaggtcacccatgtctgctccagccgagaaatctggggaggcaaactgtgagagaccagccaggcagagggcctgcaggggcaccctgctgccctgctgagtggacacccatgatgtgggatcgttattattattatggncatccttcatgtaccagcgacagggaggctgg

SEQ ID NO: 550910 - DNA, 165 bp, Homo sapiens
cggtgcacgctgatgctgcggtcggtctccaggatccccgtggggcagcgcaccgtgtaaaccttgtagaagttgaacaccaggtccagttcacagacacttgtggaaatattcgtttaagacctccacgaattgttgtgaagtggcctccaggctaagacaggt

SEQ ID NO: 550911 - DNA, 1639 bp, Homo sapiens
  misc_feature (829)..(829): n is a, c, g, or t
cggtgacaagtgcctgttcgtactgggtatctcacgagtctccgccagcactgagccggcaccacgacaggctacagagcagcggagctgtgacgcgcacacattacacatcaggcaatgcgggcgttttggccgcgctagctgtgtgcctccagcgtaggccagcttgcagtccagcaagcgtctgaaccgaagtctgcctgtgacaccattggtgcgggcgtcccgggagccgtcatcgcaggctggatcgcggtctcgctctgtgtctcgcagggccactacgactttgagagcttatcgtcttgtggttttgccgcggagctgctcgtgctgcccacgcggaccgactgcgcatgcagggcgtagctaggacacgacgcacctacgatgcacagtacagtccacatgcctctcttactatactagaagcgccctgtactggagctctgcctgtgcgacttcatccgtagacactagatcgcaatggtcccctgatacaccactatgtagcgcctcttctcgcgaggccccaaggggatgccctggacaagaggcccatcgtatatggctccacgtgcaggcgcataggggagctttggcctcatgagcggagattgagcgtcctcgcgccgacagccacacggtgtcccgatcatttgcccgcgcgcgcgaagtgggttcgccggacgagttcgcgcccgttcaagcggaattgcgttgtaggtaccgttcgtatcccgcgcttctagttggcgcatatccaaggagggagtcttccattacgtacctcgggggacccccacgaagaaggaaggcgacctaaggnctatgaaaggccgaggccctcctctacggataacaggcacaagcgctccattcgaagggtacagggtcgtatcgagagaaaacattccaccccctcccagtagagagcaactttatggggggaccaagatgtctgtgccgattatgggagcaccggcacgcgtgaggttcgccaagtgttcacttattaccacacggacatagagaaaaacgcttattgtacgccaacgatatccttgcgcaagcgaaattgagaagcggcttataattggccgcagacaggggcgcacaacagcgcggacacagggggggatatcctataccatattgggcgcacattataaccctgttggttccaaagcaagcgggcccattataccccgctatatgtggaatgagccccaagacgaattgtgttccccgaccatttatgagccccgtggatagtaagcttcttgccccttatatgaggagaaaatttctctcccatccgctttttttcggcgtcaagtagaagggccccccgctgttgagaagcgatctgagtaccacacgtcggttaaagacggcgggccccaaacacaagcgctgctttgttttattaacctcatccagatgaggccgccttcataatgacacgtgagggtggcgagcgcagtcacacatccctgtgtggacgcgcgctgagaatggagcgaccccgacgacactccacgctcaggcgggcagacagacagcggtctgtccacgtcatccgcaggagagaagatcacacagtctcgcagcgattgaagtcacgaccccatcagcg

SEQ ID NO: 550912 - DNA, 340 bp, Homo sapiens
aggaacgtcacttgggtctttcatcagaacatgttccaagatttctgacattcctttttccgaactttcgattttggtgcctttggattttcttggtagtagaaggtctttaacatttccactggttcctcaggccgatattcaaggatacacttaaatggtctccccatgtttggtaagtcagcagaggcaatatttagaacaggaggcacaaccaccaaatcgttcattctgacaggcatatacaacccgggggattttcatcaggcggaagagcagctgcacacataatggcacgggtccccaggtgacgttcctcatcccagtgacgttcctccat

SEQ ID NO: 550913 - DNA, 132 bp, Homo sapiens
caacagagccattaatcttgtatgcgttcatcaacattaactggctttgctttcatgacagctgctgaggaatcttcttaagattactgagtcactggtcttggcttaagtttttagccttaaagttttttt

SEQ ID NO: 550914 - DNA, 338 bp, Homo sapiens
  misc_feature (34)..(34): n is a, c, g, or t
  misc_feature (121)..(121): n is a, c, g, or t
  misc_feature (160)..(160): n is a, c, g, or t
  misc_feature (264)..(264): n is a, c, g, or t
  misc_feature (302)..(302): n is a, c, g, or t
gagatgaagtcgccctatcgcccaggctggagtncagtggcacaatcttggctcactgaaacctacgtctcctgggttcaagtgattcttgtacctcagcctcctgagtagctgggatttnagttttgccccaccacacccaactaatttttgaattttnagtggagacagggtgtcaccatgttgcccagggtggtcttgaactcctgaagtgctgggattacaagcatgagccaacatgcccagcctgtatatatatataanttttttattctgcattcttcgcttgacatttttaaggnagtattttctcgtgtcatttagggattctaggaaaa

SEQ ID NO: 550915 - DNA, 643 bp, Homo sapiens
  misc_feature (627)..(627): n is a, c, g, or t
tcatcttgggcctgtgttatcgagggtgacgatagccggtacggccatgatcccgatggcgccaccaagagctccaccgatgagcttgcgccgggaaagtctggactgctccgcgccgatacgccactgcttggcgagttcctcacgatcagcggcatcagaattgaccggatgccgctcctggatgatctcttcgtcacccataatctgtttggcccagtggatgcacgcgatgccgatgaatagcacagcgagccctgcgcacagccccagtgcgaaggtagcgacgggttcccggtccaggcttgggacctaggtcagcgagggtgacgatagccggtacggccatgatcccgatggcgccaccaagagctccaccgatgagcttgcgccgggaaagtctggactgctccgcgccgatacgccactgcttggcgaattcctcacgatcagcggcatcagaattgaccggatgccgctctggatgatctcttcgtcacccataatctgtttggcccaatggatgcacgcgatgcccgatgaatagcacaagcgagcccttgcgcacaagccccagtgcgaaaggtagataacacaaggcccatcattcttggggcctgtggttantaaatggggtgctttt

SEQ ID NO: 550916 - DNA, 223 bp, Homo sapiens
taagctgtatcccggcacttagggaagctgagtgggtgaatcacctgaggtcaggagatcgagactagcctgaccaacatggagaaaccctgtctctactaaaaatacaaacttagctgggtgtggtggcatatgcccgtaatcccagctactcgggaggctgaggtaggagaactgcttgaacctgggacacagcgaggtgaaatcgcgccatttcactccg

SEQ ID NO: 550917 - DNA, 230 bp, Homo sapiens
cggacggcgagttgtactaggaaggactgatccgtacactgttgtagtgagttgtatgcggtgcgggactggtatgagccacgggtctgtacactcacggccctgtcaacggcggggcttcccaccttgaggccatcaacaatcttctgtgcccgggctgggagtgactgatggcacaacaccacaagtggagccacatcattctacgaagccatgtgtgctgtgactgt

SEQ ID NO: 550918 - DNA, 909 bp, Homo sapiens
tctttccttaatgacgataatgatcatagttctctcgattcacttgatttctaagtatatctttcatgcatggacagctattttcaacctatgatgtacagtgactgtgtaaaattatgtctttcagtggctacctctatagtctttaaaatatgttgagcatctgtggtctgttgcgaaggggatatgacaggggttaaatctatcgagatggaagatcctgttacagaagttgaaaagcttgtggtaattactcagtgtgtgtggtgtatccttttttgcttttctcccttggtctatagtgaaattgttacagcagtgcaaagtaagatcgtatgtataaaagtgtctgtagtgtattatgaccacctgttattccaatgtacttttcagtccactaacagctgatgcatgggtttcagcatgttttggaagaagggtcagaatggttggcattcaaccctgttttaaaaagttgggtaaagatgcgagaagtctcagcatactgaaatattttgttgatggtgtagcagtgtagcatgtgttttctcctgaattagacagcaaaagcagtatatgcctgaagacgggcatatggagttcctagtctgactctaagtactttcattgcgtccatgggcttcaagtttctacaggtctcccggagattcagcaggactctcctgaaggttgaccgtaccttgtgggaagacccaagcggcataggggcaacggtccttagggcaagggcaggggagacgcaacactggtcaagagatgggcgcacccaaggtaacggggtaaaaacgggcgcacacgcgttacacggaacacagacagagatgccacaaagagaatgaagagcaccgaacaaaagaccacaacatatagaggccaacagattcacaa

SEQ ID NO: 550919 - DNA, 128 bp, Homo sapiens
aaacctgtctttgttccggatctgctcctctgacagctgtacttcgatgaaggactggccctggtggaagctttttaccacagagaggctcctcatcgaagtacagctgtcagaggagcagatccgga

SEQ ID NO: 550920 - DNA, 309 bp, Homo sapiens
acacggtcgctctacacggatccctgtcggacttcaccggcttgtaactactgttcttactgctcataaaacagctaaatactgtggtgtaacaactaaactgtgtgcccagagaaaagcctcagcatgttatcctacggtgaaactctgttcacgtgaacagaccagatcacacgctaccagtgaccatttctgccactgttaccacgtttcttaccaaagtgacgacacagtggctgtctaaaactcacgaccaacacggcctggctgtgtgtggctccaccgtgtataactcactgagcacctttg

SEQ ID NO: 550921 - DNA, 821 bp, Homo sapiens
ctccccgctgccaaaaaaaaaaaaggaaacgtttatcatgaactcaacagggtttcagtcctttatcaaagagagatgtggaaagagctaaagaaaccacccttttgttcccaactccacttttacccatattttatgcaacacaaacactgtcctttggggtccctttcttacaggtggacctcttgagaaagaattatcgtatttccacgtttttagcccttcaggtttcccaagataacttattttgtattttattaacctttattatggctatatcttgggtggataatacatttcaggtggtgctgggtgaatttattatacatctgaacctaggtatttccttgggtcttccacagtcattgttgaggtgggctccctggtatggtaaaaagccaggtattaatgtaactttcaccccagcctttgtactaagctcttgatagtggatatactcttttaagttttagccccaatatagggtactggaaattttcctgccctctgggtttccccattttacctatttaagaagaccagtgatacctttaataattgccaccaattctggcttagttaagtgagagttgtgacctggtgtggcaagagagccttcaacctcactaggttgcagagagccccaggccttattgttaaaatcatgcccttgaaaagcaaacctttagtcttgcaagaccagcagcaagcatttataccgtcatcttggattgatcccctttgaaaatctttatagggtcgctgggtttacaactcaaagcctgaggctggtgcaaccgttagctataaccaatattggg

SEQ ID NO: 550922 - DNA, 384 bp, Homo sapiens
tcctactgtgttcatcaatgaataatggataataaaatatgctatatacatcaactgaatattactcagcctcaaacaggagaaaaattctgaatatgggtgaaccttcaagacatcatgccaggtgaaatatgccagtcacaaaagcacacatactgcatagttccacttacatgaggaacctaaggtgtagtcaaactcacagagaccgaaaatagactggtgattactgggggctaggagagtagatgaataaagagttccgtttaatgggtaaagggagtttcagtttgggaagatgaaaaaaattctggaaacatggtatttggtgatggttgaaaaacaatgtgaatatacttaatgtcactgaactatacaattaaa

SEQ ID NO: 550923 - DNA, 822 bp, Homo sapiens
  misc_feature (226)..(226): n is a, c, g, or t
  misc_feature (228)..(228): n is a, c, g, or t
  misc_feature (327)..(327): n is a, c, g, or t
  misc_feature (396)..(396): n is a, c, g, or t
  misc_feature (421)..(421): n is a, c, g, or t
  misc_feature (593)..(593): n is a, c, g, or t
  misc_feature (665)..(665): n is a, c, g, or t
  misc_feature (752)..(752): n is a, c, g, or t
  misc_feature (809)..(809): n is a, c, g, or t
gaggcgccttgggaccgcgtgggagccgcagccgaaccgagtagggaccgggaccgcgcggcgccgccgtccccggccgggcccggcccccgcgagccgagcgcgcgcccccgtcgcccacccgggcgcggctggatgcggcggggtccccgcggcggcgacccccggccccgagcgcccggagcgcccagaggcggcgtgcggggcccggggacgccgcgccctntngtgcgccgaggcgcgccccgagacagccgggggcccgcgccgcagccgccgcccgcgctgagccccggcccggcccgcggcccgcgcccggcggcagcntgagccaggccgagctgtccacctgctccgcgccgcagacgcagcgcatcttccaggaggctgtgcgcnagggcaacacgcaggagctgcagtngctgctgcagaacatgaccaactgcgagttcaacgtgaactcgttcgggcccgagggccagacggcgctgcaccagtcggtcatcgtcggcaacctggtgctcgtgaagctgctggtcaagttcggcgccgacatccgcctggccaaccgcgacggctggagcgcgctgcanatcgccgcgttcggtggccaccaggacatcgtgctctatctcatcaccaaggcgaagtacgcggccagcgcnggtgtatgcccgccgggaccccggaccccggccctgcgcccgcgtcgtctctgctgtaccttcccgccaactacctcggtgcgcgcncggctcgcaggccccgccagaaggcccgtggcaacggcgaatacggcgcgtgcgtcncggccccagggtc

SEQ ID NO: 550924 - DNA, 280 bp, Homo sapiens
tctatcatcttaggaggtgggaaaacgatagagcccaggagctcctaggctcaagcaatcctcacacctcagcctcccaagtagctgggactataggtgtgtaccactaaacacagccaactttttgcaggggcaggggcagagacagagtctcaccatgttgtccaggctggtcttgaactgctgggctcacgcagtcctcctgcttcggcctcccaaagtgttggaattacaggcctgagccaccaggcccagcccagatttttatctttttctgtta

SEQ ID NO: 550925 - DNA, 484 bp, Homo sapiens
  misc_feature (358)..(358): n is a, c, g, or t
atgatgctcatgcctgtaatcccagcactttgagaggcccaagcgggtggatcactagagctctggagtttgagaccggcctgggtaacatgcaagactccatctctatttttttatttaaaaaataaataagtaaataaaattgagcctcattttttaacctaattgaaaatgggtgataaaaatgtatacattgcgaccaggtgcggtgctcacgcttgtaatcccggcactttgggaggccgaggcaggtggatcgcctgaggtcaggagttcgggaccagcctggccaacatggtggattcgtctctgttaagaatacaggaatcagccaggtgtggtggcacatgcctgtggntccggctgcccgggaggctgaggcgggagaatcgcttgaacttgggaggctgcggttgcagtgggctgagatcgcgccattgcactcctgcctgggtgacagagcaagactctgtctcaaaaaaga

SEQ ID NO: 550926 - DNA, 148 bp, Homo sapiens
ttaagttgggtgactggtctaggatcttggatattggaagtcattcctatgtggttgctggcgataggtccatgtgtcctacgtgtgtatactcgttgtgtgtctatcaccaggtgcatgaatgaccaggttgtgttcctatggtatg

SEQ ID NO: 550927 - DNA, 432 bp, Homo sapiens
ttatgggaatgtaaaacaaagtttaaccttccataattatgatttactttccaaggaataatcatacctaccgacttacttgcttatcctcccaacctgcaaggtaggcatcaattacccgaatccttacccaaagtcacatgtctagccaatggtggtgtcgaatattctgatgaaagagttctattggccccgctaaagagttgtggggttttttaaatctttaactcaagttgtttcagtgaacctagaactaagactttttcaaccactcccaaattattgatgcttgggttttgcaacaaatgccctctaagctctcaggataagttgggggaggaaaatgaaaacataatagggtaagggttgttctctaactattcccagaccagttctcaccttcaaactgctctctctctctgaaagatgagc

SEQ ID NO: 550928 - DNA, 829 bp, Homo sapiens
cctagcaccacagacttatccttcgcctgcactttccgtctttcttctctgggcgcccaccaacaatggatggcaactccctgctctcggtaccaaggtaagacccgcttctttctatgcccaataccatgtcgatcaaactccgttccgcgttgtgagtcgctcacctaacttgccccagagcgcttcggtttgcacggggctcccagcgaggagacaggggtcactgcacttgtaaataagtccggcccagcctcgctggagctacaggggaccctgtcaactgccccacaggtcgcgatgctgagtggggcctgtgcgctggagtggcacgggttgggggtcagccccgtgcccgcctctaaggcccaggacggaggtctgctctgccctaggtggagccaggagccggactttccgcggacacagcttggagaggtttcacaccttgtggagagacagattccaaggtctaaaacaggagggaaccgggctagggcaaagtacccccgctttccttccaccttgacctgggcgggtgtctggggctgctggggtggggaagattgtccctcacaccccgaccgacacctagactgcccccaaagcgagatcttaagacagggcagaaaacacctaggtcccctgcagttcccacagtcctccagcgtccccaaacccctgccagtctgcgagttccttctttaacaccctttggctttgctcgtcccccacaccggggtaggtcacggacgccacccaggcgctgccggggtgcgagtaaccgtgtctctcagggtgtgttcttcctcctgtctctttttggccc

SEQ ID NO: 550929 - DNA, 511 bp, Homo sapiens
acccaggccactttacaggtagctcatcgtagacaccgcattcccacttcccctcgaagccctcatgctaaaacaacgtttccatgaagcacaccctgtgacagcacgtgcgatacaagaacactacatccagaactgagaacagagccccctgctctctgtacgactgtgcgcggcatacgtgtagttgcgcgcaattagctaggccgtttcctacattttcaccggaagtggctggctatctcacccagtgagtttggatcgatgatttgacctggttagctgtcgttggcagcaccttcccaagtggtcgtgatcttcgaggccacggtgtgcagatagcacattgttaggtctacctggccaggtagacctaacataaaaaaaaaaaaaagaaagaaatccgttgtgagtctgatgggatcccctttaaaagaggcaattgggttcttttctctagctgcctttaagatggtttctttcacattgaccctgggttaggtctaccggg

SEQ ID NO: 550930 - DNA, 197 bp, Homo sapiens
  misc_feature (40)..(40): n is a, c, g, or t
  misc_feature (93)..(93): n is a, c, g, or t
  misc_feature (101)..(101): n is a, c, g, or t
  misc_feature (132)..(132): n is a, c, g, or t
  misc_feature (162)..(162): n is a, c, g, or t
  misc_feature (164)..(164): n is a, c, g, or t
  misc_feature (172)..(173): n is a, c, g, or t
  misc_feature (191)..(191): n is a, c, g, or t
gatcctgaaagaggacaaactacattgccttttagacctntgactcaagaagaagatgatgaccaaaggtgatttgtaacttaacatgccttntcctgatnttgaaggatttgtgaagggaaaaaaattctnggctctttgtatataataaaatgagactanangcattctnnaaaaaaaaaaagattaantttaga

SEQ ID NO: 550931 - DNA, 155 bp, Homo sapiens
ttcataacactgggaaagaagtaacagttgagtgcacgaattgatggctcagccaacctacaaagtcaggatagttcgtgacaagtttttgggacgatgttatcgttcacaaatcacatgctcgtgccatagctatgacgtagtgatagtctcca

SEQ ID NO: 550932 - DNA, 688 bp, Homo sapiens
atccactgaggggtgccggccgtcagtgtctgtctgcactcacgtccagaacctctagagcttgccccccagggcgggcactgctgggagggtgcgagcaccgctgcggcacagaggcccggttcttggctgatcttctggggcctggggcctgccctgaggtggtggggacaggctgtggcctggccctgctgggggctgctaggccaacgggaccctccccaagcgcgccgcacactgcagggtctccaggcacctgggctcagctagtgactgacccatttgtgtgctaaatacgcagttttgtttttaatacatactcgtgaaattttccagaactggccttggaccagagaaaaatactttgggaatttttcaaaaaaatcccttcagttccacttggaattaggaaaacgtggcagatgcacttgaatcattttagaaaccaaattcacccccggccacacagccgacccagaagacccagagacagatcaaaccatgctgttgcagggtgcacctcccccaggaggggctcacgcctgtgttgcccatgctctctggctctcctgagttctgggtggccatggaggctgtttccctggaattccccaggccccggaggaacgtagggcaaggagctgctctggtcccagcatccctccaggcacctgtgggcggtgggctc

SEQ ID NO: 550933 - DNA, 335 bp, Homo sapiens
aaaacttttgttgctgaatgacacttccatgggttggagtattctgactgcggttgctataatttggctgctcatcagttttggtctggctcagccgcgctatctttcgtccctagttttaagcctgcctgaaaatcgacaaacagatgaatggacttcacagcttttatctattcatggtattgaagaagtcgtggtgatgcctgaacagcaagtggcctacgttaaagttgataaacagcagattaatgatactgcgcgacaacaattaacgcacttgttgggtaaagaggtagccatttaagcataactcttataaagtaaaatgtcgacgc

SEQ ID NO: 550934 - DNA, 114 bp, Homo sapiens
  misc_feature (114)..(114): n is a, c, g, or t
gccaccagcagcttctgccatctctctcctcctttttcttcagccacaggtcccagacatgacagccatcatcaaagagatcgttagcaggaccacaagtgtgtatcaaggggn

SEQ ID NO: 550935 - DNA, 1290 bp, Homo sapiens
ttcgcaccatagaaccgtgaagaaggcgggccggcctcatcatagaaaagtactacacagcgcctgggcgaacgagttccacacgaacaatgcgcgtgtgcgaggagatcgccattatccgccagcaaaaagctccgcaagaagcatagcaggttatgtcacgcatctgatgaacgcgaattcagaagaggccctagctcaaggaaggtaatctccgatcaaggctgcacggaggacggagacgagacaaggagcagacgaattactgttccatgacggtctcacgctcttggaatcaaggcaaacttcattgaacagtagaatccctgtaccacttaaggcacaactgcctgaacagccttgtcagggaccttcgggaccagctcatgctccaacacgccttcaagggctcaacactcagcccctacgagcagtggggcaatgccaacgtttccaacaaaccgcctcctcgcgcgcgcaacccttgccttgtggcacattcccactgtcctgcctagcttgccctgaccaatgtcacctgctcccaacttacaaactcatgggcgcaaccaaacgcacaccaacccagaacaaaaccccagaagacaaagcccccagcgcgagctccccctcgacacccacacagggcgcgcctccccgacacccagaacaccaccccgcgctcacccgccacacacacgggcgtcaacccatcaggagggccccccacacaccccggagactcacaccccgaagaagacccccccaaaaacacaaatctcgaactccgcacacctgcacccaccagcctccctcaacaccacacctcccaccacaccctaaactcctccgccccccatatattcccacactgacaccacaccgcgccccatttcaaataccccccctacaaaacacaccacaccgagaccattaacaccgcccccacccccactccatcaccaccccaccccccacccaaaatcaccccctcaccaacaacccacccatcctctcccaatcaccactccccccactagccccacctcccccactcacacctgagctcaacaaccccttcccaccaccccactcagccctacacccccacacgcccccaccccctacggcaccacaaaaacctcccgcccccacacgcacacccccccctccctccgcacccccccccaccactccctaaccacaccttccaacccccctttcacccccatcaacccccccccgcaacccccctcacaaccggcccaccaccccccatccccccccaac

SEQ ID NO: 550936 - DNA, 1483 bp, Homo sapiens
ggcgaagcctgagtcctgtccgtttctctctccccggacagcatgagcttcaccagtcgctccaccttctccaccatgctaccggtccctgggctctgtgcaggcgcccagctagggcgtcccggtcggtcagctagcggcgggcagcgtctatggcagtgctgctgggggctctggttcccggatctccgtgtcccgctcactacgcagcgttctagggtgctggactatggtggttccgtgtgggcctagggcctagccggggtagtagcgcgcggtggatctagtggcagcgcaactggcgtatggctatcccacggaaacgcatgtaagggcaggagccaatgtcgataaggcacgtgaagcccgaacaccgcgctagaggccctccttaacacgtgggacacacgaagggttgacgcgaggcccttaggaagaaacccggaggaaagcccgggacgcggcttggagagaacggcacagaagtgcacgggcgaaggccagcctttcgtgaggaacaagacagggggaagcgcgccgaggggtgcaccgaaggaccgtgggaagcaccgagttttaacttttccgaaagggaattctatggcggcagagggaacctgtggaagcggggtcccttccagggagtacttgtcgggccaaaacacttaagcgtgactggagaaaccacacttgtcccacgggacacattctggctatcccctgagccgaaggacctgttgaaccaaccagatgggccgccccgactctgtttgtgcctaggcctttggattatggaccctttgtaacggcaggggcgtccaaaaggactcacctgcaccgcaaccacggcaggcccgtggtgccacaatttggccgttcccaaggcctccctgtggtggcgcaaggaagaacggatataacgttgcccaactgggggtccgttccccggcgaaacgggggctaccacttctgggcaattcgaaatcggatcccacacttctatttccatgcgaccgatacctgtggccgagtccttgcgaatccaacccggcacggcactccggaagggggttcttccaacgtgtgagtggcagccttggtctcctttccattgcacaggagaagtcaaacgcctacgggaaaacccacggggcacagttacgagacgggcctttacgaaaggccccaagaactgggccaggcgtccgcgcgctttggacccgctgtgcagggatacgaatggcccccacaagagtctctaagagaacctcgggccaagcgaacgctggcagaaccacaccggggccccacataggcccaaagcgggcgtccggcaagggacccggcgaaggaagctagaacgaagataacgggccccagccccaccggacgggcgaaggccagcacggtgacaccagaacagatcggcacaagcatggacactgtacggaaaacgccccaccacccgaacgtccagacagct

SEQ ID NO: 550937 - DNA, 571 bp, Homo sapiens
ggcatgggcggaatgggcattggtggtcacggctggacgcgagtccgcacccggttacggagtgccagccatacccaaggatcccaatctgcgatgcgaggagatcaccataccaatgtgtcggggcattggctacaacatgacatccttccccaacgagatgaaccatgagacccaggacgaagcgggcctggaggtgcaccagttctggcccctggtggagatcaaatgctcgccggacctcaagttcttcctgtgcagcatgtacacgcccatctgcctggaggattaccacaagccgctgcccgtttgccggagtgtctgagagagagcccgctcgggatgcgcacccatcatgcagcagtacagcttcgaatggccggagagaatggcgtgcgagcacttgcccccttcatggtgaccccgacaatctgtgcatggaacagccctcgtacacggaggctggcagcggtggcagatcgggcggatcgggtggctctggcagcggttccggctccggcggcaaacggaagcaaggaggcagtggctcgggcggcagtggggccgggag

SEQ ID NO: 550938 - DNA, 321 bp, Homo sapiens
ccccccggggccccccccggggcccccaaaaaaaaaaaaaaaattgtcccccccccccgggggttgggggggaaacggggaaataaatcggggccccccccccaaggggcccttggggaaaacccccccgggggttttaagggattgccccctaggggggcccccattttttggggtttgggggggccggtctgggtcccccccccccgtggaaagggcccccccctttgggggttttggggggttttcccctttttttttttttttgccccggggggggggggggttccggaaaaaaaatggggggccctttttttttta

SEQ ID NO: 550939 - DNA, 357 bp, Homo sapiens
  misc_feature (13)..(13): n is a, c, g, or t
  misc_feature (355)..(355): n is a, c, g, or t
tgaaatagtgccngcctatgaaaagccccccaataccttaatttttaaaaaattaaccatgtaaacatggatacccagctgtggatagacagattgtaaagaaccgtaagacataaaagtgagataaaaattcacttcttgaaagatatatatggacattttagcttagcagagagtcagctcaatgtctaatagggctttatttgtaaacactgtggcgttctttccatgtttggaaagcggagccatttatctttttatagggcttaaatgcagtatgatcaagtttataatgtcagtctaaccccttccatatgtgacagcaagccaaaatatcatcaactaagaatatggngg

SEQ ID NO: 550940 - DNA, 132 bp, Homo sapiens
agttacatccatatgggagaatagtctccagatcactacaatggggagctgggtaggagcatggcttggagcacttcctattccactggattgggaaagaccatggcaggtatggcccatctcctgtacgct

SEQ ID NO: 550941 - DNA, 288 bp, Homo sapiens
  misc_feature (41)..(41): n is a, c, g, or t
  misc_feature (92)..(92): n is a, c, g, or t
  misc_feature (94)..(94): n is a, c, g, or t
  misc_feature (98)..(98): n is a, c, g, or t
  misc_feature (101)..(101): n is a, c, g, or t
  misc_feature (160)..(160): n is a, c, g, or t
  misc_feature (165)..(165): n is a, c, g, or t
  misc_feature (169)..(169): n is a, c, g, or t
  misc_feature (176)..(176): n is a, c, g, or t
  misc_feature (179)..(179): n is a, c, g, or t
  misc_feature (189)..(189): n is a, c, g, or t
  misc_feature (233)..(233): n is a, c, g, or t
  misc_feature (237)..(237): n is a, c, g, or t
  misc_feature (240)..(241): n is a, c, g, or t
  misc_feature (243)..(243): n is a, c, g, or t
  misc_feature (246)..(246): n is a, c, g, or t
  misc_feature (248)..(248): n is a, c, g, or t
  misc_feature (250)..(250): n is a, c, g, or t
  misc_feature (258)..(258): n is a, c, g, or t
  misc_feature (262)..(262): n is a, c, g, or t
  misc_feature (281)..(282): n is a, c, g, or t
tcacttgaggtcaggggttctaccaccctggccaacatggnggaaccccatctctactagaaatacaaaagatgagccaggggggggggcanangccngtngtcccagcttcctaggaggctaaggtggcgcgcctcccttgccccccgccggccgcggntgcgnatgngccgggntcncgccgactgnactcccgcttgcgcgcccccgcagccccgccgcgcgcccctgcnctcnccnncngcncncngcacgcangccncccgcccccccggcccccnncgcgcc

SEQ ID NO: 550942 - DNA, 1663 bp, Homo sapiens
  misc_feature (138)..(138): n is a, c, g, or t
  misc_feature (527)..(527): n is a, c, g, or t
  misc_feature (545)..(545): n is a, c, g, or t
  misc_feature (668)..(668): n is a, c, g, or t
tttgggagtcagagtctgcgctctcttgtccaggctggatgtggcaatacgcggcagatctggggctcactggcgaacctccggcactccctggtgttcaagcgcaatttctcctggctcttgcctacctggatgtangctgaggagattacaggcgcggtgtgtgtgtcaccaacgctcgggctaaacttgtgtgtggtctttatatatagttagaaggcccgagggggttctccacccagtgtctcagagacgtggtctcgtgtgggacttcctgtgagacgtctcgtgtgaactccaaccgcgcactgtgtggaccctccccaaagagttcacgtggggaaatatcacgagccggcgtgtggaggcccaactgtgtgtggccccgggaccggggtattctcttatacaacgtgtggaaggcttatacattgtctctgtgagacctctcttaatagtgtgattctcatatattatgtgttaccatttaacatctctgtgtgtggatctccccccaagtgtctctntatatgtgtggcgcaccnatatctcgagggaaaacgacctttttatctatctagaatgtggagtgtgggcctctattgtataatgtctccatatatatatactgatgaggggtagggatatctcgagtgggggttctcccnatatatcacggggggcgctataattataacccgtattccaatcaccacagtgtgggtcccatgtataaaggctctgctgtgtgcgacacgacaaacaccacactcttctgttgtctcacacctctctcttcatctctctgtcgtggtgtcacacaccgcagtggggaggaaaaatatttgtctctcccttcctttaaaagaggccgaggggggcgctctttacaaacacaattctcttctctgggcgccaacaaccctgtttttgtggaccccagataagcggctaattatacacgaacttatttaggaactactttcccagagggatatttttataaacctcctaaccaaaaattgggggccttcaaaggcagcaaaacttatccactgctgtgctcaccagcgtctgtccagctgcggcagcacaacaccgctggggcgcaacacacgctccccactttttttggaggagcccgcctccacgcagggcggtgtacggcaccacccaccactttccggcagtttgggggcgcatttgtggagaagcgagcttcagccacaaagcttatgtttagacggccgctgtagtagaggagcaacctcttttctaaaacacagaacgtgtttgtctctagcgaacacacctttagtcagtctgcctcggtggcgtagaaccacctttacaaacaagtacgttttctcttttttggtgccaccagccaacagacagcctacacaacaaaacaaacaggggcggcgcgcggcggagcagaaaagaaaaagatgatatcaccctcaaggggggggggccgccacacagtagttattacccgcgtataacacacggcaggtctcttttggtttcgaaacgcagtcggggtcgccccacaatatggaaggacggcggcagcagtatcaataatacagacaccagcgagcagcaggagcgaggcgaggatgaatacacaacagcgcctggtgctggcgggacaacg

SEQ ID NO: 550943 - DNA, 113 bp, Homo sapiens
ttatgttctcatttcaggacgtatctgagtaattgcatccattgtgatgtgccaccaaagagaaaaatacttagtttacatagtcgagtataaccaaagtacttttctctttg

SEQ ID NO: 550944 - DNA, 354 bp, Homo sapiens
  misc_feature (1)..(1): n is a, c, g, or t
  misc_feature (310)..(310): n is a, c, g, or t
  misc_feature (318)..(318): n is a, c, g, or t
  misc_feature (338)..(338): n is a, c, g, or t
nattgatttcattgaaataattgacaatattgaggataatatttttatgatttttatttgaaaatttgctgattctttaaatggtttgtattctagatttatggaatttttttcttttaatctatctatagcttgtagcagttcaataaactatacttctgggaaccgtaattgaaacatttacttttgctctctacctgactgccccaggaattggggcaactattcatgaggtattgatatgtttatgggtaatacacatatttggcacaagtacaggtaaccaatctggctctctttgttacagggncacatttncaaatcattggggtatattnccccaggctttgccgg

SEQ ID NO: 550945 - DNA, 1289 bp, Homo sapiens
ttcctctggcctcttgttgggagccagagctgcctctgtagacctcttttggtgttcttatgccaatagggcgcgtgtctctcctgaaccaacagggggaggctccccccttgttagtagctcctttacaccggcttcttatgctccatgaatgctcccatagtcctttaatctcgagggctttttgcccctctctatacggccctcagatccgaccttgctttggatctcatcggactggaccggttatttggagcggggccaattccttgtggggtatttcacgcacttccctttagtccacccaattgttcagggtccctctacaaggccctttcagcgcattcaggacagttctgcggtcccatagagaatcctaggcaagcgaacgtgatgactcaatcggctaggagcacgtatgctcctcgtaattcctgggctagacatgttggttcccagtgcctggtctaggattgccgtggtggaagtcagggggagtctgttctagatcttcgaactgaatcagcgaacgtatagcaccaggacaaccccacttgacagcgtcttgtgccacgcgccaagtgccccacgtgatgtggttcgatctggcacctttaggtggctcctagcccacagccagccactttcggtgacaactgacgcctttcgcaagaatcatttagggttcaaaggagcaccacgttccctcttcattctctgaagcaggggagatacattcgacacgttggccttgtcgcccaggaagtgaggctcggcacccataactgaacacctcgccacccttgggaaaaccatgatccttactgaggaggtgaagatgaccaattgctgggtcctcaagactgttctcaaagaagagctccattagagctagactggtaccagaacgacgagtagggtacaacaggtggcagttacacacgtgacagatgtcatggcggagctggggcgggcccagcacaaacccgtccatcggtctccagagcccagccagcaggcaagaggtccatggacctatgaggacacgagaagttccagaccgtcacgggcacggtctagtgggccctagtgcaggaagtatgaggccagccttgtgtgttcacatcactgatttatagctgctgtatctgtcgtttgagggtattttgtaactggcctatatgtttattaggcaaaagcagcttcttaacagatggcatatttctgtgacatctaggcatcacaaaagagccagagttctggaccaatactcggaggtctgtagccta

SEQ ID NO: 550946 - DNA, 573 bp, Homo sapiens
gaaccatggggactgtgcacgcccggagttgggagcctcttccatcgaagtgtgacctgatttgtggaggattagagatgaagaagctgacatttgttgaacgttgaggccgtgaagcgtaacagcaggaacatttctgtgatatacaagcgagtgctggtgtgttcaagcagtgtccagttatcgagtggtcctctggtagaggacctaaacgactgtatatcattctattcgctgagagtcggacgactgtttgcagatggcgcaagataacctaaccttagacggtaatgccgtgaaatctcatgatagcccgctgcaagaaattgctcgcgtcttgcgaaagttctttatgcacacaagtaggcagtgctctctctgagtcttgaactacaactgttcgacaatgggctcgaagttggagcccggctactctttgcgcaacacattggggtgcttgtaggaacggtatcaccccgtgttgggagacgttaacctgaatatctgccgtgaaggacttaactggcggcagctttatagcaacacatggctgggtggaaccaatgcaatggc

SEQ ID NO: 550947 - DNA, 345 bp, Homo sapiens
ggctgaccatagaggatccccaaacaccgcaatcttaaaaagaaatgctagaatcagaaaaccatcattttacgctgggtgcagtggctcacacctgtaaccccagcactttgggaggacgaggcaggtggatcacctgaggtcaggagttcaagaccagcttggccagcatgatgaactccgtctctactaaaaatataaaaattaacagagcacagtggcacatgcctgtaatcccagctactcaggaggctgaagcaagagaactgcttgaacctgggaggccgaggttgcagtgagccgagatcacaccattgcctgggcaacagagccagactctgtctc

SEQ ID NO: 550948 - DNA, 232 bp, Homo sapiens
tagggcataaccctatttcattcacctccagaagtgaaattcttcgcaggatttttctgagccttttagcactcccagctagcccgtacccccaattaggagggcactggccccaaacaggcatcaccccgcataaatccccatagaagtcccactccataaacaccatccgtattcactcgcatccaggagtatcaatccacctgcagctcacccatagcaaaatcatctg

SEQ ID NO: 550949 - DNA, 646 bp, Homo sapiens
  misc_feature (608)..(608): n is a, c, g, or t
  misc_feature (646)..(646): n is a, c, g, or t
agcatcttatgacccaacttcaaactatactttaaggctatagccaccaaaacagtgcagtactggtataaaaataaacacatagaccagtggaatgaaatggagaacccagaaataaagccaaatacttacagtccattgatcttcaacaaagcaaggaaaacataaagtggggaaaggacaccctattcaacaaatggtgctgggataattggctagccacatgtagaagattaaaactggatcctcacctcttgccttatacaaaaatcaagtcaagatagatcaaagacttaaatctaagacctgaaactataaacattctagaagacaacatcagaaaaatccttctagacgttggcataggcaaagacttcatgtccaatcacccaaaagcaaatgcaacaaaaacaaagataaacagatgggacataattaaactaaaaagcttctgcacagcaaaagaaaaaatcagcagcctaaacagacaacccacagagtgggaaaaatttttcacaaatttgcatccaacaaaagactaataccccatatctacaaagtacccccaaacaaataagtaagagaaaagacattcaaatgactaacanacttaggaatggtcaacatcactaattatcagggtgcn

SEQ ID NO: 550950 - DNA, 301 bp, Homo sapiens
actctgaggatcccccagagtccaacagtgccgattagagggaggctcgccgagcatgggacggggagggcactgcccggctgtcagagcctgtgcacctatgcccactgggcacgcagaaaccccgagacgcccccatgtggacttcctggctgagaagggtcctgggctggttcaggggaaaccacaggctgggctgtatcctgttagcaagtgcaaaccttcacagtgctattcacagcctctgagaactagtggccccgggacacagccggcgcggtgacactggcctggtgacgca

SEQ ID NO: 550951 - DNA, 964 bp, Homo sapiens
cgttcctgggcctggagggctgctttggggcaggaaactttggccaccaggcctctgacctgcaccaggagacactgggaggtttagtccccaaacccgcacagagcaggactgcagcctgaggaaagagcaaggatttcaggagagaggcctgcgacaagtgagcaggaaatagaaacttaagagaaatacacacttctgagaaactgaaacgacaggggaaaggaggtctcactgagcaccgtcccagcatccggacaccacagcggcccttcgctccacgcagaaaaccacacttctcaaaccttcactcaacacttccttccccaaagccagaagatgcacaaggaggaacatgaggtggctgtgctgggggcaccccccagcaccatccttccaaggtccaccgtgatcaacatccacagcgagacctccgtgcccgaccatgtcgtctggtccctgttcaacaccctcttcttgaactggtgctgtatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattggattcatcctgttactggtattcggctctgtgacagtctaccatattatgttacagataatacaggaaaaacggggttactagtagccgcccatagcctgcaacctttgcactccactgtgcaatgctggccctgcacgctggggctgttgcccctgcccccttggtcctgcccctagatacagcagtttatacccacacacctgtctacagtgtcattcaataaagtgcacgtgcttgtgactcgagcaaacttatgcatgcgggccgaattcaagcttacttgggccaatcgccctggggggcgttacttcac

SEQ ID NO: 550952 - DNA, 179 bp, Homo sapiens
aactctagataatacagtaaaatgctatataataacacattaagtcttctgtagttaaatactagatattcttagctatctataataaagcctaagttatactatcataataaagtagtatagggccacagatcttgtacaaaatatgtccagtaatttatactagtggcatcataaaa

SEQ ID NO: 550953 - DNA, 1001 bp, Homo sapiens
cgttcctgggcctggagggctgctttggggcaggaaactttggccaccaggcctctgacctgcaccaggagacactgggaggtttagtccccaaacccgcacagagcaggactgcagcctgaggaaagagcaaggatttcaggagagaggcctgcgacaagtgagcaggaaatagaaacttaagagaaatacacacttctgagaaactgaaacgacaggggaaaggaggtctcactgagcaccgtcccagcatccggacaccacagcggcccttcgctccacgcagaaaaccacacttctcaaaccttcactcaacacttccttccccaaagccagaagatgcacaaggaggaacatgaggtggctgtgctgggggcaccccccagcaccatccttccaaggtccaccgtgatcaacatccacagcgagacctccgtgcccgaccatgtcgtctggtccctgttcaacaccctcttcttgaactggtgctgtatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattggattcatcctgttactggtattcggctctgtgacagtctaccatattatgttacagataatacaggaaaaacggggttactagtagccgcccatagcctgcaacctttgcactccactgtgcaatgctggccctgcacgctggggctgttgcccctgcccccttggtcctgcccctagatacagcagtttatacccacacacctgtctacagtgtcattcaataaagtgcacgtgcttgtgagtacaacctgccggtggagtacaacctgccggtggagtacaacctgccggtggagtacccgctgccggtggcgtactcgtggtcgtagctgtaccctgtgccggtggggg

SEQ ID NO: 550954 - DNA, 925 bp, Homo sapiens
cgttcctgggcctggagggctgctttggggcaggaaactttggccaccaggcctctgacctgcaccaggagacactgggaggtttagtccccaaacccgcacagagcaggactgcagcctgaggaaagagcaaggatttcaggagagaggcctgcgacaagtgagcaggaaatagaaacttaagagaaatacacacttctgagaaactgaaacgacaggggaaaggaggtctcactgagcaccgtcccagcatccggacaccacagcggcccttcgctccacgcagaaaaccacacttctcaaaccttcactcaacacttccttccccaaagccagaagatgcacaaggaggaacatgaggtggctgtgctgggggcaccccccagcaccatccttccaaggtccaccgtgatcaacatccacagcgagacctccgtgcccgaccatgtcgtctggtccctgttcaacaccctcttcttgaactggtgctgtatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattggattcatcctgttactggtattcggctctgtgacagtctaccatattatgttacagataatacaggaaaaacggggttactagtagccgcccatagcctgcaacctttgcactccactgtgcaatgctggccctgcacgctggggctgttgcccctgcccccttggtcctgcccctagatacagcagtttatacccatagcaccagcacgaattcccttagcaccagcacgaattcccttagcacgaattcccttagcaccagcacgaattccctt

SEQ ID NO: 550955 - DNA, 353 bp, Homo sapiens
tcaggtgtaccggtgggagtaggaatgggtagggtgacggataaagagaggtggttaattgttacagagttagacagaaggaataagatctagtgttctaacgtacagtaggctgactatatagttaacaataatgtattgtatagttcaaagtagctagaagaactggaatgctcctaatataaagaaaagacaaatgtttgaggtgatagataccccaattaccttaatttgatcattacacactgcatgaatgtatcaaaatatcatatgtgcccccaaatatgtacaactattatgtatctattttaaaaaatggccaggtgtggtggctcatgcctgtaatcctagca

SEQ ID NO: 550956 - DNA, 727 bp, Homo sapiens
tattagcctaattttggacttcatttgacgcagttgtaataggtttcaccacatcagagtaagattactacatgccagagctattctttaactcagcttgtaaaaccatgatagcatcaacaatatacatagcaaatgaatgccatctttaatccaattaaatggtttttacaaaatttgctcttgtaggttgatgctatctgcattgcagtaaattaccaggtgaggtaccacagaatgacataaactgccaaggttacaattacctatgggcaatttctctttagcagtacatgtactgtatacttactcaaaacatatgccaaatttagtgtcgaacaagctcattcaaatcaattgggaaagcacgtaaatgaacaattcataacagaaaagcatgccaatggccaagagcattagaaccaggtgctcaatccttaccaggtcattataacggaccatactgacactcggcggacattatcacactcacttacgaatactctattacataacaaacaattattggactttatatcccccatatcagattaccccactacattgcgctcacacctagtatttaccaacatcttacacactctggacttagtatcaaacctttcaggaaaaatagaacacaaccagtatgtacacacgtcaactatccttttggaccacacatatggtaaaatatacaatggaatacacgtggcgtcatcacatc

SEQ ID NO: 550957 - DNA, 1555 bp, Homo sapiens
tgctcccttgggctctagagaggaggcccctcttagccctcagcccctccttcctctctatcttaaagtaatttgatcctcaggaatttgttccgccctcatctggcccggccaaatcccgatttgacaaatgccaggaaaaggaaactgttgagaaaccgaaactactggggaaagggagggctcactgagaaccatcccagtaacccgaccgccgctggtcttcgctggacaccatgaatcacactgtccaaaccttcttctctcctgtcaacagtggccagccccccaactatgagatgctcaaggaggagcacgaggtggctgtgctgggggcgccccacaaccctgctcccccgacgtccaccgtgatccacatccgcagcgagacctccgtgcccgaccatgtcgtctggtccctgttcaacaccctcttcttgaactggtgctgtatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcgtcatcccagtgctgatcttccaggcctatggatagatcaggaggcatcactgaggccaggagctctgcccatgacctgtatcccacgtactccaacttccattcctcgccctgcccccggagccgagtcctgtatcagccctttatcctcacacgcttttctacaatggcattcaataaagtgcacgtgtttctggtaaaatgaaaaaaaaaaaaaaaaaaacaaaacaaaaaaattttttgggcggctcgggccctcaagaaaagtttttaaaccccatttttgttgggggggcggggccccaagaaatagtaaggtaaaccattgggcacaaagggggtggcccaaagagagagcaaccgggtggccagcagataggggtgcgggttgtctcaccccgaataaaaaaagggccggcgggagacaccgcgacgtgttttctggaaccaccaaccccgagagggagcgtctcggaggacaaaaagggcttccacaccaggggggtatccccaggcgacagtccccgaatacataatatagagccgcgctggtggaaaaagacaagacagacgacctagaacacagacaaggcagacgcaagcacatcacacacagaagaccaagacacaccatgcagagcacaaccacagcagaaataaaaaggaagaggaaggggagaaaacgagcagagaaatatcaacgacagcaaacaaagacgcggggcagaagcggaacacaggagaacagacagagaaaaaagaacgaggaggtaggagagaggacaaggagaggagacaaaaagaagaaacagaggaccaggaggagaacgagcaagacgtaccgaagaaaacagggaaaacacgaagaaaagaagacaagaagaagagaagagagagataagtggagggcaggcgcacggagcagcgaagggaagaca

SEQ ID NO: 550958 - DNA, 607 bp, Homo sapiens
  misc_feature (23)..(23): n is a, c, g, or t
gctcggtaccccttgcatgtacngggctcaacacttccttccccaaagccagaagatgcacaaggaggaacatgaggtggctgtgctgggggcaccccccagcaccatccttccaaggtccaccgtgatcaacatccacagcgagacctccgtgcccgaccatgtcgtctggtccctgttcaacaccctcttcttgaactggtgctgtatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattggattcatcctgttactggtattcggctctgtgacagtctaccatattatgttacagataatacaggaaaaacggggttactagtagccgcccatagcctgcaacctttgcactccactgtgcaatgctggccctgcacgctggggctgttgcccctgcccccttggtcctgcccctagatacagcagtttatacccacacacctgtctacagtgtcattcaataaagtgcacgtgcttgtga

SEQ ID NO: 550959 - DNA, 425 bp, Homo sapiens
ttgactcgcattcgcctgactcgaatcgctttgaaaaaattagagtgttcaaagcgatgcgaactctcgggccctgtctatctcacaaacaagagatgaatcactaactctactccgaaaagtcctgggtcctgtccactctctcttccggtggaatcagaagaaacaaagagtttcctccctgccactttgggaagtgttaagcgtctcatgaatattatagttcacagactgaaaagcaactcaagaatgcctcagtcaggttttcttctatgttccaaagagcaccaaggaaattctgggcacttgatagtgtccctgagagtaaaacatcagtattcaccaaattaccctctttgctgccaaagaacgatggggctttgataattttctccttttaaagccaaaaagataaggcatgactt

SEQ ID NO: 550960 - DNA, 863 bp, Homo sapiens
cgttcctgggcctggagggctgctttggggcaggaaactttggccaccaggcctctgacctgcaccaggagacactgggaggtttagtccccaaacccgcacagagcaggactgcagcctgaggaaagagcaaggatttcaggagagaggcctgcgacaagtgagcaggaaatagaaacttaagagaaatacacacttctgagaaactgaaacgacaggggaaaggaggtctcactgagcaccgtcccagcatccggacaccacagcggcccttcgctccacgcagaaaaccacacttctcaaaccttcactcaacacttccttccccaaagccagaagatgcacaaggaggaacatgaggtggctgtgctgggggcaccccccagcaccatccttccaaggtccaccgtgatcaacatccacagcgagacctccgtgcccgaccatgtcgtctggtccctgttatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattggattcatcctgttactggtattcggctctgtgacagtctaccatattatgttacagataatacaggaaaaacggggttactagtagccgcccatagcctgcaacctttgcactccactgtgcaatgctggccctgcacgctggggctgttgcccctgcccccttggtcctgcccctagatacagcagtttatacccacacacctgtctacagtgtcattcaataaagtgcacgtgcttgtga

SEQ ID NO: 550961 - DNA, 628 bp, Homo sapiens
  misc_feature (23)..(23): n is a, c, g, or t
gctcggtaccccttgcatgtacnggggagaaccatcccagtaacccgaccgccgctggtcttcgctggacaccatgaatcacactgtccaaaccttcttctctcctgtcaacagtggccagccccccaactatgagatgctcaaggaggagcacgaggtggctgtgctgggggcgccccacaaccctgctcccccgacgtccaccgtgatccacatccgcagcgagacctccgtgcccgaccatgtcgtctggtccctgttatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcgtcatcccagtgctgatcttccaggcctatggatagatcaggaggcatcactgaggccaggagctctgcccatgacctgtatcccacgtactccaacttccattcctcgccctgcccccggagccgagtcctgtatcagccctttatcctcacacgcttttctacaatggcattcaataaagtgcacgtgtttctggtaaaa

SEQ ID NO: 550962 - DNA, 419 bp, Homo sapiens
actctagaggtcccctccagctgggccccaagtcactccttaatgcaagaacaaaaccggaggcatcacgctacctgacttcaaactatactacaaggtacagtaaccaaaacagcatggtactggtaccaaaacagagatatagacccatggaacagaacagagccctccgaaataatggcgcattatctacaactatctgatctttgagaaacctgacaaaaacaagaaatggggacaggattccctgtttaataaatggtgcgtggaaaactgggtagccatactgtagacaagctgaaactggatctcttccttacaccttatacacaactcacttcccgacggattacagccttccctgtttagacctaaaaccactaaaaatcctagaaggaaaaactagggcataacattca

SEQ ID NO: 550963 - DNA, 282 bp, Homo sapiens
  misc_feature (178)..(178): n is a, c, g, or t
tagagatccgtactgcatacagatgtagattcttgattagtagaatctagatctatcgagcaaaaaaaaagagtgaaagaaagagggacaaaaagaagagatgagggaacagtagggaggaaggaaagaagaaaagaaacaagagaaagaaagaccactggcgaatgtatggttggtnaaaagtactttattcggtagttcaatttatcaaataaaatattctttcaataatatgagatctttcctaaagcgtacggatcatactgataatcttctgtcccc

SEQ ID NO: 550964 - DNA, 809 bp, Homo sapiens
cgttcctgggcctggagggctgctttggggcaggaaactttggccaccaggcctctgacctgcaccaggagacactgggaggtttagtccccaaacccgcacagagcaggactgcagcctgaggaaagagcaaggatttcaggagagaggcctgcgacaagtgagcaggaaatagaaacttaagagaaatacacacttctgagaaactgaaacgacaggggaaaggaggtctcactgagcaccgtcccagcatccggacaccacagcggcccttcgctccacgcagtgcacaaggaggaacatgaggtggctgtgctgggggcaccccccagcaccatccttccaaggtccaccgtgatcaacatccacagcgagacctccgtgcccgaccatgtcgtctggtccctgttatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattggattcatcctgttactggtattcggctctgtgacagtctaccatattatgttacagataatacaggaaaaacggggttactagtagccgcccatagcctgcaacctttgcactccactgtgcaatgctggccctgcacgctggggctgttgcccctgcccccttggtcctgcccctagatacagcagtttatacccacacacctgtctacagtgtcattcaataaagtgcacgtgcttgtga

SEQ ID NO: 550965 - DNA, 262 bp, Homo sapiens
agggacaagatacatcagtgagagagtgcagatacaatctgcaatgcatactagcgagacgtatagaccataatatgtgtgcagaagaacacagaggtattccgttctttcgctcatgcacaagtctccatcacaaatgaaatctatcagctacctaggagagccagaaactttcctcttctgtcccacagactactgaggcactttctgttatccaaatgtgtctcagtctccatatctcaggactgtgggtgaaaagctt

SEQ ID NO: 550966 - DNA, 887 bp, Homo sapiens
cgttcctgggcctggagggctgctttggggcaggaaactttggccaccaggcctctgacctgcaccaggagacactgggaggtttagtccccaaacccgcacagagcaggactgcagcctgaggaaagagcaaggatttcaggagagaggcctgcgacaagtgagcaggaaatagaaacttaagagaaatacacacttctgagaaactgaaacgacaggggaaaggaggtctcactgagcaccgtcccagcatccggacaccacagcggcccttcgctccacgcagaaaaccacacttctcaaaccttcactcaacacttccttccccaaagccagaagatgcacaaggaggaacatgaggtggctgtgctgggggcaccccccagcaccatccttccaaggtccaccgtgatcaacatccacagcgagacctccgtgcccgaccatgtcgtctggtccctgttcaacaccctcttcttgaactggtgctgtatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcgtcatcccagtgctgatcttccaggcctatggatgacgatgagcagaatggtcatgaggatgcccagaatcagggcccagatgttcaggagctctgcccatgacctgtatcccacgtactccaacttccattcctcgccctgcccccggagccgagtcctgtatcagccctttatcctcacacgcttttctacaatggcattcaataaagtgcacgtgtttctggtaaaa

SEQ ID NO: 550967 - DNA, 913 bp, Homo sapiens
tgctcccttgggctctagagaggaggcccctcttagccctcagcccctccttcctctctatcttaaagtaatttgatcctcaggaatttgttccgccctcatctggcccggccaaatcccgatttgacaaatgccaggaaaaggaaactgttgagaaaccgaaactactggggaaagggagggctcactgagaaccatcccagtaacccgaccgccgctggtcttcgctggacaccatgaatcacactgtccaaaccttcttctctcctgtcaacagtggccagccccccaactatgagatgctcaaggaggagcacgaggtggctgtgctgggggcgccccacaaccctgctcccccgacgtccaccgtgatccacatccgtgcacaaggaggaacatgaggtggctgtgctgggggcaccccccagcaccatccttccaaggtccaccgtgatcaacatccaagcgagagctccgcgcccgaacatgtcgtcaggatcccagtacaacaccctcttcttgaactggtgctgtcttcatagcattcgcctactccgtgaagtctagggacaggaagatggttggcgacgtgaccggggcccaggcctatgcctccaccgccaagtgcctgaacatctgggccctgattctgggcatcctcatgaccattggattcatcctgttactggtattcggctctgtgacagtctaccatattatgttacagataatacaggaaaaacggggttactagtagccgcccatagcctgcaacctttgcactccactgtgcaatgctggccctgcacgctggggctgttgcccctgcccccttggtcctgcccctagatacagcagtttatacccacacacctgtctacagtgtcattcaataaagtgcacgtgcttgtga

SEQ ID NO: 550968 - DNA, 443 bp, Homo sapiens
  misc_feature (12)..(12): n is a, c, g, or t
  misc_feature (20)..(20): n is a, c, g, or t
  misc_feature (79)..(79): n is a, c, g, or t
  misc_feature (89)..(89): n is a, c, g, or t
  misc_feature (92)..(92): n is a, c, g, or t
  misc_feature (101)..(101): n is a, c, g, or t
  misc_feature (139)..(139): n is a, c, g, or t
  misc_feature (143)..(143): n is a, c, g, or t
  misc_feature (149)..(149): n is a, c, g, or t
gattcggcacgnggggcganggggaaactgctccgcgcgcgccgggagcgaggaacctagtgttcctttagggtccggnccggccgcantgngatatcatnttcctgagcccgcgtcccactgtcttctgcttcttccnatgntgcctnctgctgctgctgctgctgccggccccggagctgggccgagccaggccggaactgatgagaacgactgggttcgcctgcccagcaaatgcgaagtgtgtaaatatgttgctgtggagctgaagtcagcctttgaggaaaccggcaagaccaaggaggtgattggcacgggctatggcatcctggaccagaaggcctctggagtcaaatacaccaagtccatttcagatcccccagaccaagatgacctatcttccttccagctctgagtcacttcccattgggacttgcggttaa

SEQ ID NO: 550969 - DNA, 103 bp, Homo sapiens
gaggacccggacaccaccatttcacataagaggcaggcgacatgtcgagtgctgaggaggaaccccggtatgccaccatgctggagaggaaccccggacgcca

SEQ ID NO: 550970 - DNA, 712 bp, Homo sapiens
gagagatcagtttacaactgcagcagagcagcatctaacagggcaaaaaataaatccccatgaaggaaaccttgtgtggtggaaagatgtcagaacaaagacctgggaagaggggagaatcattacatggggtagagggttttcttgtatttaaccaaggagaaaatcagcttcctctctgggtgcctacaagacatcttaagctgtgccgtgagtcagaatccaaggaagaggagaagacctcggaactttgcactcccaacttgcctgatggctcaaatgaagatttctgctgagcagaaggtgaccagcaagactcaccagtcaactccaccgacctgggggcagattaagagattgacccagcttgcagaagaggacctgaagtctcaggacaaaccgtggacctcctgcaatctgctggtagctatgatggtggtaattaccctggcagtgagtctccctgtagctgaggctgatcaaaattatacctagtgggattacattccattccctccactgattagacctcttacttggctgaactccccagtagaggtttatgttaataatagtgttaggatgcccggagcaactgataaccaaggcctagtcatccagaggaggaaggaatcaattggagactggtcattttagcgaggctgtgagagcaatggcatatttgcagatatgtccagataatttgaggaat

SEQ ID NO: 550971 - DNA, 601 bp, Homo sapiens
cctgaacaagagcaggtctcaacattgggcttgaaatattcagcaaaccacactgtaaacagatgtgctggcacctgggctttgctgttccatctacagagcacagacagaatagatttagcataatttttaacagccctaggattttcaaaattgtatatgaacagtggcttcaactcaaagttgccagacagctgtattagctcctaacaagagagtcagcctgtgctttgaagcaaggactgacttccttctagctatgagagtcctacatggcatcttccaacagaaggctgtttcatctaccttgaaaatctgctgattactggagccaccttcatgagtgatcctagctgaagctctggacaacttgctgctgcttctacatcagcacttgctgcttcatcttacacttttgtgttatagagatgacttctttccttaaatctcatgaacctatttccacagcttcctcacctctcttaacctttatagaaatgaggaggagtagggccttgctctggattaggcttttggctttatggttgatctggcttgatcttttatccaggccctaacttttttcctattagcaaataag

SEQ ID NO: 550972 - DNA, 693 bp, Homo sapiens
tcgagctcggtaccattaaacaggctgatgctgtttcaggagactggggtctctcttcccacctgggaagccagagaccgccttgcttgccccggaattggatggagaaccctggtgactcagaaatggacgtctcccctctacgccacctcccccgcaggacggcgtggcacctgtcacctggctgctctctggatgtctgtgggccttgtgttaaccccaggcagaatcctgaaggtcattcttgcctggcccaggtgtgctttgagctcttctaaaggggcttacaaatgcagagtcccactggcatgggtggattcgtgttcacctgcatctctagccaggccttccaattctggaaccggttcctccatctggaggacttgacgtgtctgaggaggtgtgtgtaatagtggctttgggatcactggactgaggtggcgtgaggggggtgcgtgctaatggtgacatagatccttccactttaatcatcacgtcctcacccccacccccatgttctcatctgtaagacgaggatgcagaggccctctggcagttgagggtgaggatgagatgctgtaatgcccgccacatgcccctgacgggtaaatgtcagatgcgggtgagggttgagaaggcctggagcgtggggtgagcccctgatgagtgtcagctgttactgtgtcgatcagt

SEQ ID NO: 550973 - DNA, 420 bp, Homo sapiens
  misc_feature (5)..(5): n is a, c, g, or t
  misc_feature (12)..(12): n is a, c, g, or t
  misc_feature (70)..(70): n is a, c, g, or t
  misc_feature (84)..(84): n is a, c, g, or t
  misc_feature (114)..(114): n is a, c, g, or t
  misc_feature (123)..(123): n is a, c, g, or t
  misc_feature (131)..(131): n is a, c, g, or t
  misc_feature (193)..(193): n is a, c, g, or t
  misc_feature (224)..(224): n is a, c, g, or t
  misc_feature (257)..(257): n is a, c, g, or t
  misc_feature (393)..(393): n is a, c, g, or t
  misc_feature (411)..(411): n is a, c, g, or t
aaatnctctgtnttgttacaggcaaaattctggtatggcgtgaatgccatggggtcattctgaatatatntccccctgtaattntatcattacacgatgtttgcaatacgtgcnttgtttttnaatttganagcaaactttcctactgttgaaagacattttttgacaacttgacccttcctagtattgagtnctaagttgaggactgcatctcctcgtttttnacagtatagagaacaaaatgacattagtttganaaatacatatcacttgggtattgctgtcttgggttgcagtgggtgatacaggaattgggtttcattaattcctacatgggttgaggaatcactggatccaggaaagtggggggggaaaaaaaacaaacgtttaaancctcaatcctcgtagggnagggtgggt

SEQ ID NO: 550974 - DNA, 355 bp, Homo sapiens
  misc_feature (14)..(14): n is a, c, g, or t
  misc_feature (113)..(113): n is a, c, g, or t
  misc_feature (216)..(216): n is a, c, g, or t
  misc_feature (222)..(222): n is a, c, g, or t
  misc_feature (256)..(256): n is a, c, g, or t
  misc_feature (261)..(261): n is a, c, g, or t
  misc_feature (267)..(267): n is a, c, g, or t
  misc_feature (271)..(271): n is a, c, g, or t
  misc_feature (274)..(274): n is a, c, g, or t
  misc_feature (282)..(282): n is a, c, g, or t
  misc_feature (308)..(308): n is a, c, g, or t
  misc_feature (339)..(339): n is a, c, g, or t
  misc_feature (343)..(343): n is a, c, g, or t
  misc_feature (349)..(349): n is a, c, g, or t
  misc_feature (353)..(353): n is a, c, g, or t
cacgggtccccgtntgacagtggccgctgccatattcaggtgtagctaattgctctggtgtgggaatgcaggcctaatgacagaaatctggagaagccagaaatacagatttntatgtcagatgtcctgattttttaagttgttggcagaaattaattcagaaatcaaatctgcaggccaaacaaggtgcaggacccagctttggcccatgccctngtaggnccctctgggcagtcaccgctggggtcctgggtgntctgncattgngggnggngggactgntgcgggtggcagggtatggggatgtnccagcaatgtggtcttggcccgttgcaagtntctnggcctngaangg

SEQ ID NO: 550975 - DNA, 155 bp, Homo sapiens
ggcggacctcttcttcagcccgcgatatgtctcctcgggggtccctgtcacccggtgtctttcttgaccactcgggtcctagatcaacctaaagctctcgctaggctgcccgaactcctgggttcggttgactggatagcaactgcgagtcatgt

SEQ ID NO: 550976 - DNA, 397 bp, Homo sapiens
gtagctgaaaggacaaccgtttgccagctaacaagccttggtgtgtataggcagtagagttaagcagctgacttggagatcaatacgaaaggcaagcgggtactgaggtcgaaaacgctatgacaactataggtgcttccttagccatggctgtatccccggaggtctttccggctgtgttcttgggcctgggggtcccgacaagcacagtcaccttgtaggtcacaggacatagggaatggggtgacccttttggtcttcactgtggaggtgcagcaatccccaccgtcatagttgcaaaaggctcggttggtgatggcatcacaataattgtctcccatgaagggctcacagcctttgacacagtgaatcagagcagggtgaggataccacttga

SEQ ID NO: 550977 - DNA, 851 bp, Homo sapiens
taagtgcggtaacaccgtcaaagagctagcggacgtcctccgagtcaagatattgtcaaatattttcagaagatggctgatcgtttggaggacatgccatggattatgcagtatctctagcaagacaaggtggagaggtagttgtgaagctataaaaaatggaagtgaatgttatgctgaaaagttctccagttgatagggtaagttgctacggacgaaaaagtggagaaaaatgttatctcttccataaaggatcagagtatccatctcacagtttcgattggtgaagaatctgtggccagcatggggaaaaaagtatcttaacggaaaccgcacatggtatcattgaccctatgtgagggaacaattaacttgtgtgcatagattccttttgtagctgtttgaaactgggcttgtggtgtaagataaaaggatggaatttggagttgtgtacagtgtgtggaaggcaagattgtagcagtgcagaaagggaaaaggtgctgtgtaatggtcaaaagctacaagttcagacaagaagatattacaaatctctcttggtgacttgagtgggtctgccagaaaacagaagacgggaggaatgggtcttcctaactatgcgaacacgcgtcgggcttcctgtcgacatgcatcctggacgtgttggaccacgcaggtgtgactcatgggcctcgtggcactggggggaccgaatggcatttcagagatgggcctccctgctggctgttggcggaccggcctattgggcaggaacgcgcgggcgccacggggtcacgggcgcggctgagcacgagacactcgggaaaagactcgcaggggacagaagggaccgg

SEQ ID NO: 550978 - DNA, 930 bp, Homo sapiens
gaaaatcacgaagatcctctggtctgtggatgaaatagtgaaggacctgaagcattgtagaaattgtgatgtggagcttcctaagcttaatttttccctagttagagggcctcaatcatttgcagtgcatctgtacatatttgtgtacgtatacatgacagcatcataggggaataaggaaggtatttgcagaaacatgatctatgttctgtctccgtcccatttagtaaagagattgttccaaaagggatcgctgtaacgagaatcggggcccacagtcttcccccatagatagcgcattccatgatgcagattgggcactgttagtaaatgtgacacatttggatctagctcttcagtttgaactgaggcagagatcgaaagacgttcctatacccaagaataaaggcatagtggtagttctttgggtatatgctatctgctagttcctgcattgccagcatctatactaagagtaaaagtttcggtacttgggtaagtatccgaaatcacatcaagtcggcccttcttctcaaggccaaatttgaaaaatcaactgggcaacatgggtctcgctaatgaaagttaacagaaaatcttcagacgttcagccaggacaacgcctaaaggcctctgaaagaacttccccttttggctactttttgggacaaactccacacgcatagaagataatataaggatacttattattccataaccaattttttatttggtccagcaacttttagcacctgaaaacttacggcagtttgtccaaaactacgccgtggagattagacttctggttgtcccttaaaatggggttggtgaaccaaatcctggtttttcctaattggctctggggttgacacttagacagccctgataggaaataacttacttgctttgccggaaattgcataaaactgg

SEQ ID NO: 550979 - DNA, 167 bp, Homo sapiens
atctgcagctaatcaggacatacttctggtgagcactgtgcggaaacttgaggatgaaatcagtgagctgcatgcacttataaaggcatggccctgtcctcctcacttgtagtgcaatggtccatcagaccacaagcccatattctagatcaattacatcatgatac

SEQ ID NO: 550980 - DNA, 155 bp, Homo sapiens
  misc_feature (123)..(123): n is a, c, g, or t
tattatttaaaaccccacataatacattatgataccctcaaccttaattcagtacttcatacttgtgaaacaccccataatgagtagttgaattttgggattttatggatcatccatatcaanagttatataacttgtggggttttttagttttt

SEQ ID NO: 550981 - DNA, 897 bp, Homo sapiens
cgtcctcaaggctctacctgcgtcagcttcccgagccgccatctccttccgcctctaccacgagctcgtagggcctggcacagattgtccgacgacgtgtaggagcacgacaagagaccgcagacaacggcgacgacacaggacagaggaaggagcggatagagaagactcgagaggagagcgacctgatagaaggactgaagggcgacagactccatgagggagcatgccgacatgacagaaacgggaacatacagcggcacgaacacatggaagcgcacacacataccgcaagggaatcaccggagagtcggagacagggcacatagcaagaatgaggcacccggggacaccgtgagcgcgatccgcaagatgacgcgcgccacgcgactgcaggcatgaacgagctgcacggacccacacagcgagagccacacgacagaggagaccacatacgtcgcatcccctgagccggaaggaataccaccagtacagaggccagcgcagtaactcaggaaggaacgtcctacccatcagaatacacaccagtaacagggcccctggacgcataaacgacagcggagcgacgcgcgaggaggacaggaagcgccccagtggagcacaacgaccgaagctccatcacagcatcctcgacagacccaggaagacacatgagacagccaagcgccaggcccagccccgcatggactgtggccctacatcggcaaggagccgacaggcgggcagcgtagacaagccgctggacggaccgccagcacacgtagacagaacgtgcgcaccgcggggacgcacgtcagcaccgagccccaccagcgtcgtcacagactgcacacgcagagcaagaccaagagcagagcctgcgaagacccaccgggc

SEQ ID NO: 550982 - DNA, 153 bp, Homo sapiens
ggatccttcgattggcgggaacttatgcagcgcttacctatcttaacaagctttgagtgccagacgattgaagagtacaaagtctgaccaagatgttgatgttggataagagaattctctgctccccagcctctaagttgcccgccaatcgaa

SEQ ID NO: 550983 - DNA, 391 bp, Homo sapiens
  misc_feature (135)..(135): n is a, c, g, or t
gaatgagttcaagaggtgtatgcgcgtgtttagtcattctccctttaaagtacggttaatgctgctctctatgttgtgcgatatggtcaacaacaaaccgcagccaagataaaccttccggataacactacgggntcgggtacgccgcttcactcctgctttcatgcaggcataacgcgttttggtctgaaaaaccccactttttgtcggatttgcaatccccttcgcaaaagatttgttcgtcagtagttgacctgaacggcggctcgctctatcttcttgcagccctgcgtatattgcggctcgcggatgcggacccctttccactcttcacgcactcttgcaggtattgacccttgacgccagggtaagcacatggcgtttgttacga

SEQ ID NO: 550984 - DNA, 269 bp, Homo sapiens
tttctctcacccagtacttttttttttcccccaaccccactttctgtaagaacagcctatttctaaaagctagttcaccaggcccagctccttgtctctggagcccacacctgtcatagccaaagccacagtagatgaatgctcaggacactactgttcccaggagggcactgcttgccaaggtttactgctctaagagtgttctcgggcttcagtctggttccatcaggcccagagaaaacagcagctgtaaaggcctggagacagga

SEQ ID NO: 550985 - DNA, 352 bp, Homo sapiens
gtatgtctcctaaatggacagatgccttccctttccgccctcccgtagggatcacaccaactaacaccagactcccaagcacaagattcttgctcccatctttctagtagggtttggggtgtggacccttcaggactgctgagtcatattgccatctggtgttctaactagatactatgctcatcttgattgcatatagtgtctcttatagatttgatctctttgtcatctctcatccaacttggctgtcattttgcacactgcgtcgtgtctgtgatcctcttggggatgctgatcaggtcgcacttcttgtttgcagtgggcttgctatccataatgttcttcttgacca

SEQ ID NO: 550986 - DNA, 160 bp, Homo sapiens
tgactctataggatcccagtccaacctgcacggtgcctctagtgagtgtcccccagctcccggtgccgtggtgagtgccccccagctcccggtgccgtcacagtgagtgtccccccagctcccggtgcccgtcacggtgagtgtccccccagctcccggt

SEQ ID NO: 550987 - DNA, 120 bp, Homo sapiens
gcctggtgtgataccgtcctgcgcgtttgttctctggagcagtgtctttatctccgaaccggcttctctcctacctaagtgcgtgccgccaccgcgatggacgatgcgatggacatgcaa

SEQ ID NO: 550988 - DNA, 291 bp, Homo sapiens
  misc_feature (192)..(192): n is a, c, g, or t
  misc_feature (202)..(202): n is a, c, g, or t
  misc_feature (228)..(228): n is a, c, g, or t
  misc_feature (253)..(253): n is a, c, g, or t
ctcctttgtagctgggattacaggcacatgccaccacacctggcttatttttttttttgtatttttagtagaaacagggtttcaccgtgttggccaggctggtctcaaactcctaatctcaaatgatccgcctgcctcagcttcccaaagtgttgtgattacaggcatgagccaccatgctcagccaatttnaaatattttnaaaatatttatgcagctctgtacgtngtcaaagcccattaagaagattttnacagagacagggggaggggatataagtctataattttt

SEQ ID NO: 550989 - DNA, 809 bp, Homo sapiens
ttcgacaggtcagccgcatcttctttatgcgtcgccagccgtagccacatcgctcagacaccatggggaaggtgaaggtcggagtcaacggatgtggtcgtatgggcgcctggtcaccagggctgcattttaactctggtaaagtggatatagtgccatcaatgaccccttcatgagccatcaactacatggtttacatgttccaagtatgattccaacccagtggcgaaattccatggcaccgtcgaaggctgagaacgggaagctatgatcgatcaatggaaatcccgatcaccatcttccaggagcgagatcccgtccaagagatcaaggtggtggcgcatgactgttgacagacgtagaacgatagcgatcggtgggacgtcccacttggacgatctttcaagcgcaaacgattgggacgacaagggcataggagagactacaattttttgcaccagggagagagaagaccacaacaaaaggtggatacatcgagttcattccatggatcacacaaatatcctggggatttgaatttggacacacaagcacaagaggggattgaccagatacccacatggccacgaacggcgttgaaacaacacccaaaatgggtaaacgccagacaggatcaattgggaaccacgcagcacaccacggcgacccagcattccccaaaaggaccaatctcacacagcatcccaacaggacaacacagtcggcacgattacccctagtgcgagcacccatgacccagagacgttgggcatgataaaccaacacgcccccgttggcccaaaggggct

SEQ ID NO: 550990 - DNA, 1283 bp, Homo sapiens
gggatgtgggaccctgggaacaggaacaggcagtggctgtgaatggtttcatctctgccccctgatcctgagatgaatcctgtacccacactgggtgtgaatgtctatcctgtctggtgtgtgtgtgcgtgatgtgtgagcagcatcgtggccagccagtggcacaatccactgacgcatgtgtgatcatagacgtgtgggatcatgtccatgcctcccatgcagtgacccaatactgtaatcctgtgatgaagactgacaaagtggacaacagtgggtggatccatgaggacatggccccacagccttgactcgtgcagtcccaagaaacctaccgtactctgacatgctcccttggcggcattgcaccttcatagcctgcatccatagtcatcccatggatgttgtgaccaggaccaccgggataggctttgccaaatcatatctacggcggagtccatccacaaccctgaacgctcactagtcacttgcaccacaaaggggacaaggcctccaaaggcaatgaaggcacaacacgcgacactgcttcacttgggaaggtcaccaaacaattgcacgagaggagcacgagagttgcaacaacgcttagaacacgctgggacggtacatacccacacgcgcgggactcccttgagaggtccctactttttccttgtacatcaaacatatacttagagggaatacgttatggaccacacgcagtttgtgaaaccccaatttggaccttggctgaggacccgcaacggcacccttccctccatgggcaacgctggcaaacacaacggagacacaacaagcacgacctacccaaacccgacgcaagtccacagtgcaaaaagcggtacagtagaggtgaaatggccgcaaagttgtaatacaccaaacacagtggaccctacaaagtaccccccggaaagcgaagcatcgacaagcaagcgagaaacacagagcagaacgcagaggcaaacggaaaaaaagagcgttcgagaaaagtatcgcgtaatttagtaaggacaagagagatactatggcgagcgtgaactacagaccagggccacaattgtctcaggggagcgccgaattagagaaatttgacgcgattacgtgcctgtgacaagacgtaccgagggggaaagatacatagcccaaccaagaggcgagagaccctagattaatccctcagggtaggaaactcccgagagaacagcaatcggaatcgagccaagcacgcaccagacactcactgagagacaccccaggac

SEQ ID NO: 550991 - DNA, 680 bp, Homo sapiens
  misc_feature (114)..(114): n is a, c, g, or t
acagatttgttcccgccaggagtttcttggtcagcccgtagccaaaaggccagaaggaccagtccagttgaggaaagttcttttggttttggcaagtttttggaagaagccaancagcatggtggctctaaagagccccagaatagcagccgccccaaggaccccgagcatgaaggcaagaagaggaggaaggaataggcccaggtctctccaaagtgaatgaactcttacccataaccctaatgatgcaagtcatatgggggaaccctttgtaaatggtcaggataaaaaccaaatctgggtgccagatcccagccctactttttattactggagaaatgggggggatagaaaattctcctttgaattatttagttttttttaaagagtgggttgggtttgggcttctcccccctttcagcatttatagaacatgctgccccccatacaaagtcaagaccccttacttttatgtgcccctagtagtttggggttaatgttttgggtaagacccgctgcatatgagtaaagttcccccccccccagtgaggaggaagatgttcccatactggaactgtcccgcccaataaattttgcccctattgtgctctgttttaatttggggtgggcaaagtaccctcttgcttggggccactttttgtttccaataaaaaccttta

SEQ ID NO: 550992 - DNA, 257 bp, Homo sapiens
acaatgtatggggaggtcaatggtcaagctcatcgtgcttggtactgatgccctatgatctactgggtgggcctggagtaagttccttctacctagcaggctctgatgcaatttggagctcattgatggtgagaatacccacaggtggcctattcagacgtcctggagctgccagagagggcgctgagccccgtggtaagtgtggcagccagggggcattggtgcagagtacggaggcttgcgctgacgtacgtggg

SEQ ID NO: 550993 - DNA, 401 bp, Homo sapiens
  misc_feature (387)..(388): n is a, c, g, or t
  misc_feature (397)..(397): n is a, c, g, or t
agattgctcgagtctgggagttcgaagaccaccctgggcaacatggcgaaaccctgtctccaaaaaaatatgaaaaagattagctgggcatggtggtgcacacctgtggtctcagcttctcaggagactgaggtgggaggattgcttgagcccaggagacagaggttacatcaaactgagattgcaccactgtactccagcctgggtgacagagtgagatcatgtctcaaaaaaaaaaaaaaaaaaagcttttgaatttcatccatgctgttgtgtgtatcagtagttgattctgtctttacattttagctattttagtggaattatggtactttttgttcttaatattcttacttggaaaaattgaaagtgtgaataaccctaaannaattcccanactt

SEQ ID NO: 550994 - DNA, 732 bp, Homo sapiens
ggtagtggcttcgtcttcggtttttctcttccttcgctaacgcctcccggctctcgtcagcctcccgccggctgtctccttaacaccgaacaccatgccttcaattaagttgcagagttctgactggacgacgactactttgacacgttgactgtggaacattggccaaacaactctgtgacctacttaagacccatgatggacagatttgggaactggactgactgaacggacgatgactgaccccaagttacctcctaccacaatgtgcaatgccagcaactattacaacaaaggtccattcacgttggtgcacccagagcagcaaggcatgacccgtccatccatccttgaagatgatgacgaacaagagcacacacagcgcaacagcatgcatatacgctgttatgggaccaaggaattccgtgaacagttgaccaagggaaccacgttcatatgcaactcattctggactggcgaaactcactttagaacatcaagaggttatgcttggatgtcgacattgcacagacgtgttggccaagtatgcatcaagagggacaaagtgcatggaggagcattcagcaaggaaccctttcacgtacttcaacacacagtgaacattagacacatcgtcgactacgggtaacaaggccaagtggtcgtggcacgtaagatacaaatatggtaccaaggtttcaacctgtttaggtggaaccctttgtgagaaag

SEQ ID NO: 550995 - DNA, 800 bp, Homo sapiens
ggcagcggggaaggcggatggagttatatcatcgcaatctgggaggacgggatccaaaaacgtgtgatacaggaaggccgaggagagctcccggaacttacaatgatgggaccaaggccacgtaccactaccggacgctgcacagtgacgacgagggcaccgtgctggacgacagccgggctcgtggcaagcccatggagctcatcatatggcaagaagtatcaagctgcctagtgtagagagaccatcgtgtgcaccatagcgagaagtgtgtgagattgcccaagttcctactgtgaacatcaaagcatagtggtcctagataaccacgctgagatggccaaagaagtactaccagcaaacatacagcacggtagggcaaagggacccctcactggaagtggagccaaaccggcaaaacaatgctagacagggtaaggaagcccaagaataacttagaaacacaaggatacaccacatgggccccaaatagctgaaacaagggggacggccccctagacaaaacaaagaaaaaccccaaaaaacccccctccatctatccaacattgcacaaatgctggaagagtaggaccaaggcccttgccaatgtaagcaagccagggaaccccaattggcccattgacaagacaacatggcaaggcacacggccaagaaaaacgtataattccaaccagtgcatgccaaaccagagtaatccagcgacggatcattgagaaaggaggaataaagccaagaacaacgaatccaattccttaacacaagaaccttaaaactaagga

SEQ ID NO: 550996 - DNA, 1029 bp, Homo sapiens
aggacagatattttgtatcaaaggaatactatgttttcacactacgtcaacttggttgctctgataccccagagcctgattgggggcctcccgagtcctgggctcacgccaagtccctggtgctgggtttgctctcccgctgaatgccaggggctgggaagctggaggggtctcttgagtgccatggacatccccagcttccagcccatgtacactagtggcccacgtagcaaggtggtcttcatttccatgaaaaagggactccaagaggcagtggatgagctagtggtgccccaacatttggtgctccagggctgtgtccagctgcttgtgggtggcacctgggaggtcaaaggtctccaccacatcaacctattttgttttaccctttttctgtgcatgtataatatatcctcctaaaaggaatttgcacgtgtgttttgtggaaggcactcagggggtggcacattttggcttgccatgattgcgatgattttgatggtacgattttcgatggctactttcgctcactttgaccttggccgatttgtcctcaacatggccagagtttcgtgccctgacatagcaccaataccctttgactactggcacatcccaatgtccccgaggccttaggagctctggaaattttcgtggtgaaatggtcttggccgggttggcggaggagtgccagccaaatagttcactgaatggtacaactctgtgtagctctcaaagactatatttttgtcactcaaacagttgtatataccggctcaactgttttattgcctatacgccatttgatgggtgatccttacggcatgttggcagagctctaagtgtggaatcatggactgacggtttgctgttggatcttttcccccacttgcaagggttaattctggatccccgggggccttggcttttaagaaaaaccgccgccaatgattttgtcccagaacaggggcccactgtgcatccccgtgggaaacctgtgctcatcttcatgtcgacggtaggctggag

SEQ ID NO: 550997 - DNA, 456 bp, Homo sapiens
ttaggagaagcgccggcagcgcggtggaaatgaaaaccgctgccttaacccaatagtttcgacactcttcgctgagacgcctagagggcagcagtgcgagttctcctaactctcccagacctagctgctggcatcactatactactaacagaccgcaacctcaacaccaccttcttcgaccccgccggaggaggagaccccaatctataccaacacctaatctgaattttcgggcaccctgaagtttaaattcttaacctgccaggcttcggaataaactcccatattggaacttactactccggaaaaaaagaaccatttggatacatagggatggtctgagctatgatatcaaatggcttcctaggggttaacgggtgagcacaccatatatttacaggaggaatagacgagacacacgagcatatttcacctccggtaccataacatcggtaa

SEQ ID NO: 550998 - DNA, 486 bp, Homo sapiens
  misc_feature (41)..(41): n is a, c, g, or t
  misc_feature (139)..(139): n is a, c, g, or t
  misc_feature (154)..(154): n is a, c, g, or t
  misc_feature (183)..(183): n is a, c, g, or t
  misc_feature (199)..(199): n is a, c, g, or t
  misc_feature (227)..(227): n is a, c, g, or t
  misc_feature (239)..(239): n is a, c, g, or t
  misc_feature (247)..(247): n is a, c, g, or t
  misc_feature (288)..(288): n is a, c, g, or t
  misc_feature (359)..(359): n is a, c, g, or t
  misc_feature (377)..(377): n is a, c, g, or t
  misc_feature (394)..(394): n is a, c, g, or t
  misc_feature (449)..(449): n is a, c, g, or t
  misc_feature (472)..(472): n is a, c, g, or t
aattcgcggccgcgttcgacacggctgcgagaagacgacanaaaggggggggctgctggggactcgcgtccggtttggcgacttcccggacgtaagtaagtttttttgggcccggtttcttgaagcctttgctttctcntttaatttttcccanttctaaggcccaacgattaccgcaattanccaagaccttgggganggagtttcaaacccgccgcttgcccgangaaagcttttancttcgctngaaccctaatgaaaggcaagttgtgggtttcttccaaatantaaggcaattcttgctttgggaaacttgtgttgtttaaaattaaacaagattgaattttaattttggtttnggtggttaataaaaaacnagaccccaaagcctccnaagattgttaaaaggaaagaatttgaggaaaaatttcccaacaagttccaaattnaattgccgaaactttaagggttnccccgggcccccgg

SEQ ID NO: 550999 - DNA, 424 bp, Homo sapiens
  misc_feature (25)..(25): n is a, c, g, or t
  misc_feature (27)..(27): n is a, c, g, or t
  misc_feature (34)..(34): n is a, c, g, or t
  misc_feature (45)..(45): n is a, c, g, or t
acgcgaccgctggcttgaacgcttntngaactgncgctggctgancttcatagcattcgcctactccgtgaagtctagggacaggaagatggttggcgacgtgaccggggcccaggcctatgcctccaccgccaagtgcctgaacatctgggccctgattctgggcatcctcatgaccattggattcatcctgttactggtattcggctctgtgacagtctaccatattatgttacagataatacaggaaaaacggggttactagtagccgcccatagcctgcaacctttgcactccactgtgcaatgctggccctgcacgctggggctgttgcccctgcccccttggtcctgcccctagatacagcagtttatacccacacacctgtctacagtgtcattcaataaagtgcacgtgcttgtga

SEQ ID NO: 551000 - DNA, 744 bp, Homo sapiens
tcccggttggggccccgcgcggggaggttgtctatcccaccctcggacccatgccgcccaaggccccgttgcatctgtgcgggtcttcgaacccaaaaaaacagcaacagctttgtgtggccgcacttgcaaacgcggaaatgtggtcttctctcattcagggtttgaacgggcggcccctgtggaaattgatttgacccgccgcacgtcatacagatacacggcgtgctgtggacccagtttctgctttctctcggacaagagagcgattgtgctgggtgttaatacatctccggtgtctccgttgataaagaggggtggctgggctcacgtgtgcgccccaagatattttgtgcttaactccgctcaggtctccatctctctcacaaacacgccctgtggtgtgcgcctatatttttcccccagagaaacatcttttgttggggatatgaagggctttctcacaaaaaaggggaaggatctccaaaaagaaaatctcccctacatctcccaggtatattgtagcaccgggaggaccccttgtgcgtgtgggatcagctgtggaccctttcagattccggtttgcaggaggtctccacaaagttttttgtgagagcggccgctgtgtggtgccccggctgcttctgtttacccaagaaaattccctatccccggattaagcgcccattcgggtgacctcaagaacctccctgttggttttatctaccccccgctttttggagg

SEQ ID NO: 551001 - DNA, 704 bp, Homo sapiens
  misc_feature (495)..(495): n is a, c, g, or t
tgggccctaaagggggtaaagggggtgctatacgggtaaatacggccccgtatttcaaagattttataggggaattaattctaggacgatgggcatgaaactggtggttggcctccacagattttcagagccattgaccggtagtatacccccgagtcgtgtagcggtgaaaggtggttgggttatagacgctccgggaatttgctctctgttttataaccctaagtgtggggacagcctcagtgagttgcaagacgtcttgggtgagtgttaacttatttattacgaatgtggggggctctcaacctcgggaagtctacatacctcgaagtgtgtcaacgtctcagaggagtttcgccaggttcgcccgtggtctctagggaaataacgtggggggaacgtattgtgtaggaagtttgaagatattagtctcccgccgtatactcgggtgttacctccgtaggttctcagtcacccatgtgggtgcgcccacantgtggacttgtgagtgggttaaagggcagggaactcgttggacccctcgattcgtgtaaatgttaacagggtatgtcgttagcggaatgggcaaggggccgaaatgagggcacttagggattgattgggcgggcgcagggaatagttttcacaacacggggtccatattcccctggaagcgttctgaaaattgtccgagcattaaataa

SEQ ID NO: 551002 - DNA, 924 bp, Homo sapiens
cgttcctgggcctggagggctgctttggggcaggaaactttggccaccaggcctctgacctgcaccaggagacactgggaggtttagtccccaaacccgcacagagcaggactgcagcctgaggaaagagcaaggatttcaggagagaggcctgcgacaagtgagcaggaaatagaaacttaagagaaatacacacttctgagaaactgaaacgacaggggaaaggaggtctcactgagcaccgtcccagcatccggacaccacagcggcccttcgctccacgcagaaaaccacacttctcaaaccttcactcaacacttccttccccaaagccagaagatgcacaaggaggaacatgaggtggctgtgctgggggcaccccccagcaccatccttccaaggtccaccgtgatcaacatccacagcgagacctccgtgcccgaccatgtcgtctggtccctgttatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattggattcatcctgttactggtattcggctctgtgacagtctaccatattatgttacagataatacaggaaaaacggggttactagtagccgcccatagcctgcaacctttgcactccactgtgcaatgctggccctgcacgctggggctgttgcccctgcccccttggtcctgcccctagatacagcagtttatacccacacacctgtctacagtgtcattcaataaagtgcacgtgcttgtgagtttaagcaagttatgcttggggcccaattggaggtccttggaacattgccttggaggcgt

SEQ ID NO: 551003 - DNA, 264 bp, Homo sapiens
tgttggtgtctctacaggtatcccctgcagcacacaacagcaggctaggggatgctccaggcggcactggtgcactctggtccgcgcattcactgattcctttatcaatgcgatgtccttgtgcaaccattgctgtccccaccggaagaatgggcagatttccatgtttcataggcatctctgcagtgatcccaccaatggccgaggtcagtggtctctgagtgtggcatgcagggaccccctgaccatcttcttcgggatctc

SEQ ID NO: 551004 - DNA, 308 bp, Homo sapiens
gcggccgcctactactactactgctcgaattcaagcttctaacgatgtacggggacatgaccattggattcatcctgttactggtattcggctctgtgacagtctaccatattatgttacagataatacaggaaaaacggggttactagtagccgcccatagcctgcaacctttgcactccactgtgcaatgctggccctgcacgctggggctgttgcccctgcccccttggtcctgcccctagatacagcagtttatacccacacacctgtctacagtgtcattcaataaagtgcacgtgcttgtga

SEQ ID NO: 551005 - DNA, 561 bp, Homo sapiens
  misc_feature (480)..(480): n is a, c, g, or t
  misc_feature (537)..(537): n is a, c, g, or t
cgttcctgggcctggagggctgctttggggcaggaaactttggccaccaggcctctgacctgcaccaggagacactgggaggtttagtccccaaacccgcacagagcaggactgcagcctgaggaaagagcaaggatttcaggagagaggcctgcgacaagtgagcaggaaatagaaacttaagagaaatacacacttctgagaaactgaaacgacaggggaaaggaggtctcactgagcaccgtcccagcatccggacaccacagcggcccttcgctccacgcagaaaaccacacttctcaaaccttcactcaacacttccttccccaaagccagaagatgcacaaggaggaacatgaggtggctgtgctgggggcaccccccagcaccatccttccaaggtccaccgtgatcaacatccacagcgagacctccgtgcccgaccatgtcgtctggtccctgtttcaacacccttctttntttgaaattgggtgctgttctggggtttcatagcaattggcttaattccgttgaaanttctaaggggggatggtttgggcg

SEQ ID NO: 551006 - DNA, 605 bp, Homo sapiens
cgttcctgggcctggagggctgctttggggcaggaaactttggccaccaggcctctgacctgcaccaggagacactgggaggtttagtccccaaacccgcacagagcaggactgcagcctgaggaaagagcaaggatttcaggagagaggcctgcgacaagtgagcaggaaatagaaacttaagagaaatacacacttctgagaaactgaaacgacaggggaaaggaggtctcactgagcaccgtcccagcatccggacaccacagcggcccttcgctccacgcagaaaaccacacttctcaaaccttcactcaacacttccttccccaaagccagaagatgcacaaggaggaacatgaggtggctgtgctgggggcaccccccagcaccatccttccaaggtccaccgtgatcaacatccacagcgagacctccgtgcccgaccatgtcgtctggtccctgttacacctctctgactgtgctgtctggctcatagcatcgctactcgtgagtctaggacagagatggtgcgacgtgacgtgccagctatgctcacgcagtgctgacatctggctgatctgcatctcatgacattgatcatctgt

SEQ ID NO: 551007 - DNA, 761 bp, Homo sapiens
  misc_feature (23)..(23): n is a, c, g, or t
  misc_feature (470)..(470): n is a, c, g, or t
gctcggtaccccttgcatgtacnggggagaaccatcccagtaacccgaccgccgctggtcttcgctggacaccatgaatcacactgtccaaaccttcttctctcctgtcaacagtggccagccccccaactatgagatgctcaaggaggagcacgaggtggctgtgctgggggcgccccacaaccctgctcccccgacgtccaccgtgatccacatccgcagcgagacctccgtgcccgaccatgtcgtctggtccctgttgcccctgcatggcgctgggtcattcattaggcgaattcgcgcattactgccgtgagagatctagggcatcatgggaatgatgagttgtgcagagcgctgacgcgtggggcccagggtcgcttatgtccttccacacgccaagttgcctggaacatctgggcacctgtattctggtgcatcgctcatgatccattctggctcagtactgntcatccacacgatgactagaatcttgccatggcgcctactggtactaggagtccaggatgggccaatcatcgttgacggccagggcacgctcatgccacgaatggagccggtgtaatcccgaacggtaactcctagatcttcgcgattccgtcgacccgtgcccccgcggaagccgagttgccgtgtagtcagggcccctgttattcctcgacagcggctttttctaccagagtgggcattcaataagagtgcgacgtggtttcctgggcatcacatataatacaaccaag

SEQ ID NO: 551008 - DNA, 195 bp, Homo sapiens
ctggatacagtatgaaataatagctaaccatgactgatggcagtatagatagcagtactctggaggtgacctctgacacagcccatcccaggagccggagtgaagctcattccccacactctcctgtgaacactggagtcttgcaacacccagggaagaacccactgtctttccccaggagggctccaggataag

SEQ ID NO: 551009 - DNA, 275 bp, Homo sapiens
gtcgacttttttttttgaatttaaaaaattccacagtctaatataacccaacgttctgctacccctgcaaataacaataataaaaattatgtttaaatgaggacaaagtttcggtatattgtttagatccgttaaattttcgatgcttttaaagatttaacaagcgctctattacgaggtcttcaaattatggctgcttctaagcccatctccttgtcgacttaaattaaaaccttcttaatttcacttaacaataattttggaacctgtcgacg

SEQ ID NO: 551010 - DNA, 677 bp, Homo sapiens
gtgaaaaactctgacacacacacactagtgtatgcctgcaaggatgagaattaatatcactgtgttccaccttcacatcttgttccactggaagggcttcagggacaataacactcttggagctgtcatttcgtatgataacaatgccttcttctggaatacctcctgaaggaactgcctaaggctctttacaggtaactcttttggtttatatgtagaaggagtacagtctatattcacaattaaaagccaagtatgaatggttacactggcattgctgcaaatacaacagctactacgccattatgcgatatgaatttctcagctccataatcttatggaaccactgtgataatatgccatctatcctcaactgaaacatcattattcggggcatgacatggttctcatttctaaatttatgcgagaaacatggccttatatctggtttttaaaaaagccatcattaaattcctccaaactcatatttactatctctttcataccaaaacacttcaaatatcacagtgaaatatccagttagagagtcatataacaaagtggatttataatgagctatgacttaaagttaacacaccaaagaagtcttctaaaaagtcttacccatacatattacccgatgaatatgtatgtggcatttctaacccacattcctg

SEQ ID NO: 551011 - DNA, 137 bp, Homo sapiens
  misc_feature (6)..(6): n is a, c, g, or t
  misc_feature (40)..(40): n is a, c, g, or t
  misc_feature (83)..(83): n is a, c, g, or t
  misc_feature (103)..(103): n is a, c, g, or t
tcaagncttctaacgaatgtacgggggacatgctaacaanattaaataacttaggttgaaagtggaccagatttctagaaagnacacacaaataccaaaactngattcaagaataaataaaaaatcaaatagaccta

SEQ ID NO: 551012 - DNA, 883 bp, Homo sapiens
  misc_feature (607)..(607): n is a, c, g, or t
agtgaaatatggctctgttctgctcagcccacaggcagccagacttcaaggttatctcacttgttccctgaacatcgctgttatcctgtttttttttttcaaggtgcagatttcatattggtttaaacaatttgtgcagttaacacaatcatcacagggtcctgaggtgacattcgtcctcagcttaggaagatgatggtattaagagattaaagtaaagacaggcataggaaatcacaagagtattggatcgggggaagtggtaagtgtccatgaaattttcacaatttatgttcagagattgcagtaaagacaggtgtacagaaattataaaagaatgaatttgggggaactaataaatgtctgtgaaatcttcacaatttatcttcttctgccatggcttcagctggtccctccgttcggggtccctgacttcctgaaacatttagatgtgaattggggagctctttaactataaagtttaatatctcaaaataataagagctatttatgacaaacccatagccaatatcatattgaatgggcaaaagctggaagcattcccttttgaaaaccagcacaagacaaggattgccctttctcaccnatcttattcaagcatagtattgggaagtcttggcagagcaatcagtcaaggggggtattcaaatgggaagagaagaagtcaaatggtctctgtttggccggtgaattgactggatactttagaaaccccattatttcagggggcaaaatgtgttagctggaatagcaatttcaggagggcccagtgatacaaattcatgtggcacataacagcttcttatagcattttgcagggaaaccaattgtgaggccccttcaaatggtcacggctaaaggc

SEQ ID NO: 551013 - DNA, 130 bp, Homo sapiens
aaccagcatctaaatctaaatccccacaagggatccgttagagcaagagaggccaacagagaagctggattgagcagccaggagaagcatccagaatcctctcacagtggggtcacacaccccatgctta

SEQ ID NO: 551014 - DNA, 926 bp, Homo sapiens
  misc_feature (358)..(358): n is a, c, g, or t
aggggttacagatctaaaccatatcattactcaaaaaaaaaaaaaaaaagaaagaaaagaaaaccccggaaaaggaactcacctcttttatcatcttagtatttagtactaattggtttaaagcaggagttgacaaactgtggcctggactcatggaccaattctggcccaccacctgtttctcagaagcaaaattttatgggaactcagccacacttactcatttacatgttgtccttgactgccttggtgtccagtgtcagaactgagtagctgcagcggaggttgtgcctctgggcctttaattattcacaaacagagcagccttataagccaacagaaaccttacttctcacangtttgtggaggctgggaaagttccaagaatcaaggtgtgtcaccattatttagggtctagggcaaggtctgcttctgggttaatagaaagcacctttcactgtgtcttcacattggtaaacaggcggagagctctggtatcttcagccccttataagggcactatatcccattcatgagagctccaccctcaggacctaatcacctccaaaaggccccatttcgtaataccgtcagtaaagttccattatatgactttgatggggatatagcccatagtaggtggtatgtccctgaaagcctaaaatatttcccgttgggctcttcacagaacacatatatcctgggcccctgttccagagcattcatcaagtcagataaagggttaaaaccagtcagagaacctaggtgccactggaaccatgtcccgacacataatggcgggaccgaaaattttaacgcgatgggaactgctgctcaaaatatccctactctacgatgtcccataatctcgtacggacattcagtattgaacttgccaatccttagtgcacaggaatcttggaaac

SEQ ID NO: 551015 - DNA, 127 bp, Homo sapiens
ccgcatgctcttttgtacgatgtcacccttccgccacaacaccacttcctgctgcttgaagtagcgccactcctcctcgtctatcatcaccagtttgaggtaatagcgcacagagaacttcttgttg

SEQ ID NO: 551016 - DNA, 141 bp, Homo sapiens
tacgtaggcaagagaccagtcagtttctggttgctttactggacggctgatgactagtactctgttcgcttggtaaaattctcagaagccagattgactctctatgtatcttgttgtatcaggattgaaccggatagcttg

SEQ ID NO: 551017 - DNA, 1102 bp, Homo sapiens
caactacagaatactcctatatttttgagtgcatatggaatattccacaagatagaccatatactgggccctaaaaccagtttcaatagatttcaaaagattgagatcttatagaactgtgtactctggccacgagtaacagtaaaactaaaatcaataacaagaaaatatctagaaaagcccgcagagtacctggagggttaaagtatcgtttcttctagttaggccataggtcaaacgaagaaatcaatacacggcaaattcagaccaggcatgatgccatgcacctgtaatctcactgactagggatggcgacgatcttaggatcacttgcagaccaggtgttcaagaaccagcctgggcaacagatacatgatcttgtctcctgatatggtataggttgtgtccccatctcacatcttgtcttgaaattgtagttccaaataattcccatgtgattgtgggagggacccagtgagtaggtacattgaatcatggtggtcggcgatcattctcactccttaccatggcagatagtgacataagtctcacgagaatcataatggttctctggacgaggagttccccttgcgttaagctctctgcctttgcctggttgcatcaggcgtcagattgtgactgtggtccttccttgcttctcctgccgtggtttgtgaagtgttttctctgcccctcgtggacaagctggaaaaattcagcattagatgccgctctttccgtctctggctagacttggctcccagcacctggagcatatagtccgttgcattcagatctgtgcttgggttaactgcgggaacgtaagttcagcacacctcttcagtaacaactacgaagaagcatggttacgacattccgacgactgatatgagtgttactgtttgcgcccgcgagtctgcatacatgggacatttagcatcccattgtcaagtcacccgcagctaatcaatcaaggaaagcgacttatctctccacggtgacatattcattgcagctccacgatggaggttcacaatgcgattcaggcctgcaactcatatttagcctgccgcattctcgaaccagctgtgcctacgatggt

SEQ ID NO: 551018 - DNA, 251 bp, Homo sapiens
tatgctgccacagttctcagttcatatggctatcccatcaccctttatttggagaagtgaacgagagaaggaaattagtgatgataaggcaagagaacagagaaaggtgatacagaagcggaagcttaagatgctcacgaatagccctagatcgaagatgtgcgtccaggtgaggtggatgacagccgtccggatgatgatgaagcatcctctgaagctcaatgagcaatactttgatcaggcagcaccat

SEQ ID NO: 551019 - DNA, 161 bp, Homo sapiens
  misc_feature (38)..(38): n is a, c, g, or t
  misc_feature (141)..(141): n is a, c, g, or t
agacagagcgagactctgtctcaaaaaaaaaaaaagtnttgcaaagttggccaggctggtcttgaacccttgggctcaggcagtctacccaccttgacctccagaagtgctgggattgcaggcatgagccattaagccctnctggccattcagaaatctaa

SEQ ID NO: 551020 - DNA, 500 bp, Homo sapiens
tacttacatccgctcggtacctctactcgcgggtgctgtagccccagctaattggaggctgaggtgggagaatggcgttaaccccaggaggtgcagcttgcagtgaactgagattgcaccactgcactccagcctgggcgacagagcgagactgcgtctcaaaaaaaaaaaaaaaagaaaaaaaaaagaaaaaaaaagaaagagaccatgggtttctgaaagcaaaaaagaggaatttgggtttcgtgaaactgcaggttccattctctcagggcctctcatttggtttctggtgcccatgatttggcctgtgagagatagggggtgtgcctggtcctcaaagctcatgcaaatgggtctctgtttctaacaatcatttgtgcccagatttggatggtgactgatgctctactaattgctgaaaaagggcagagtggaagcacagaaaggggggctctctgaggagggtgactttagagcccatgttgaaaggcagaggc

SEQ ID NO: 551021 - DNA, 279 bp, Homo sapiens
  misc_feature (54)..(54): n is a, c, g, or t
  misc_feature (118)..(118): n is a, c, g, or t
  misc_feature (197)..(197): n is a, c, g, or t
  misc_feature (267)..(267): n is a, c, g, or t
ttgggatttcaccatgttggccagggtggcctcgaactccagacctcaggtganctgcctgcctcagcctcccaaagtgctggaattacaatcatgagccaccactcttagcctctanaaaaaaaatttttttagttagcaggtgtggtgatgtgcacctttagtcccaggaggctgaggtaggaagattgcttgancctggagaggtcaaggctgcagtgagctatgattatgccactgcactccagcctgggtgacagagtgagnccctgtctcaag

SEQ ID NO: 551022 - DNA, 453 bp, Homo sapiens
ctaccggggcccctctacacctgcgccctttcccaaaccaggcgtggataagaacgcgtgtttctaaacgcaccgggatgtattagtacctgagcccccccttttaacaataagggttaaaaaaattgcaacacctacttgttgacccggcgatcaagttttcccagcaaggaaactaaaaaagaactcctttctctttataaaagaacacacacccagggcagttgttctacatccccaaaagcacagtgcgttccattcgggatccctgcgccccaacctgccccgctttctcactcaccaaaccgttgataaatataaactctctgtacacctatatccggtcaaatacacccaccggaattgtccctcttttcgatctctctatacaacccttttcccaaaaaaaagggcgtaaattttgaaaaaaaaaaaggaccttccccaaaaaaa

SEQ ID NO: 551023 - DNA, 120 bp, Homo sapiens
aggtgaggatccaggagagagaggccactatttctcctggaaatatcaccctgcatatgtggaacagtttagagtattgctcggtaattgcaatagtgcatctcccggtggtgtaagaac

SEQ ID NO: 551024 - DNA, 1158 bp, Homo sapiens
  misc_feature (1158)..(1158): n is a, c, g, or t
aggtccccggcgccagagacgcagccgcgctcccaccacccacacccagccgcgcccgtcgtatcgcctcttcgtccgggacgccatctccgcgccaccgccgtccgcccagacccagtcgcacacccgtccgtcacgtccgatggtccaccagggtccgctggtccgtcgttcctgcctgatcgccaggagtgtctcggcggtgccggggcaccgaagagaccggcgcgacgcctccaagcctgagcagcgtacgaatgacgtacggtccgacccagtcaccatacgagccgtgggcgagcagcgctgagccaccgagcaccatgccgcagggcgtcttacagccgtcgggtccgccggtgccggcggtgtactgccatcgctgcatccgtcgttgctcgctgcgagccattgcgaggaggacagggcatgtgccgcgggcggttcgcgcgcttccctgcacaggacctctggtcggagacatttcttctgcttcgaggcccaggaagtggcccaattccaagagctaacgcggacgttgtccatagggataacaagcacgcagccattggcaaaacagaccgaaaatgggtcgaggacgccttggcaccgagacgcgctagtaagtgggaccccggcgtataaccggaaacagagactgcaaccaatcggcacgcaaagagatcggccgacctacttccccattgggataggcccacggcgcaagcaaagttcaaagccattcccataggcgtacgggcccctggtaagcattccggccacgcgataggatgtccgaaagggcggcccccaaaagggccaagaagtgcaagcgcggctccattggtggggggagaaacacattccgtaaacgcgaaaaggaagcaaggcgaaccgaacctggccaggggcggaacggcgttggagcggcgcccagcggaacagagagggaatgcagaagcgccagcgccccatagaaccccacaaaatgcgcgagaaccgaacaagagaggcccccaaggagcggtcacccggaaagggaggtcacggagaacggccgaggccaggaatcggagacccccgattggggcacccccgaagggcaaaccgactatctcaaatagctagcccatatcgccccgggtgacaaagatcacn

SEQ ID NO: 551025 - DNA, 474 bp, Homo sapiens
gtgccagaaccctttggtggccgggagataacccctttgggctctggcatcccttattcaaccgtccccccaacttcttatgatccaaccctgggcctccccctaaagagggggcacagtgtttataggctttccctataaaattaaaaaagcgcaagtcctattcttgccacaggggagccctaccccccttatccccatcttagttattttggaaaccatcagcctgctctttcaaccaatagcccgggcggtaggcctaaccgctaacatttttgcgggccccctactcatgcccctaattggaggcgcccccctagcaatatcacccattacccttccctgtacccttttcattttcccaattctaattctgctgactatcctagaaatcgcggtcgccttaatccaagcctaggttttcacacttttagtaagcccctcccggcggggctcccaaaaaaaattataaac

SEQ ID NO: 551026 - DNA, 106 bp, Homo sapiens
gtttcatcttgcatcgtgtgtgtgtagactttggagtgatagcaacctttgatcctaagcccattccttggaactctgaatggtgcagaactgtcataccatctgt

SEQ ID NO: 551027 - DNA, 901 bp, Homo sapiens
cgctgttaattcctgcccgggcccccttgtgcgcgctccccgaaagtgggtttcgggggagtatacacccgcggtccgcgcggacgggagagaaaggccgtgccctgcttcccccaggggaggactgaccaaattggcaaacgggcctgccttgtcaggcaaaaaacgcatggaccccctgcgtttacaggaccccaacgagagactcttgtcgtggggaaaagttcaacccgcgcggggtcacctccccctaggggacccgcacgtcctaagtcggcggtacgaccaagtaatgccaggcgcacgccccttctagaagtcgcctctgctccctccggggtggccacctgagaccattgctcctccctctggaagatggtcgccactgcaggcccctagggtggggccaccattttccacgctcacctggaataggtgccccacctcatactcggcacacttctggtcggagagtcaccccccctgccccaccgtgcccccttttgtgcggaccgacgacaacttgccgccgccccacttctctgcgagtaggtctcaagcagtctctcagggagccaccggccggtctgtctccgccttaccaccacgagcccccaatggtccacgcgggtcgatccctgcgaacacccccggccgacggaaaatggtggctgcgatgcagtgcaaggggtccccgccataggcgtggtcgaagaatgaattttccgcctggaggcggcgactcaccgccgagacgttgcggccaacgccttgctacatcgctgcggggccgattgttgttgccttgacgacccttctctcgctccttcacgcatactgtggtcgcaccgcttcccctccgggaaggtggggcgccctaaaagacactcaccacatgaca

SEQ ID NO: 551028 - DNA, 254 bp, Homo sapiens
  misc_feature (4)..(4): n is a, c, g, or t
cggntggggacggctctcacagtacggtgctgaaactccctactatattggtgtcctctcagcaaggctcaaaagcacggacggggtctcattcttttggtatccctaacactgagcaaccggcagggcagagaacagaataaatatgggctaaattctagagattccatcattaagttctgcccaccaggtcccaaggattccggctcaccggtactggtgagcgcaactgatccaggtagagagccgggcag

SEQ ID NO: 551029 - DNA, 448 bp, Homo sapiens
  misc_feature (125)..(125): n is a, c, g, or t
  misc_feature (243)..(243): n is a, c, g, or t
gagcttaagtatgccaagcagttcgccttgagcccagtggccctgaagaagctccgggttaaaaagctgaaaaagtttttggatgcctggggggaaccatccaaaggctgggcagaaaagtttgnctccatccggaagataaatgaattgatgcctaaatatgcccccaaggcagccagggccggggccgatttgtagtttgcccaatttttgttgcccctgagggggaaaaaccggttcaangggttactcccaaaacagcccttttggaaattttttttttaagggggcccccgccaaaccgggatcaaatgtgaagcctggggctttcctgatgatgcgggccctccgggccccccatggggggattcccttccttttgtgggggggggactctagggcttcaaagggggtttgggattttttttttaaagaaaaaaaattttta

SEQ ID NO: 551030 - DNA, 429 bp, Homo sapiens
  misc_feature (258)..(258): n is a, c, g, or t
  misc_feature (388)..(388): n is a, c, g, or t
  misc_feature (396)..(398): n is a, c, g, or t
ctcgacgtacagctgtttgtgtgtgtgcccgcgacagtctcgggttttgatgggcacaggatgggcggcaaaaaggcaacatttggtgggcaaaaacagaaacgcctgtcctcatttaggtccatggcacaggcccgaggttggagcccttgccagggatcctggccttctgtactcagcacttcgctgcccctctcctgaatcacatcaattaagaactttcttcaccaccccttcgctgtcatccttctctctccnctattcacccaacatcatccgggaccagaactaatgtcagcaaagcaggggaaggaagtaaacttctaggagtagaagaaaggatgaaaaagccaaccacaaccccctttcttcattaaaggcttccctntaccgtannngaaaacaactttgccattttgataatcaaaa

SEQ ID NO: 551031 - DNA, 218 bp, Homo sapiens
ctatgcatacagcctatttcagaacttctggcatgttgctgtaatatttatgacctgaaagagaatcaagtatttatctgtctttgagtcacatttagagcaaagtgactggcacacagcaataaatgaatgcctgtatgttatagctcagcaatcacaggatcttctttttcctcgaatcttaaaaacatatgtttcttacaagggaggtcttatgc

SEQ ID NO: 551032 - DNA, 458 bp, Homo sapiens
ggaaaaacagggggcccactttgttgccctggcttgtttcaaactcctgggttgaagcaatccttttgccctggcctcccaaagcactgtttttacaggggggagctactgggtccagcctgttttggtttttaacaaaaaagtttaaaaagtaaaaaaataaaaactttaaaaattggaaaaaacttttgaaataaagattttaagaaaattttttggaacagctattccatatgtttgttttaagctaagtgttttaagagtcaagagtttcaataaacttaaaagtttgtaaaataaaagtaagctccgggttacatttttgaagaaagaaacttttttttattaagttaggggggcctaagggtcccggggttttaaaggcaacaggagggggtgggaatggcctaggcctttacattcacttttcccttatttactggctcaacccaagcaac

SEQ ID NO: 551033 - DNA, 137 bp, Homo sapiens
atccaaagaattcggcacgaggctccctcttagccaatattgtgcctattgccatactagtctttgccgcctgcgaaggcgggtgggcctagccctactagtctcaatctccaacaaaaattggctaggctacggac

SEQ ID NO: 551034 - DNA, 311 bp, Homo sapiens
catgtcagtatgaagtagacattatctatagatatcaaaccaagtctgaattcaatcataagtcttattgagtgaacataacggatcttccactctcccaagaatcttatgtttttaatttaatttaatttcttttagagatggagtctcgctcttgttgcccaggctgtagtgcaatggcatagtctcggctctctgcaacctccacctcccgggttcaaagcattcatttcaaacatgaatatattaagtacagaattacaattccttagcttgaaattatgctgtgaaagtttggttcatgctttgtg

SEQ ID NO: 551035 - DNA, 227 bp, Homo sapiens
ggttcagtcggctcatgctggtataccagtactctggaaggctgaggcgggtggatggcttgagctcaggagttcaagaccagcctgggcaacatggcaaaatcccgtctctacaaaaaataaaaaaaattagccaggtgtggtggcgcatgcctgtagaccaagctactggggagacaggtgagaggatcgcttaagcctgataggcagaggttgcagtgagccga

SEQ ID NO: 551036 - DNA, 979 bp, Homo sapiens
  misc_feature (77)..(77): n is a, c, g, or t
tccgcgggggcgttgctgtggtgggggcctggtcctctgcaggtttccagcgtctgttttgttgggcggtcttcttntctccgtgtggggggaataatatggggcgcaagattgcttgccgcgacgcgcggataggggcgccccgccacggtttgtttgaggaagagttgttgtcgattgtttcttggcgccgccgagtgttgttggctgccgtgttggggcgcccccggatgggtgagttgggcgcccccctccgttcccccgcaggggcgccctcttctctccgccgaccgcttggagatgtgtttttttttagtgaagattgctccccgctcacggggcccctgtcggttttcagcaccttcccgcacgctttctctcgataggagtggttacaaccccccccgactggcggtctgtgggcccaaaactggtgtgggggcttcctcggagaccgtctcccacgagggccacgcgaggtgttccgcgagagcgcagcagtttgtgttggtgctgtggtcgcaacaaccgcaagtggggagaacccctctcgctggtggggacaacccgcgtgagttctcaccccctcggggagtgggggagttcctcgccagccccccgcggtgtgacttcttatcacctgatgaaagagagcagtcgtattccaccctgtctcggagcaacccaggggcctcccaccgcgttattggggagtttttcatccccctcctcgagagccccccacatttgagggagggttagttcgtgccccctcgacaagaaagtggggaccgaggacccctggagggagagggtgcgcaccccacctccacggggaccctcttttgatggtatttaaaccccgaaatttttttttcccccgaaccctttccttatcccccccccccccttccactccctttccaattaagggcccaaatttttccaagggtttcccctaaggaattttgggacccca

SEQ ID NO: 551037 - DNA, 432 bp, Homo sapiens
atgtggtcgatctctagcaggctcccccgttactggcatttaggggtgtgtaaaagaaggaattggaagagtgataggcatgggagtgccttcatagcaaacgacttcttccgcttctgtccttgtattttccctacggtgcttcatgtgtgtacttcattacatcatcagctcagttgttcagaagtttgtcctactaattctatagagaaagacttacagtagccacctagctgagagctctagccctgtgcagagtgttgctttaaatttggttttccataatagatgtacgttgatggtgaaaagcgttcattcttatcaccttccatttccacttctttacatgaatactgaagaaaaatccaaagcttaaaggaaatgtgcccttctatatgatgggtgaggggaagtagtacatttgtacatttc

SEQ ID NO: 551038 - DNA, 170 bp, Homo sapiens
  misc_feature (42)..(42): n is a, c, g, or t
cgcatcttctcccatcagtcatcaggatcaagcagaagggancagaactgaatgactgaaaaattacaacgttaaaagtcagtgctcactctttctgcttctagaaaggttttgctgtgtcagcatgaatagcgaaagaaaattgaaaacagaggggctgatggaacgca

SEQ ID NO: 551039 - DNA, 844 bp, Homo sapiens
  misc_feature (115)..(115): n is a, c, g, or t
  misc_feature (228)..(228): n is a, c, g, or t
  misc_feature (272)..(272): n is a, c, g, or t
  misc_feature (375)..(375): n is a, c, g, or t
  misc_feature (397)..(399): n is a, c, g, or t
  misc_feature (402)..(402): n is a, c, g, or t
  misc_feature (406)..(406): n is a, c, g, or t
  misc_feature (408)..(408): n is a, c, g, or t
  misc_feature (411)..(411): n is a, c, g, or t
  misc_feature (414)..(415): n is a, c, g, or t
  misc_feature (417)..(417): n is a, c, g, or t
  misc_feature (621)..(621): n is a, c, g, or t
  misc_feature (642)..(642): n is a, c, g, or t
  misc_feature (709)..(709): n is a, c, g, or t
  misc_feature (714)..(714): n is a, c, g, or t
  misc_feature (734)..(734): n is a, c, g, or t
  misc_feature (736)..(737): n is a, c, g, or t
  misc_feature (755)..(755): n is a, c, g, or t
  misc_feature (840)..(840): n is a, c, g, or t
gcgactgagagagccagaggcagagaggggagggggaccaaagccgggacggggagaggaaggggacgcggggccggtagcggccaagcagggggcaggggcgccaggctgtgancggcacccgcggaccccggacagggaccgccgacccggaccccggccggaccaagccagggcggaacaggaggcgcaagccccagggggccgggggcggcccccggacaggcnggcagagcagggggagcgggggggggcccagcagccgcggcgcncggcgcgcggcggcggcggggccgggggcctcggggcaggcgggggcgcgggcggcgtggcacggcgggcaaccaccagcagccgcgcaggggaagggcggcnagcaacgggcacggtgcgcggnnngcnggcncngcnggnncnggggaaacagcggaggagcgcggcggggcaggacaggaacggcatccgccaggcccaccagggggcccggcggcgcagggggggaggggccgacgcccgcggggggcggcgcaggggcctcgtgctgctgggcaccggcctgaccctggccgggctggccgccgcccctgcccctgctcggccgctggcgccatgctgtctgtnggcattgctctggctgccttnggctcgcttttgctgctgggcctgctgctgtatcaagtgggtgtgagcggacactgcccctccatcngtatngccactccctccacccacantnnccatttcttccatttcancatcttcatcatctcattacattattcttctttccttcttcactataccacatccatcatttccatcctcatcttacttatccanatcc

SEQ ID NO: 551040 - DNA, 812 bp, Homo sapiens
gggggaagaagttggtgtttcgctgggaccctgggtactgaacgtacgcggctccggggctcggacccctatgatgttatcctactcacccaactgccccgacacccgctcttttactcgtctctcactctggccagagatgaaggcgtgcaggcactgtggtgaagtgagataccgtcctggtccgaactatggagaactatgagtctatgtctaagtagttgtggtatcagtgcctgtgaccgaattaacaatgagtaaggctcactgaatcatggctctagaggaagacactacctaatctgcttataaaatctactttcgcgattgatgtttaggcgcatgacagttcaatacccaggtaataaattaattaagctgtaaactggatgtcacaagatttgatctccactaactggcatttctacggtaaataactatggggcaagactgaagatttgtatccacagggagccaaacaaagctgctgtgctatatgatgctgttttctttatttgtcgtctttacatcaatcttattcggattattcaaactgtaggtgatgcatgtacattgtgaatttggaactttgttccagcttgaatggcttgcagtaccactttgtactacaaatccagcgtcaaaaacattcctagtgtacaagatactgtggcatttgtccacttgaaaattgctgaagttttgcttattttatcaactcccgattagttaagtacaagtgagtctttgaatacgcggttcttaatgacctcattttagcccctatttccaggggttactgaaagggtttt

SEQ ID NO: 551041 - DNA, 938 bp, Homo sapiens
  misc_feature (365)..(365): n is a, c, g, or t
  misc_feature (807)..(807): n is a, c, g, or t
gatgaccgagcaccattgagccttgcgcgaaggaacaagcactgttagcatgggcggttaaaacggagaccacgaaacatgagtgagttcgccactcgcgagtctatgtcctgatccatgaccattccggtccatgtctcctgagacagtgacctgcctgttgctcgtctcatctcatgcgagaatctctaggctatggtgagcctcgcgatctagctccagcgatgctctaaacgagagctccgagtatatttagcgattcattatctgtgtcgtctttatggtgtgctgttgctagtcttagagtgccgatgtctttgtcgcggttttgcagcatttgctttcacgctttgcattcctccganttattcctttcctggtccttttcttttcttcgcattggttccccgtgtggtttatattccccatggccatgcaacctaatgcgtgtgctctctcgtgccgagttggggaattcctatgaacgcgcggtgccccgacacggatggttgattgccgccgctgtgttcgggccctagcttgtgtgacgtagcccagattcggatttttggataccccttctagccggtttttgcattccgtttctaacgtatcttaagccacgaacttggggtctcaccatatgtccctacggggcgttgtttcccttgttgctattgttcctctccttcccttatagcaatatcaatcgttatctttgatctccattgacatatcggtgcagaggatctcttcggtatatttggcgttcgagggacctttcaccaaagcgatcacagacccaangaatgctcgagcattgaacaacggaatggggttagagccaaagctccgaaatggaaccctcttttgtgtatgggcttgctaccgaacgacatggttgaactttcgtgattacttcaagaaggatgagtcca

SEQ ID NO: 551042 - DNA, 203 bp, Homo sapiens
gagctcggcaccccatgcatcaccacgcctggctagtctttgtatttttagtaaagatggcgtttctccatgttggccaggctagtttcaaactcctggcctcaagtgatctgcttgccttgactcccaaagtgctgggattacaggcgtgagccactgcgcccagcctccaccaaaccatccttgaaaaatcccagctattc

SEQ ID NO: 551043 - DNA, 193 bp, Homo sapiens
aggcgaggtcggattcaaacccttgccttgcggatgatgcctgggtggcagagtcctcgttcatggagcgcaagtatgatgtctagtccctcttctggcaacccaaggtaggcgaaggcgagccaaacaggatggatagacatgggcgatgggatccctgtgttgggaaagtgcaatgcatccacttcgagca

SEQ ID NO: 551044 - DNA, 271 bp, Homo sapiens
cttgccagcagtatgattgagatgggggctagtttttgtcatgtgagaagaagcaggccggatgtcagaggggtgccttgggtacctctgggactcagaagtgaaagggggctattcctatgttttattcgctatagaccattatgatatattaatagatgagatattgatatggtagtattaggttataggttcacttgtccgagacgacgtatacttgttgaagaggatagctatctagaaggattgtggactgcggttgcttgccgtg

SEQ ID NO: 551045 - DNA, 798 bp, Homo sapiens
tccccccctatttttcccgcgctttcctgcccccctctgaatttccccacaattttcacccccccacttgtctttccccgaaaataagtttatacaagtcgttccctgtaccccccccccaaatcggttaagtttcccccaaagccccccgcataacatgtgtgccaacaggcgttgcacaaaaaaaacatttgtctatgagaatcgcctccccacacttgtgttttaagtcacgctccacgcacgcggttttccccgcgatttttcttcttttatttttcgggggcgacgtttggattaactacttccagaaaagtctttgtcttcccgcccccttgtttttctttctacgcgcgaaaaaaaacagactgtgcgtgtgtttttttagtgctgactacacgcgggagaacccacactatccgtcctattggtgaggaagtaccacctccgtggtaggaggaacaaatctttttcgagattttttttaataatacaaacatatatatccgtcgcgtttgtaactatgctcactcgatgaaaacggaattccacccgaacgactgtcgccatcacaaagaagatatgaataagtatcaaattctctctctccctctaattatgcgtgttattattaataactatatcttttcctataattgcgagtttctttatcacacaatgtgttctacctcttattttaatttcttaatcttgaagaggttaatggttttattctaaaaacaaaatcctttttaaaggtaaaaaagaaaaaaatcgaattatcgtcgcacaaaacaa

SEQ ID NO: 551046 - DNA, 791 bp, Homo sapiens
  misc_feature (260)..(260): n is a, c, g, or t
  misc_feature (266)..(266): n is a, c, g, or t
ggtgactcacccggcagctaggtagatgcgaactgtcagaactcgtcagcgtgatacacgactatccatgcagccgttggggtctgcgctgtgatcgtgcctggcatcgaggtacaaactcaacaggctatctgtaccgagaggatcgtcgacaatactgtacgcagtgacacgtgttcacggaaccgccactgccggtctgcgtcgtgaccaggttgacatgctgactatctcgcctagactaattgattatggcatgncattgntcgcctgtggggccactactgatcacgctcgcgtgcagaggaatgacgttggggacctatgtcaggcgatgggtgaacaatacggttgaagtgtgtgtaccgaagcggtgcggaattgagaacggcgtggcagaacgcaaggtggcgcgcaggttccctcggggaatcgtcataattcatgctatcccgagccatggcatggggccagagtagggaaacctattacagtgccactaggtgggccgaatccttgtacagaacggttccatgaagcaaggttgaatggtctgcaacaaagcgatgatattttacggtctcctgccgccagaactggcgacactagggataacggaactggagtatgagttttaccgacggctggtggacaaagccagttgctcacctatcgcctgcacggtgagtcgtggcgtgaacaacgtgatcgaaacgtccggtggtacatacagattaacgatgaacaggcggcgggcggtattgtcctgtgtggatacttaccggtcaatg

SEQ ID NO: 551047 - DNA, 373 bp, Homo sapiens
  misc_feature (40)..(40): n is a, c, g, or t
  misc_feature (78)..(78): n is a, c, g, or t
  misc_feature (94)..(94): n is a, c, g, or t
  misc_feature (164)..(164): n is a, c, g, or t
  misc_feature (237)..(237): n is a, c, g, or t
  misc_feature (263)..(263): n is a, c, g, or t
  misc_feature (315)..(315): n is a, c, g, or t
  misc_feature (339)..(339): n is a, c, g, or t
  misc_feature (365)..(365): n is a, c, g, or t
taattgactctccacacttaaagcactgggtatgagaaanagccacaaatatacataaagaattcagatcacaaaacnctctaggacattggcngggcgcgggggcccaagcctgtgatcccagcccttcgggaggctgaggcagggggatcacaagggcaggngaccaagaccatcctggctaacacggtcaaaccccgtctctcccaaaaatacaaaaaattagccggatgtggnggcgggcgcctgtggtcccagccacngcgggagggctgaggcaggagaatggcgtgaacctgggaggcagagcttgcngtgagccgagaccgcgccactccnctccagcctgggcaacagagccagantctgtctc

SEQ ID NO: 551048 - DNA, 685 bp, Homo sapiens
cctcaagacagcccagggtcaaactttggcacttcaattcaaacaagtttccccccggtttagccatccgggggcatttaagcaaaaattgtttcttgcgtgtatcacaaagttcaatattgagagtaagtccacaaacaaagtcccttgtcagggcctccaaggctccccaaacatttaagtttctcaaaaagcaaaatggaagaagcaggttcaccacggaaaacttgcgcagcaaagaaaatcaagtttttttgttttatgctaaacttttacaaactgactgtggtagtcgtggcaatctcatgccattcagaacctttgattggcaacagtatctttgttcatttgataacaaataactcaaattttaaattaaagttagtcgacaacatctttcaaaatcttggaatcgtgtcgggggaaacaaaatacaagagatatgatttgatgtgaaagaatttaggacctcttggctttgattaaattagggtgtgcttctgttgtttcactgggattgtgaaatgttgggatgaggagatatgaaaaatctatagctgaatattctgttgatggttttaaaccatagaaataaatattcaggaagtctctattgagtagctctatagggtaatgctagctgctagagcaaataaactcacgtcttaaccatcttggccccgga

SEQ ID NO: 551049 - DNA, 665 bp, Homo sapiens
ggaacaatggtaattgtgggacttaacaaagagtgagtacagctgaaggagccggggagcagaaagtatatgcgtcaggtatgaggaagaaaatagattttggaagttatgagaaatgtagagagtgagttgagcatagttcgtgatttttagggcctctaaaattattaaagcagcggcagctgctgcatgcagacatgagggctaggctaaaacagtaaggtcaagtcgttcggacagaaaggctacagggtgcggtcctggctcttgtgtaagaattctgaccgcactaaccataccctaggaaggaaacggagtcgtcgttctcgtacgggattcgcggtctcgcggacgattcctcagaacgacccatcagcacgggagggcaacctgatgatcccagtgaacgacctgcatgccgaccgctagagtaaaccgggcattgggcacgaaccgcacccccttccggacgcccccccggagcagggcggacttcaccccccgaacatccccatctccgcgacagacaatgagcactccggctcggaacggccacgccacaacccgccactcgaaccgcaggctcagcagcacaagaataccacgacacgcaccgcagccacacccaacagcacacgcacgccaccccgcacacaacgcgccga

SEQ ID NO: 551050 - DNA, 343 bp, Homo sapiens
cagtagtccctgtgcctccttatagctggttttattaaaaatatttattgagagccaggtgtgatggctcacactggtaattccagcactttgggcggccaaggcgggaagatcacttgagcccaggggtttgagaccagcctaggcaacatagcaagccctgccctgtctctgcacaaaatttaaaaattagacagttatggtggcatatacctgtggtcccagctacttgggaggcagaggaaggaggatctcttgagccttggaggttgaggttgcagtgggctacaattgcaccactgcactccagcctggacaagagagtgagactctgtctccaaaa

SEQ ID NO: 551051 - DNA, 740 bp, Homo sapiens
ccaaaagctaaccagccaattgctctctctttgtgatataattactcccttatgaatgaagtatcaactacataagagaaggaaaagaacgatttcgtatgtatactccctaaacacaccgagtttactgcgtacagatctagactgtgagcatatatatgcctacttcgcagtgcatcgcctgctgatgtatcactgctgctgctttcgttgtcttgagtcctcaaactctgctttggtagtgcttctccgaggggagaacatactggagctggtgttctgcaagacaggccattctttccgaagccttttcttctcaggtcctctttcttcttggtgacctctttcgcctcatcctttgtgaggggacggcactcctcatcattttcaggatatttgctgccaacccatagccttcaatatgctgtcctctgcttctagatgatgtgtgagagaacctcttctttcttccactgagcgagggggggcaacgaccattttgatggccgtcttcctccccatctccgttgcttctaggtgtgctgtcgcctccatatcttccagttgtgactctcttattcgctgagatgtccccttccgttctcctcgagttgcagcctcctctccgtggttgtcggcgaccattcgcaaggaggttcatcggggggggcggacgcctctggggaacggctcaccgcctgtgttcacggtttgtaaccccgaagaagagctcccctaca

SEQ ID NO: 551052 - DNA, 818 bp, Homo sapiens
tcctataaccaaccttttatggggtgcttccaaggtcccaggccccaacccaggcccggtaatccaaaattctccaacacaatcttcctttcccctcagaagaagccttcacgagttctacgtggggaagaagtgaccatttaggccaggcaagtgtgaccccagaagtggactcgtggtcgtagtattgcccaggatgtggaggagtctcgggaagggagaaaagttttagcccaagagccctccctaggtagaaagtctcagagttctaaattgtgtgaaaatttgcgcaccagatagaatagacgttcacccctttgtctctcgtgtgtgacacccagaacagacaagaggggaggaaatctccagacagtgtgcgccatgtgagtgagagacgccccacgtgcagtctcttcggtgggatatccctagcgggagcgcgtggtggacacctcgatgaaacatgtggacaaggaagagaggcagagtcctggatgattggacgcacctccccatacgagacgactggtgatagcgaccgccaagagggcgccacctctagtagacgatacgaccccctaatataggaagagtttcactccaaaccagaagcgccccagcatcgctatgaggagagcgggtcgtccccaaagagactattataatctactccccttcataggcaagtgcgcgcggctaatcgccaagtaggggagaccagccccaaaacacacgaggaagaggcggctcgtctctatattaagcggccgggcccaacaagaaagagaagtgatgacgcacctctatatgatccaccg

SEQ ID NO: 551053 - DNA, 124 bp, Homo sapiens
gtgggtacgtctggtgccctcggacatcgcgtgcttggcagctcgccgggcagcagcaggcgcacggccgtctggatctcgcgggatttgattggtgcgacgctgcttgttgtagtgcgccacg

SEQ ID NO: 551054 - DNA, 649 bp, Homo sapiens
atggcgagcatgttctgcgtgcatgtcgataagcagagctgtacttggggagaaggagggaggtctcgggagtgtagcaccatgccaaccagccctgcgcgaagacagagtgagccacgcccggatggcagggcatgtttctgttttggtgtctcactttcctcccagcgtgacttatttggggattcctcagggcctactggaatgtgactgacccactgcaccagactgcctcgggatacaagtcctggccctatgtcccagctgtcagagggcatcagaggaatccatacccagccacactgtcctgggatggagtgtcagcaatccaccccattggttgatcatcgagagccgaccatccacagtcctgggtgaagatatttggagccaccagggactccacttgagccaccttcacgataggaaatagacacgatgcttatttaatgcaggacactttgagtgttacaaactctgtagacctggcagataacggtcatgaatgcttcgggaagcggtgtagtgccctaggattggtagacagaagggacagacacttgtgcacacggtgtctttggtgatggggtaacaaacattacataccttacctcaaaccaacaaacacgtatgtcgcacttcccacacc

SEQ ID NO: 551055 - DNA, 457 bp, Homo sapiens
  misc_feature (124)..(124): n is a, c, g, or t
  misc_feature (163)..(163): n is a, c, g, or t
  misc_feature (279)..(279): n is a, c, g, or t
  misc_feature (317)..(317): n is a, c, g, or t
  misc_feature (358)..(358): n is a, c, g, or t
  misc_feature (450)..(450): n is a, c, g, or t
agagcacaaaggaaaaacccgcaaggacagcacacacccaagcccaaaccaaagccacaagcggagcagggccacgaccagcccacaagaacaggaaccaaccagcgggatggagaccagaccnagcaaaagcaaatggaacaggcaaaccagcagacaggcnacaccgactcagccaccaagcgccccaagcacccccaggcccggcaaccagcccctggacaccagacaaccccccagcacccagagcagaggcagccagcaggaaagacgggcaangcagcaaccacccaaccgggccccaggctccccttcanccaacacagccagaaccccccccccaaacacaagtgaccancagaaaaaaaaaacaacaccacaccccccaccccatcgtgggtgagggtatcccctgtgtgtcccaggccaataaaatctacctgcccctgncaaaaaa

SEQ ID NO: 551056 - DNA, 114 bp, Homo sapiens
cccagtccaggaaagctcagggctgacaaaagagcagtttgctcaggacgacacctgggaactcgccccggctctacttctcagagggtttactaagaggggcttacaatggtg

SEQ ID NO: 551057 - DNA, 131 bp, Homo sapiens
  misc_feature (21)..(21): n is a, c, g, or t
  misc_feature (29)..(29): n is a, c, g, or t
  misc_feature (124)..(124): n is a, c, g, or t
acccaaccgggcggccgccgngggggggnccacccccgagggattgttcgcctcaccccccaccccatcgtgggtgagggtatcccctgtgtgtcccaggccaataaaatctacctgcccctgncaaaaaa

SEQ ID NO: 551058 - DNA, 857 bp, Homo sapiens
gcaatcctccaacctcagcctccaaaagtgtgggaaatacagtgtgtgagccactgcacccagcccccaccccttagcctttggctctcgggtcacttcacctgtccaggcctcagtattctcatctgtaaaaggggagtgagaactcctgccctgatgacctaagtagggtttggtgagactcaaaggaatcaggggccagcatagagtttcacgaggctaaaatttcactcgacaaatttaagatgtggggtaatttatcagcaatttatgggtcgagtctggaagtcttctggtgcccagattctaaggggcagtgggtctggaaggctgaagtcctacctggctatgaaaatgtggctgggaggccagttagcttgaacctccagtgcgaccattctgcagactggacaggccgctgcctcctgcctcccagttcgcccctgcctgcttgcctgcctgtccctccttcattaccgtgtcctgcttacggggggaccagcttatagggacatgcgtgggtatccacttctctcccataactgcaaagcgcatgcaaaacaaccacgaagggacggtggggaacacaccagctggggatgaagagaaagggcacgtggggctgaataggggggaactgagaaatagaacccccgtgctattgaaccaaagcgaaggcgggggacaccaaacggacacgacggtatctaagaaggcaaccgtaccggacccataagtccctccgaaggggaggcggacacacagggactacggacaggcaactaaatcaaaaagaggcccagttgctctcacgacccaatcacaacgatagagcaaggccgcaaacgacagagaaa

SEQ ID NO: 551059 - DNA, 625 bp, Homo sapiens
  misc_feature (252)..(252): n is a, c, g, or t
  misc_feature (348)..(348): n is a, c, g, or t
  misc_feature (367)..(367): n is a, c, g, or t
  misc_feature (489)..(489): n is a, c, g, or t
tgaccgagctgatgtcttctgagggcctgcttcctagttcatagacagccatcttcacatggcagaagcaggctaggaagctctctggggttccttttataagggctctgatcccattcatgaaaactctaccctcatgacctaatcacctcccaaagggcccacataataccatcacattgggggccagaatttcaatatatgaattttgagggggacacaaacatttggtctcttgtaggctaggacacngcaagaggtgggggagaattgtacaaaatgaggttggaaagggaggcagacaccaaatcaggtaggcttggccatatatacctctaatctttctanttgggacccttctagcttngcaaactcaagatttacctcctccaagaaggcttcctgtataatacataccacattgttctaattattattttattttgtttgagatagggtctcactccttcacccagtctggatgtagtngtgtgatcttgtttcactgcagcctcaaccttctgaggcaggagaatcgcttgagcccaggaggtggaggttgcagtgagcagagatcgcacccctgccctgcagcctgggtgacagagtgagaatacatctcaaa

SEQ ID NO: 551060 - DNA, 541 bp, Homo sapiens
tgcagacggggctcccagcctcgaccagccccggaacccccagcacggggacgtccaatcttttggcttccgtgggccacactggaagaagaactgtcttgggccacacataaaattaacactaacagtagctgatgagctaaaaagaaggtctgtgcctaaagctcatgttttaagaaagtttacgaatttatgttgggctgcattcatggccatcctgggccactcacagttgcgccagagcctcaggagcacaggccgagcacctgccctgcttcacccagggacggggccctgcactgaccaggaggctgttgccctccaagtcgtccctgccgggaacagcaaagcacacaaacctccgagagacctaatggctgcatcctccgtgcagtgggcaccacgcttgccacctagaagagtgggtttggcagatgtcagttaataacaaggatgtaagttttaaaatcacgtgggggtttgtaaacttgaggaattacagcacaaacacttccatattattaaaagaaacagactggga

SEQ ID NO: 551061 - DNA, 237 bp, Homo sapiens
  misc_feature (77)..(77): n is a, c, g, or t
  misc_feature (89)..(89): n is a, c, g, or t
  misc_feature (125)..(125): n is a, c, g, or t
ggaaatacacacatggggcaaagatatttgctcaaggagccttgagatatgggtgttctatataaccaaagctattnaaaattatattnaaaatgtagccaggcacggtggctcacacctgtaancccaccagaggctgaggctggaggaccgcttgagcccaggagtttgaggctgcagtgagccatgctcacatcactacattccagcctgggtgacaggaaagaccctgactct

SEQ ID NO: 551062 - DNA, 300 bp, Homo sapiens
  misc_feature (259)..(259): n is a, c, g, or t
ggtcgacgtgcagatgtcgcgacaggcgacataatgtacctccggcgtgcggccatccggtcgttgtgcaccagacctcgcggagtcttgaatggccttgcggaatcgtcgctacacactgaaaccaaggttcgttccagagtccacgcattattcgttctctccctcgtggtcatcctcgaccggcatcggtgcgggtcacggcggcaccgtgctggcgatgttgttgcacgcgatccaacacctggcctatggtatnggcaggacagcctcaccagccatgaaagcttcctgtcgacg

SEQ ID NO: 551063 - DNA, 1892 bp, Homo sapiens
  misc_feature (1138)..(1138): n is a, c, g, or t
  misc_feature (1244)..(1244): n is a, c, g, or t
agagatttctgagatctcgcacgctccatgactcctggattcagacgatgtatcgacatctacgccaagagtggaaccaagtctctgtcacggcaagatccccgtacgacaatcacgccaataggatttttcatgcgattacctgcgacaaacctagctctgtggcaagcccgtgatgcgtggctaattcgacacgaaattctgatatctagtcatttaataaagcatgtcaagcgcatatatacatctcgcttgtgagcaatacataggcgtgttgcatgtcatgaacttatgatatagaagacaggacagtcaacacagagacagagcaggcgaaggtcctgcaaaatggatgatacaagtgacgccactgagtatctgacgagtgcacactaaccataggaagctattgcaccaaactcaacgtcactacacgtacaatgaactgtcctttgtttggaggttgaatacggcttctcgttacatgaagctgagtcgtgggaattccgggtatcatacgcgacgcagttagaggaaattaaccactacaagtcgggaagggtaccattgtgggaacatatagccgagcaaggatactcttttcgtgcgacccaattgtggtgctaaagggtgcatggcacctatacgacatatttctcacgtgccatgcgttagttttgaaatggactcatgcgtacgcggtgtgcacggcggctgcggacacagtgtccaggcgcaatttctcgtgcatggaattgcgtctatcacagggcttacataacctttaactaatcaaataaggacttaaaaaatcgttgagcgtgaaatcgccacgagtttggtcttttacacaacacactaaatgaccatagcagaatataaatataagccgttgggcagcagacgccgggatcgtacactgaaagaatagtttatattgcacccccataacggagggagggggggaccccctccaagatggtcttttaaaacagcccgatattaaatccacaagaagactatattgcgttatggtacaaaagaaaagaagtctagtggggggcgacccccccaatatatctaaaggtacgacaagaagtcacgcgagacaaactttatcatcattaaagggccgagntctataaggaggacacaacaatgtgttgtaacccacgggagtgacagtagtatatatatacaaccaaaacagtggtttcgatgatagacacatgtgtggacagaanacacagctagggcgatgtgaccgccacatgtgggggagcacaacttccatatggagtagcaaaagaggaaaccgccgattgacacatacccatgtggtcagagtggttggaacccaacttaaaatttgggtgaccacaacagtatacaacagtataagaaagaatattataacagcccccttataagtggtaaaacacattatcacacaacgactctacataaccaacatgtactacaaacagtaccgacagtacaaacaaccaacatcacacagtccaacatcaattagacactaaaaacagcaatatgacacaacaactatactagcctaaccaccaggagtacactcgacatacataaaaacaatttttacgggaacacgtagagcgaagaaacgacatacacacaacaagcgcagcagcagaacaacacgaaagacaaggaaaacgagaagcagaaatacagacagcagcaacacgtgccagacagacacaaagaacaagaacaacagaacagacgaaagacaaacgaaaggcacaaaacgaaaaacaacacaaaagacacacacgaacgaggagaaacaaaaaaacacagacagaaaccaaaggtaaagcacacaagacgaccgagcaaacagcgacacacaa

SEQ ID NO: 551064 - DNA, 268 bp, Homo sapiens
cccgccccccccccccccatatggacaaatgataatagggggtggaatgtcgtcagtggccaacctttcccagatttttattttgtttctgtcttcaacatttttgaccctggggtaatagttatattcaggacatgaaaaaaaactcctgtgttgaaagccttttaggaaattttgccaggatttttggcccaaacctttttttgaaaaaaaacttgttaatttattctattttaatttgccaatgtccataaaaagttaagaaata

SEQ ID NO: 551065 - DNA, 110 bp, Homo sapiens
gccaagcactctttactacaatagggcaataaggatagcaattcacatacagtgtgattagtttcaccataccacacattatgggggatggcaaaaacggggtctaaggc

SEQ ID NO: 551066 - DNA, 137 bp, Homo sapiens
gggatctatacaacactagaagccaatcagacccagcaggcatatatacaacactacaaaccaaccgggggcgcaacaggcttatatgcagcactacacaccagtggggcccagcacacatgtatacaactctacaa

SEQ ID NO: 551067 - DNA, 136 bp, Homo sapiens
tgacggtgttaagaaggtcatggaagagcggtggaaccaggcatagtcccagcagctgccattcccttcagatagtctgagcctctggggaggcgattcgagcacaagccaacggccgatcattgactataatctg

SEQ ID NO: 551068 - DNA, 552 bp, Homo sapiens
ggacgcgtgggtcgacccacgcgtccgattttaataaatgctcattagtctgtaaaaaaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagagaaaaccaaaaagagaaatacaagaaacaaaaagaaaacaagcgaagaagaaagagcgacatcaatgacaaaaaagagagcacagcgagacgagggacagagatgaaagcaggaagaacgacagacgaagcgacccgcgcacgcgcaggcagagacacaagggcgaggataattaaaggatactgatagattataaggagatactaaggtagacacgtgggagtgtgatgacaaatatgaagatagtaatgatgattaggtagaagtggtggtgtataaatgtgtagttagtaaaaaagaagtagaagagagtaaatatagaagaggatgagcagtgttttttttgtgtgttgttgtttgttgggtgatgatagaggaggtagataataatatg

SEQ ID NO: 551069 - DNA, 372 bp, Homo sapiens
  misc_feature (15)..(15): n is a, c, g, or t
  misc_feature (18)..(18): n is a, c, g, or t
  misc_feature (27)..(27): n is a, c, g, or t
  misc_feature (46)..(46): n is a, c, g, or t
  misc_feature (180)..(180): n is a, c, g, or t
  misc_feature (243)..(243): n is a, c, g, or t
  misc_feature (274)..(274): n is a, c, g, or t
gcggaaatggcttantangcagatgangtggtctttgacaaggttngattgaaccagagcacttattgcttaaagaataacagagttctagagctgggggttcttgggccatgctccgtgtgtggataaggaaagaaatactgtttctgggactctcccacagtcacaaagctgttttcnctgtggcccctacatctcttaacttttgctattactcctatgctgccttccggattactgctngtctatcttcttgctccactcactgaagatnctaattataatcccatgaaaatgtaaattacagtttacttgggagagccagattttctctgtgctcttgagttttttattcattcaagaaaccttggg

SEQ ID NO: 551070 - DNA, 351 bp, Homo sapiens
cagaaaagccaacatatcacttggctcatgattttcattcacaagacacttttgacaattgaggccaatatccagaagagcccttataatctcgtcttaagtggtcccttaaatacgttaaaagcccacaatataggcatttacaaggcttttctaagacttccagctcttgaaaaattcacaccttcacagtttcaaatcacccacttaagttgttaagggacagcgaagtatgttgatctgctgcgtatgcaagtctgacgcctatctttcaagtgtctaattcacttgatcacacccacaccacacacaacacaaccctctgacacaggctgtcgtggacaacaggag

SEQ ID NO: 551071 - DNA, 1321 bp, Homo sapiens
  misc_feature (306)..(306): n is a, c, g, or t
  misc_feature (420)..(420): n is a, c, g, or t
  misc_feature (458)..(458): n is a, c, g, or t
gctcaggctggaagagttccttggcctagcatggcagcgagtaccattctggtgaaactgttgggccctgacgtgcggagtggccgaatgcagaattctcaggagacatggcgactgcatggatcctgtgtcctggtcgaggagtcgctacgctgcagcgctactagcttcagacgttggatagtctagactgtgtgccctgagccgaatccgcgaactaggcctgtcgtatgactgtatccatacagaccaataatgtgagttgccccgctgattaccctggcattgaggtagcgcttgacggtngtatcgtatctggtgtgggacttctcaagttgacgagattggtgtaagctagtgccccggtaacctgcagggacattacggatcggacaattggttgcccaaggcgctggctcntgatagaagctgtcttggtcaagttgtggccactcatnagtttccagacacaatcttggcctcttgcatcggaagggtgcgtaggtagccctttgcagtggcgttgatgcctttgcgacgttccgtcggaagcattcgtgcattccttagcgtatgagtgcacagctttggacgcccaggacccattgaggcctttcttaggtgccccaaaactagtcctcgcggcatggaatggggactcgtttggtttcaataggtaccccctttgtaacgcgaaatccgggcgcgcacaacccgcgttatgggccccagcgttgcctttgtcccctttatggacagcgtcccaccccggaacctaatctcgaccggttggacccaagggacgcatctttggcgatcgcgttggttgccccgggaagcattcgcacgggacggtgaagccattgagaacattgcggcgcacacacgtgtccgacttctctaggcgcaaaggaaaagcgttaagcaaacgcgagagagtagctcccctttggggccacgggggtacacttcctttggcgtttgtgaacgaaactgcccacgtttggccccctggggcaagttgggtcccttagtacgcggattttccccgccaagtttcttttccaaccgagcagtggttggcgtccccattgtgtgaaactggcagacacccttgtgcgtgcgacatgggcagcaagttgtgttcagagccgacactatatgggtgcgccccaacgagccgttgggctgtctccgcacctgagagagttccgcacaagaccaccgaaaggggaagcacaacactcggttgaattccggcatgggcggatgagcgatcgtactcgtagtggacacacgcgttttccgctggtcgagcgaa

SEQ ID NO: 551072 - DNA, 460 bp, Homo sapiens
  misc_feature (143)..(143): n is a, c, g, or t
  misc_feature (168)..(168): n is a, c, g, or t
  misc_feature (423)..(423): n is a, c, g, or t
gacttctcaggaccgggctggaacgtgcagctcctggccgggacactctgtctttcggggaagggaagtggcgccgatggatccgtgccgctcgggactgagccgccacgagggccctgtgcagctcgccattgttgcctgtngcttaggcgctccgctgcccgtcgncggtcccagcgacagggtctcttatccatccctgcaagttctgggctcagaatttgtcactaaggctgctaactctaccttgattctgttctgccctcggtgcagcagcctttgatatagtgtccttgtgactctagcatgagacttcaagcagttggctcactactggagaaataaaggatattgccagattgactctcctgtctgtagcaatgttagcctcaagcaagaggatgaacagttcttgacgttctnaaatgcttctaaggtggaagtcagacaaggctcagag

SEQ ID NO: 551073 - DNA, 82 bp, Homo sapiens
acggaattttaatctttaaagcgatacattgtctattattttagtacatgacgtaaaccttgtccccttctgtcgtcttctc

SEQ ID NO: 551074 - DNA, 187 bp, Homo sapiens
ccccaattgaatccattatcctgactgactcttctgatatacagcagttggccagtcacaatgacagaataatctaaagttaaccagccagatacctttatttcattaaagtggttttgattctccaataagttattgtggcgaaccagtgtggtacttgggtcacgagtgcagttgtgttcctata

SEQ ID NO: 551075 - DNA, 210 bp, Homo sapiens
gatgctgctggttgactctatgagtgatcccctgttaaccagtctattgggatcatgactacctggagtggcactggaccctgactgtgcagacccactgtgctgcctgccgtgggttctgtgccctgcctgtcccgcatccctggccaggtgccggatactggggcgaatacatgcaatgtgtgacctgcccctgaggaccctggagag

SEQ ID NO: 551076 - DNA, 793 bp, Homo sapiens
aatctggcacgaggctgaggcggcggtgtgagactccctctttccctccctcctcctccgtcctgccctgtcctgtcctgcgcgtctgtcctgttcggccctggtcctggccctgaagcatggcctggctgtcagcttcagctggccacctgcctggagctgctggctggcttactgatggatgtgtgatcctgatgatggagatgctgctggcctgactggtgctctgtacacatatgaatgatggctccgatgacctcaatgcttggcagcatcatgtgatgaatgtgggtgcttgcagtgagctttcgtggacacttttgagaaccagaagtgtgatgtacggcttctgcagtgtcaatggactcccaatgctgctctgccaaaatactgtgctcatcaacttgggtgggctgaagatgtgcctgatgccctgcaagtgcgcttgtgccagccacgtggctaagtgtggcagagttcttccagtggtgtcgacgtgatcgtgaacgccagcagctgtggaagacatagacgcgggtgccatctgggcagcgtgctctctaactgggctggctgctgactctccagccctgtgctgcaccgactgccggctgcgagaggatgagaacgcagagcccgtgggcaccacctaccagaagacggatgcagctgtggaaatgaagcggataaccgagagcaggtcggggacaggcacgaaggagaagagctgcggaagaggaggaccggaaatgcgccggtgagaggccaggttcgacatagcggtgggcaggcg

SEQ ID NO: 551077 - DNA, 224 bp, Homo sapiens
ggtatttgggtgcgaggggagtgacggagatgtagtgttttggatgtgaggggagtgaggagatctcagtgtgtttgggtgctgaggggagtgaggagatcacagtgtgtttgggtgccgaggggagcgaggagatcacatgtgggttttgagtgctgatggggaatgaagaagatcgcatgtgtgtttgcggtgcctgagggggagtgaggcagatcacagag

SEQ ID NO: 551078 - DNA, 178 bp, Homo sapiens
gcgaatgcggtatataggatagtataaactagttaaatgaagaatggttatgttagggtttgtacgggtaaaactgctattattcatcctatgtgtggtaattgagtgtgtatgcataagattttgctgtagtctggagttatggtttaactccactctcagcgattcctcgacaagc

SEQ ID NO: 551079 - DNA, 748 bp, Homo sapiens
tatgtgtcatgtatgtgatgaagtctgtgtgtgtgcttgtgcacacatgtgtgaaaatgctgggcacagaagaagtgttacaagttgccagttatcgtaagtcctttaaaggggcagaaattatatgtacggccaagtagaatccatacattaggtatgatttaaagacttactgatactctttaagcctctcctgcagataatagttcgctttatttcttactcatttcaagtttatgggtttgcaaaattttgtaaacttttgtgtttttagccttgtattttttacagcctagaatcttgcaaaagtctgaatattttttaaatgttctatcttaactaggttcactaatacagtatttttagcagacagcattttcagacagcattttcataccaagttgacttgtggtctccaatcttactgggaaggccctggtagtgtaattcttttccttatcacacaggtaaccaagtgcctctaagtcatgcttatttgtaacaacaaagaagagtatattgtacctgctcaaaattttcctcggataatcgttatataattaatttctaatgatgaggacatgtacacagttgccagtaagaacatagtatgcatctcacttcacctcacgcatggctactggaatcactttctcccggttcttgccaggtggaaatcgattaagccattctccttgcggttgttcgcagtcaatcccctcgcctcagatgccgcccacatctcagg

SEQ ID NO: 551080 - DNA, 540 bp, Homo sapiens
actgtaatgttatccttaggatatctctgtttttacaaacttagatgaccttttcttcactgcttcatttgggttgtggaagttggtcatacaagttgagtgttgtgttcttactcatgaaaaatgtttgcatgaatttttagagtttttacatatttcattgagtcagtgggtttcactaaaacagctgtgtgtcttattctccatgtctggaaaatcctgccgtaataattacatttaccccagacgactactctactgtgttaaaaagtgaaaatatttataaaagattttgtggtatttttaagtccttaagttagaggactaaaccttttttatgaatgaaaggataatctctaggaaatgttagtttatgatagtttgtaacttgtgaattttggtttccagacatggagacaaaaccaaccaaaatactgtcaagtggaacgtaaaaatattaattcagaattcattttattttggcaagataaatttaatgaagaataattaacatgctttggagaaagtgataaaaacatg

SEQ ID NO: 551081 - DNA, 737 bp, Homo sapiens
  misc_feature (17)..(17): n is a, c, g, or t
  misc_feature (19)..(19): n is a, c, g, or t
  misc_feature (24)..(25): n is a, c, g, or t
gcccatgaaacctgagncnttatnnactcgtacgcctgacctgattacgccaaccttggcactaggcggacatcgcagagactgcggaagatctgacccggctgcgtgcgctttagaacgcaggatcccccgggctgaggaattcggcacgaggttcgatacctaaccctagcccagtaacgctcctggtgaaaagcccaaaccagtgctaccgcgacttggacctgagtggctaccgcggatggagtgtgggccaccgttaagcccacactgaaccgagtctaccacctaaggttcgcgttcagaggaccataagtttattaatcttgggaaggtgatgttggatcaccgatgtttcagggacttgcttacaaagtcatgaaaaaacatgcatgcttagcatctggagtgcaatgtgaagaagacctttatgaatgccagaaataaactctaaagtggttgaatccacagaggatcctgctggttctaattgctgacagtattctgaggattcctaagtgatggtttaaggcattcggaagttcttctgaactcttcttctcctgggtgggaattcatatttttgccttgagatactcaatagggcttttaaggccagggttctggtttactcctgttcattacccttgggagtgttatagctattcctgatatcatatgttttaattctctatttaatttcatactaattttactaagctaatgttagtttttgg

SEQ ID NO: 551082 - DNA, 291 bp, Homo sapiens
gcaacagaatgaaactttgtctctatctttttttaagttgtttccccaagatggtagattagagactttcagcttgcctcagccacttggaagtagcaagatagtgcataaagatcaactctgcaagctttaatttacaaaggaaagtgggaatccaccagaatcatgaatgacatcttagatcccaggacggagcgcagaggctaacagactctgtgacagcacctagctaaaagaagtgagggaagccccaatacgtgagaggcagaaagcctccctctgtgatgcacc

SEQ ID NO: 551083 - DNA, 211 bp, Homo sapiens
acaaaagagacgtgtttccacctgcccatattttgttggaaccatgtaagctctggttgccatttctggagcgcccgcattccagaatcggcgctcaagcgtgtaatactgtcgttgctcagcaatcgttcccgttgcgggccagggcggtaaatccggctgaagagtattcacaacggtcttcatttcagcagaaataaggtccagaaca

SEQ ID NO: 551084 - DNA, 932 bp, Homo sapiens
cgcttcaacctcctagtgtctgttagcatcttccttttcatggggggagggaagataaagtgaatgcccagagctgcctttttcttttctttttaaaaattttaagaagttttcttgtggggctggggaggggccggggtcagggagagtcttttttttttttttttttaattactaaatgggaacttttaatcccatattaatacaagggggttggaactgggacatcctaatggatgcaattacggtcatcacccagctggattccaggggggtgggcaaactcatcgggttctggtccggagaggctccacaaggcccacccgcatcgccattctggtagtctctcagggtcagcttgtgataacaggggcaggcttgcgttaatggggcctagatttggctggcagatataaatccgttggaggatctcttctctttaaccatttttcggggtgctcatcactctctctttctctctctagcttttaattcaggaatatttccgggtctgggctctctctctctcggggtttcctccagccctggtctcggagacggtggtttcctccctggcccattatcttttcacctcccaggtctaccattcatgggggtcgggggtccaggctaagggatgagcgttggcatggaaagcatagggggagggacatcccggtcaatgtaggacgggtggctaaccacgtggcatactagagggaggtggtgctaaaagtgtgggacccgtgcccaattggcagaatggggcagggcgttcaccacaaggttacttgtgggacgcaaaagggcccaaagttaaaggataaggcggcaacagggaaatcccgagaggctcgggaaaccgaagaaacacgcagctaaccgtgatacaaacgaaaagtaaaacgaccgagccgcggagtatgaacaca

SEQ ID NO: 551085 - DNA, 184 bp, Homo sapiens
  misc_feature (182)..(182): n is a, c, g, or t
ggaacaaaattctagggttaatagcatgggatattagttcaaatggaccttcttctctactttccaacctcactgtccccctacagctttatttattcacacaaatatcctaaatactgaaaataattgagattaaaagatctagtgtaaatatccacaaagaggtacattttttttttcanaa

SEQ ID NO: 551086 - DNA, 145 bp, Homo sapiens
ccgggcagaatggctccctgatcagacgacgcaggacgactatgacgaacccatggatgggggacggacctctgtgccagagagcatgtgtgagtgagcacccaagggcagagggagaactctggtcagagcaggaggaggcgat

SEQ ID NO: 551087 - DNA, 1134 bp, Homo sapiens
cggaggaggcaggaaccggagacgcgagcagtagctgggtgggcaccatggactgggatcaccaccatcgaggcggtgaagcgcaagcatcccaggttctgcagccagcaggccagcatgatgccagcaggcagcagagctgagcgccatcccagcgcagaagttgagggcagcaacaggcgggcccgggaacaggctgcaggctgcaggtggcctccattgcaaccagtaggcatccagcgtggttgcaagcaagcagctggcaccgtgcatcaaggcagcgcctggcgcactgccctgacaaaagctggcaagcaagctgaacaacagctgctgatgcagagtgcagcagcaggtcatgcacaggttcattgcaaaaccgggccattcactagcatgcaagcacaccagcatggcaactccaggcaaatccaactccaacagcacagctcaagcacattgcgagcacgcaggcagatcaggcaagtcatgacagcaaggtggcatcggtaagttggtgcatccattgcaacggcagacttggaccgcaaccagaggaacagaagctgcagctggcagaaggtcccgttgccgcagacgatggactgagcccgacttagacctgactggaaccaagaactctgacacggtgtactgagaatgctgagtgaacgacacacgtacctactcacaaaacgacgatacatactgacggccgaccttcaagattccttactgattaaactcaaggcagggcactagaagccgatgcatgacgattggcttgagcaaatcaggtagccacagcttgagaaacagacacaatttgatggaccatggaaagaatacaatggaattgccaccaaaaaggaaaacatactgaacaaaaggcgatgtgatggacacaaaacccagattgtgaccctcactgcaaaattatgaaacatcaccaaatacccgaacacaataaatggcttacctaaaattatagaccacgaaatccaaacatgagagctaaactctacaaacaagacatccactatatacaacagcgaataaattctaaagtgcgaaaaaaaaacacacacaataacaccactcacatctgtaccaacctaaatagtccgccacaga

SEQ ID NO: 551088 - DNA, 127 bp, Homo sapiens
tgatgctgcggtcgttctagacggatccccctccagctggcccccaagggaagcgtgctgcgcacagtcagcccgggtacgttcttggtatgggtggcgcaggtggatctgcctgtcctgtgggcgg

SEQ ID NO: 551089 - DNA, 518 bp, Homo sapiens
tcgtcggggtttcctgcttcaacaggtgctgtggacggaacccggcgctcgttccccaccccggtcggccgcccatagccagccctccgtcacctcttcaccgtaccctcggactggcccaagggccccgctgcgctccagcgccgcgcagacaccgtcgcgacggcgcatctccttagtcgccgccatgacagaccgcgtccacctcgcaggtgcgccagaactaccagccaggactcagaggccgccatcaaccgccagatcaacctgtgagctctacgcctcctacgtttacctgtccatgtcttgactactttgaccgcgatgatgtggctttgaagcaactttgccaaagtactgttcctttacaccaaagtcgtcaatgagggacgacgcggacaccacttgtcttggaggaaaacgctggactgacacgctgggcatgaaatcccaagcggacggttgtggcccgaaagtctttccctttcaggaatattcaagaaaacgcagacctggtg

SEQ ID NO: 551090 - DNA, 700 bp, Homo sapiens
  misc_feature (202)..(202): n is a, c, g, or t
cacccaccttcctgacacctactaacccacggctctcaggcctgtgcaagccttcagtctgcccctttgaagattttcttggggttggggcacacttgggcatcaccacatgctggtcctgggccggtgagcccaacttcgatgcctggagagttatcccataccgaagcccggaaccgcccccggagtgggaggtgtaagnccctgctagagaaggtacctgcagagcttatttgtctggacccccgagccctggccgaggtggaagtcatctccctggagcagggaaagaaggaccgatagagaggctgggctatgaccccccaggctaaggctccccctcccagcccaagcccatagccgaagggccgcagctccacggcaagcctggtgaagaggaagaggaaggtcactggatgaggcacaccaacgggacaaggtcccgcagagccttcagcagcagcatcataaggaggcgaaggcccagcccacgggggcccggccatctgcctggacagaatttgtgcgctgagccagactcccgggttgcctgggaaccaatctctcccccagatcacctgtagggaaatgagtgttcctggaacaaggaggtgggggccatgtggccccttcccccactgggggtggacaactgtctcctggggtgggttggtattaaagaggcaagcgattttttgga

SEQ ID NO: 551091 - DNA, 416 bp, Homo sapiens
tgctccttgggtaggggaaagcacagacaggctcccagtgaccacacgaaatatacctctatctatattgagaaatccgagttcccagctgccgctacctgaagtagccacacgactagccacccaaagtgcggcgcatggggtgtgttcactgtgtttgcgaaattcacagcgcttgagcctccataatgaagctgtggctgcagagacacctgggcactgtgctccaggctcccagctcccaatctatgaactctccctgccctccactctggttggtttgtggttcctctcgagcgagggtttctagaatcagggaccttgtctaacttttgtttgcccataaccctacgagccacccgaggtagccacacaacgagccacgcgaagggccacaccacgcgccccacaacgag

SEQ ID NO: 551092 - DNA, 125 bp, Homo sapiens
catccaagcagattcatagtatctcttactacgtctaacagtatctgaatggagatcgctccagaaaatagtcctgcgattagcatattacctgaaataagagcgacattttacagtagagttaa

SEQ ID NO: 551093 - DNA, 558 bp, Homo sapiens
aacaaccagttaatttatttcaggacaagaatttaccatataacactctttttatgtaaattctgccccttcttttttttttttcctgaagatgataaccattcttttccaaagcgaacttcttttatgtctgtggactagactgtctgaggccacaagatcagaaattactataatacatgttacactgttaacttttagcaaactttacttttgttgaaaaccttgtaagcttgggattttaattatcctttgctattagtaagacctcgttttgtcaaaattaacttagaattcgtatagatggcttttttttttttctttaattacctgggaggaaccatagatcatcctttcctgaagggagttcctcctaggtatggaagggcctttgtacggtaattaagattaaaatcccctgttaggaaacctgttgggttaagggaattttcagtagttaaagttaaatcatcctttgtttttttttccctaaggccccttctggacttggggagggggccccacaatagggttccctgaaaagaaatttttaaatct

SEQ ID NO: 551094 - DNA, 205 bp, Homo sapiens
tctgaggtatcaagtctaaattgaactagagatttttgtccttagtttctttgctatctaatgcagactcagatgaggggaatcgattgcgcttcattgcagactcgtctatgcacacttgaagatcctcagaatatggagctatgcacattgcccgacactcaaagaggccttatctatggggctgcattaactgctgcgtagc

SEQ ID NO: 551095 - DNA, 1273 bp, Homo sapiens
  misc_feature (463)..(463): n is a, c, g, or t
  misc_feature (543)..(543): n is a, c, g, or t
agatatcgtactacacgacacgtactaagttgtagcacaattacatcatatgtcctcatcactaggagccgcattagccagcctaggaggcttcatacactgattgcccctattctcagagttacatcctagaccaaacctacgtccactacaatacactaacacttagtgactatttcagtcggtagtaagattcttaagcttgtcttgccgcaacaaacacgtgttgcgtgcgcgtacgtactccagcgaatgctccacgactgctaaactcgagtattgagccccagaatgaatatcacactaaaaatgaaaaacactcactactcaatgtgttaggcctcaattcgatctctcctcctaatcagtcatgtatacattactaacatgaaactttgtacattgactcttgaagaaacgcctatcgtcctgtacgatacgacgaacaagcctcctacatagntacgtaaagtacatcccgtcacattaataccctggtagctagatctataatggaatgactcacaccaaacacatacccantatcagttttcgataggaaccacacgtattacataacaaaatctaggactcaaaaaacaacacaacttaacgtgggtgagcgtacgcctacctcaagaagtactcctcactccgcatggggggacctcacatggtcaaagggccgttgaacgccaaaggtttattttgcggtatgcaaaaagcgtggtggatcccactgaaaaagagagaagagctccgtaaatcattacataccgtgaattaaacgtggcaattccgtggcgcccttgaccagatatttcctaccccatacgggtcttctgatgaacccgggtgtgcaaacaaaggtcgcgacctaaggactgctgggaggtcccccttattgttgtagaaaggtgcatcccctttacagatataccgcgagggggtttgtgatgacccactaaattgtgtgagccataattcatatccattacacggaaatgaactgtggacaaaagccgcatcgccccacaggagtccggcccttggtaaaacagactttgtggcaacaaagttggcttattcacctgggtgtggcttaaaaaacccacatgaagttgaagagtattttccggcttttgccccccgctttaggaacagagatgcggcagcgggacaaaatactgaggcaaggtttcaagagaaatttaacccccgaaagagggtcttcttcattaacacacccagggcgctaataggtcacacaacg

SEQ ID NO: 551096 - DNA, 463 bp, Homo sapiens
gcgcatatataggttttactgaaatttgggaactcctattatagagagatttatagtaagatttgacctacttgggctgattgtatgagagattctggactaagttatacgtagtgctgaactccacagatgagcaagttgatatccagtcatagaaattctgtgggcagaaaggggaaagaactagtctttggtcctcacaaaccaaattacacataagttgattttgcacagagatgttttgatcatgatacatggttccatggtttaagtcaccgcctttcctcgaccttctgtatacattaacaagccagccattactgtcctcatctttattccctactgaaacttgaccaatactgttctcctttttcgtcgttatgccaaggaaagacagtattgatatgggaatttatatagctggtctgtacctagtattaggaagatcctccaccgcatatca

SEQ ID NO: 551097 - DNA, 372 bp, Homo sapiens
tctttccataactaaagaaaaaaacaacttccaacacaatttaatggggcaatatttttgatctgctccacgaggatccataaatctcttctaaagagggatgttttaaaatactgtatatgctgtttgtattgttctaaggaggtttagaatatcttggctactttactactgtagactgtctttttaacctaaacactgatttatttatttatcttcagagatggggtcttggtatgttgcccaggactggactgcagttgctattcacaggtatgatcacagcctcaaattcttaggctccagcaatcctcccacgtccagagtcactgagaatatacacatttgtcactgcaccaagcttaacttata

SEQ ID NO: 551098 - DNA, 584 bp, Homo sapiens
agactcggtagagcttggttttgctttggtttgttttaattctacaactactgcgaacaagaaaataaattagctttgtgctgcacccgcagtttaaattatcatttggaataactgcttcccaatttcttagactgtttgaaaactttccacacaaagtcagagctgacataagccaatgggatagctacttctctttctttttgcagcgcagttgtgttcatttccactggttggccatccaaataatctagtctcaatatatgaataaaaggataaatgaagggaccattcttgtcgtaactgcatcactatttttgagtgtgtgaattttttccacttatctgtggcaagtatactttgtgtttagtttataaaataacctctacctctctaaaagaagaggaagaaaagtgatcattgtaggaagttggtttacaaatttcatctttcaggctcattgtgaagctgagtatatttttgccactttgctttaaagtagaattaactggttaatacttctcttccctcttctgtcttcctccgtgagtcctgttaataaaaataattggttcttggataat

SEQ ID NO: 551099 - DNA, 244 bp, Homo sapiens
ctttgggacgacgatgactgagctagtaacctgtggatatgcaagtggggagaatcagagagcgagacacaatcagaagtactgtaggcagaggacgggcgtctcattgaagcacgcgaggcacgtgccaggctggaagccacgctagcaggcactggatgaaggcgtcccttactcttacttcttgtccatgggaccatctactgcagcctgtagatatgagtgctctctccagcaagctggc

SEQ ID NO: 551100 - DNA, 148 bp, Homo sapiens
agacgctgtttgccaagaaactcgccctgcactcaggcatgggggccacgtccccgcctgtcatgatggcgtagtccatgcctgagtgcagggcgagtcttggcaaaagcgttcccggtgctggtggcccatagaggatgtgcctgta

SEQ ID NO: 551101 - DNA, 204 bp, Homo sapiens
ttttttttttttaagaacaaggaaaagggtggggggggggtttcccacactttaccccacggggaaaacccaaacttgggtggggccccaccggggttttttttttgttttaacccccccctttggaggtcaaccccccatgaaaagggggccccccgcccaaatttttttgtgcccaaaaaaaaaaaagatccctctgtgtga

SEQ ID NO: 551102 - DNA, 527 bp, Homo sapiens
agcaatacctacttataattctcctaacacagctcactgcgttttcacatgctgtcttcactcccagaaatccctttcctgacctttgccacctataaacttttattcagttttcagaacccagctcagatgttacctgcttcaggaaggcttcctaatcaaccctgccccgaaagagagaattactcctttgccaccttttgaatacttctgtttttatatttaaaacatccattgcttgttcaggtgccattttgtggctactacttttgtgccaggtactgttaaacccctggaggaagcacgcagggacattagtgtgctgaatccctcagaagcatgtgcatactctaccctgttgcctggcctggagaggttcttgttcgcttgtgcatgtccccagctacactcagagctcttgacgggcatcattgtgtcttactgatttctgtagccccaatgccaagcttagaacctggcaccatataagtgctcaataaacatttgttgaattgaattgaaaaaaa

SEQ ID NO: 551103 - DNA, 1049 bp, Homo sapiens
gggtacgtggggcgaaacaaaacctggtcgatggacatcagcggagtgaggagagacgggggccccgaagggccaaatcgcgagcggggcggggcggtctgcgaccttcgcaagtgtatatattgttctgagatgcactgcatcggggaatgctgtggtcaagttgtgtgtggccaccgtgtacttgtctggccatgtcttcatcaggtggctggagacacagtgccagaacggcaagacgtgtccagtatgtagaaggctggcgatcacgcatcagaggacacggtctgtcccgcctctaatgagggctgagggcagccaggatacgccccaagggattcccaggacttaaagaaatctcctaccgccctgtgccctcaaggggcgcacgcagaaccagacgtctctggagaaagcaggtaggcggggagttccagacccagtacaggtggagtacccgggggtgcttccagctctactcgagtcagggggtcaggtggcatttgccccttgggtgctttatctctcacgcgaccaggtggttcaattgccccaagtagatgccgtttccctgccttgaggggtatccacggttgttgtgatcctaggggaccaacgtggttccaccgcgattgcccattcccatggccgtagtgactcctgtgattgcccccttccgttcacgtggatctggcactcggggccatatcgttagcgtaatcctctatctattatcgggcctggcgctccagtggctaagtcttagaggaccttcattgatctttggcgtgtccccgtgggcgcccaactccatctgcagtggcaccaaggtatgtagatgcaaacttcgattgatcattcttgaacaggggttccccgtatggcgttgaatcagcgctgttatgcatgtgttaacatcccagtggggaaacacacccacattctgaaacacccccccgtcgtaagtttggtagcatggatttggggcacttaaaaggggcgccagggaccccttggggagcaatttggttcccaagaggaaaggggcc

SEQ ID NO: 551104 - DNA, 409 bp, Homo sapiens
gtccaacctgaagttgccaaattatttttttttacttttattaggttcagaagtacatgtgcaggtttgttatacaggtaaactcctgtcaccagggtttgatgtacagattactttgtaacccaggtacgaagcctagaacccaatggttattttttctgatcctccccctcttcccaccttccaccctcaagtaggccctactgtcggttgttcccttctttgtgtccatgtgttctcatcacttagctcccacttataagtgagaacattcggtacttggttttatgttcctgcattcgtttgctgaggataatggcctccagctcccaaccacgttcttgcaaaagacaggaggatctcattctttcttacagttacatcgtaccccatgatataaatgtaccaa

SEQ ID NO: 551105 - DNA, 1453 bp, Homo sapiens
  misc_feature (140)..(140): n is a, c, g, or t
  misc_feature (290)..(290): n is a, c, g, or t
tgtgtgggagagaggtgtgtgtgtaaaaaaaagggagaaaaaaaggggaaaaaatataaattttctctctctcaccccaacaccatgtgggggggctcaactttttttcaataacaaacagtgtggtgcgggcgcacaantataaacacacactctctctctgtggaaagagagtgtggcattattatttcaagagtgggtgtattgtcggggagaaatctcaatatgtgtgtgagagaaagaggtggggagcgctctctctatatatatgtgtgtgcgagaatatatantttgtataaaaatatatatctctctctcatatatatctatatatacttttatatatatataacaaataaagaaagagaggcgcgggcggcgcgcgcgctctactgaagaagatatatctctctgtcggagggcgcgcgcacacagagatctagtcgcgcgcgcgctcccccacgcgacgtatattgtgtgtgtgaaacacgagagagggggggcgcgcacactatagtagagagagagagggcgttgtcataatttcagacagacgagacgagagagagcgccgcgagcgcgcgccgcggtgtatatataacacaacgcagcagcgcgcgcaggagcagagcggggggaaaaacacaaaaagtggtgctaaacagcaggtggggggacaacacacagtgtggggagagagaggagagacaccacctcctactcataatactgaagctgagggggggggggggaggggaagccaaacatatatgtgggggggcgccagacaccataactcatacccaaagacgaaaagaggagcagatttaatactaacgcaaacccgccccccagacgggaggggcaaaaactcacacttatcctcacagaatgatttcacaacgaacgaggcgagcggcgcaatcaaacctggaggcgggggggggcgtgctaaaccaccaacatacgatggcaggcgccgcgggaagacaacaactagcgggacggacgcccgtgctgaggcgggaacgatgcaggcacagaagaagaatcatgctgggcgctacgctcaccacacacgcggcagggcgagagagaatcacaactcaacatcatgctgcgctacaacaaaaaacacaacttataatcatataaacaccggcggggggggggaggagccataggccgactgcacgacgcgacaagccgatcagacaacagaacaagacactaccaacgcagcgcaagcaagaccacacgccaggccaccacaaccaagccaagccgaacgaactagcagcacagtcggcagcgacagaccgcacgacacgaatgcgacacagcgcgacggcagcagccacccacctacacaacaaacgacgcagacagaacgcgaacgacacgagccaccgcagcaccacgcacacagtacagagtagccagcacaagacac

SEQ ID NO: 551106 - DNA, 782 bp, Homo sapiens
cgcaccctgtttaccgggacaaccttttagccccaaccatggtacccccaattaagtatagtccgatagaaattggaacctggcgccatagatatagtccccaaagggaaagatggaaaattatagcccagcctaaatatagccaaggactttacccctataccttctgcgataaatggaattaacttaggaaattaactttgccaagggagagcccaaagcttaagaccccccggatacccagtacggagcttaccttaagaacacagcttaaaaggagcgaccacccgtttatagttagccaaaatatagtggggaagaattttatataggttagaaggcgaccaaaccttaccggagacctggtgataagactggttgtccccaagaataaggaatatttttagattccaacatgttgaaatattggccccaccagagacccttctaaatgccccttgtaaaatttaactcgttaagtcccaaagagggaacacgctctttggaacacactaggagaaaaaccctctgtaaaagagagtaaaaaatttaaacaccccactagtaggcctaaaagcagcccacccaattaagaaagcgttcaagctcaacaaccccactaccttaaaaaatccccaaacaatattaaactgaacatcctcccaaccccaattggacccaatctatccaccctatagaagaactaatgttagtataagtaacatgaaaacattttcctccgcataagcctgcgtcagattaaaacactgaactgacaatta

SEQ ID NO: 551107 - DNA, 145 bp, Homo sapiens
ccaggcactgagaggcttgttcagcctgcagcacagactgggcatcccagatctttgaagaggaaccagagcgcaagcgaaagaagggcccagccccgaagatgctggccacgagcttgccggctgtgggacaaggcctctagcg

SEQ ID NO: 551108 - DNA, 203 bp, Homo sapiens
cttgcgtgactacgtgcttccctggactaacatggcgattggctatgccatgacttgtgacggggtacggacgtcaggtacgttagtactatacggcgtgggggtagtaacgggggtcggacggcacacggttggggacacccgctacaactacggttgtccgttgactttggttaacaacacactacgtacgggggactgac

SEQ ID NO: 551109 - DNA, 347 bp, Homo sapiens
aagcctgtactgtattccataactttttacaataacttttacaatcaataaaagcatttttgtaaaataatgtttttttcttacaattcaatttaactgcacagttacgtagtgttctataattcggttaatacatttctagtttagatttggccgctaagacttttgccatatttctttgagaaaaagcctcaccgagatcatcatcaatccatggagatggtccattacctcagtgagcaaataaatgaaacattctgtattgtgattaaatcaacctctagataaatcagctcccagggtacagcagccaaataattttgaaatagctcacgattaaatctttt

SEQ ID NO: 551110 - DNA, 1149 bp, Homo sapiens
ggcgtgaacggtcgttgcagagattgcgggcggctgagacgccgcctgcctggcacctagtgagcgcagacggagaccccgacaccgccgcacgccgccatggagtccgagaccgaacccgagacccgtcacgctccatggatgaagagccccaaccagcgaccaccgcagacttgcgagctgagtggcgaccgcgtgtttggagtgtgggccaccatcaatggcccacctgagccgcgtctaccccgagcgtccgcatccagagagaacagaggttaatttattctgggaagctgtagttggatcaccaatgtctcagggacttgcttccaaagcaggaaaaacggcatgtatacgcatctggatgtgcaatgtgaagagtccatatcaaaaatgccagaaatcaacgccaaggtggctgaatccaccagaggagcctgactggattctacatcggaggacagatatcctgaggatacctacaagtgatggattataaggcaaagggaagttctttcgagaacctttctacccctggatgggaaaacaattctcaaaggccgtgaacgcttgacccaggaaggcaaaccaaaggcctggagatccatggataatcatccggttacacacaccgtaatggaatggactccaagcatataccttggttccaagcgagaatacttcttgcacgaacacggtcattaacaagtgcaaaacaattataggcaagcacacatgctagcaatcaagggagattatacggaaaccagacagacaaaagagacacaaagaagaataccatagaggatcctccatggaaccactgctacaaggccacatattcaaaaacacaggaatccaaggcatgagcaacccacggccgtgacaaccagacaaggcaaggcgtcacttaaaggaggattgggtcaccatcccagtgcacgccacaataaaaagactattggcaggacatcaaagcgcccaagggagtgccccctatttgtgtcaacgaagaaccgtaatgaacaaaaatcgcgaaaactgcgtaggagaatggacaacatagacagacacacatcgagtcagctatatcacaaaatcatgtacgataaatcaacaatgagaataccacacatgatcaggcaagca

SEQ ID NO: 551111 - DNA, 125 bp, Homo sapiens
  misc_feature (5)..(5): n is a, c, g, or t
  misc_feature (42)..(42): n is a, c, g, or t
catcncaaagcaggctcatgcattctctgactcttctgctgncctggtccctttttttggaaacaggtcttggctgtgttgcccaggctgaagtgcagtggcacaatcaaggctcactgcagcct

SEQ ID NO: 551112 - DNA, 461 bp, Homo sapiens
atgcatactgggtgtatgaggtaagtcaaggtcaattttcacattttcgctttttaaaattaggtataatttgcataggtagaattcaccttttctagggcttttttaaatgagatggagtcttgctctgtcgccaggctggagtgcagtggtgcgatctcagttcactgcaacctccactttccgggttcaagcgattcccctgcctcagcctcctgagtagccgggaccacaggcacccgccatcacacccggctaattctttatattttagtagagacggggttttgccatgttggccagtctggtcttgaactcctgacctcaggtgatctgcccacctcggcctcccaaagtgctgggatcacaggcgtgagccaccgcacccggcttccaactgtggttttttttttgagacagagtctctggctcctaggctgacgtgcagtggcgccatctcg

SEQ ID NO: 551113 - DNA, 116 bp, Homo sapiens
aagtgaatgtgtgtgattccattgccgttcgttatatgctcggatttttcttacgacaaggcaattcctgctaatgagcatggtgttgctttctaaaattagattgtggtaatgtt

SEQ ID NO: 551114 - DNA, 233 bp, Homo sapiens
atgggatttattggcaggcctaccttacagattccaccaacacttccgtagaccaggcattgtgagcgcagttgcgtaacatggatggtaccagacaatgcagcgagattgtgcgaaccatgctccgaatgattgagattaccacttcctctagtggatcatctgccagcagagtgagatactgatcaagaacttgcttagagatgttctagccaacatgtcgggatctcgaa

SEQ ID NO: 551115 - DNA, 896 bp, Homo sapiens
  misc_feature (235)..(235): n is a, c, g, or t
  misc_feature (285)..(285): n is a, c, g, or t
  misc_feature (360)..(360): n is a, c, g, or t
  misc_feature (511)..(511): n is a, c, g, or t
acattttactttaatttaatttctggaagaaaaagaatctccttggcgtggttaaccaaggctgggaggtgtaatgggtgagaatcatagactcaactggaaggctctgaaactctctggggctccaagctaatctcctcagagcttccacgaagcctgggaattacacggggcatgaggccaagcggcggccctggggcacaataatccacacggtttaattcctggtaagtantataaacattccacaacaaatttcacgaagacaagggtgagaaaggtcancaaacggttactctccacggtctccctggtgtggtctccctggtctcaacacttgttggggggggaattaatccntctccatggtatttccccccttacattaaacatcattatattcatggttaaggtgggtcatatacatgggtcattcattaatatcccatcaatatctcgtcgcgtccccttttcaacacacatggggattacaaaggtagagggtgggggnaccagcatctttcgtccaattaaccaatatcttatcaaagatttatctcctccgtccttttttaagaggacatggggtgggaaattttcatacgcggtggcgtaattcctttagaggggaatatgggaaatggttatttcctttaatcttcattggtgggtaggtgggatatgttggggtggggttaaacaggccaaggcacgtacacactccatgtaggctgtacattttcccaatagaataccttgggctgtgttgccaggaatgtccccattatgggtgtaacagttttatccaaattgaagattggtccttggacttggtaacaccacccctaggtcttggaccacgagatggaccctgggctctggggggtgctccggtc

SEQ ID NO: 551116 - DNA, 440 bp, Homo sapiens
gggccaaggccaaggactggcggacggggaagccggacagggtggtgcgcaatgtcaagggtggcaagaatagcaagtacgcccccgctgagggcaaccgctacgaaggcatctacaaggttgagaaaaactggcccgaaaaggggaagcccgggtttctagagtggagctacctacctgcggagggacgacgatgagcccggaccttggacgaaggaggggaaggaccgaaacaagaagctggggctgaccatgcagaatccaaaaagctacctggaaaccctgaccaaccgagagcgaaagaaggagaacaacaagagggaggaggaggagcaacaggaggggggcttagagtcccccaaaacgggcaagggcaaatggaaaccgaagccgactggaggcggcccaaaacaagggaccagataccccaacaccgggaa

SEQ ID NO: 551117 - DNA, 426 bp, Homo sapiens
  misc_feature (35)..(35): n is a, c, g, or t
  misc_feature (54)..(54): n is a, c, g, or t
  misc_feature (203)..(203): n is a, c, g, or t
ttaagtaggtaatatactttggaatacccaggtantaaatgtaggaatttgggncattcctaggaaataatataaaagggcttaatatccatggtaaaaatcctttaaatagttaaaagggaagcaggattttttgtaggatatagtcctaaacagttgcaactgccatcattaagaacaaatatggtttctcaaagcacatncctaggaaaactgttggggactaaatactagactgggccttggcaatctttttcgtgtgtgtatgcgtgtgtgtgtgtgtgtgtgtgtgtgtgtgtgtgtttagtagagacagggttttgccatgttgcccaggctggtctcaaaactcctgggcacaagcaacctacctgccttggcctccgaaagtgctgggattacaggcgtgagccaccatgctcgact

SEQ ID NO: 551118 - DNA, 760 bp, Homo sapiens
agcatccaaagcacccaaatgaccaaggacatatatacgtattctggaggaatcaggggtctaggacggagtagggagcgagaatgaagagaacaatgcaagccagcatgattataagtgtgtcacattgagcataaaagtagaaggcacaggagaggtagcaaaggccaggcctttgccacgcgcgctgccattcaaacgatacgctgaaacaaaacactagccatacacaaggtcacggcaacaccagggaccagcactgccaacgccgtgggagcacagcatgcacgcggcacgcaacaccatgcctgcggcgcacttgcagaggaagcaagatcacatcggcaacgagtaaggtagcgtacacaagcacacgcgccgcgaaacagcacggaccaacgcgcccgtcggtaacgaacggccagaccgacagaacaccaacctacgcaccatcagcaccgacaagccggccaacgcttgcgaagcgccaatatacacatcgcacacacaacctgacgacccacggacaacaccaacatccagaggcatcccgcaaccgacggcagacgcgcaacaggctggcgcagcaaccaaccgaaaccgggaagaaccacgcacgcgacagagcgagcagcatcacagacgcccgacctagagcaaggacaaagacaccccggcgaacaagaggccagcaacgacacgcagcaccgggtagggcgtaagagacacggccacacgagcgacacatacaagatagcac

SEQ ID NO: 551119 - DNA, 171 bp, Homo sapiens
ggctccttttgggcgatggtgcgacgacgtgtttcgttcggttcaaggtctttgctgcagctgacgtcaaggtggtcgtcgccaacagcgcaggcgtctgagaccaccctgtgtgctcaactccgactactcggtcaccctgaaccccaaccaggacacaagccccggcgg

SEQ ID NO: 551120 - DNA, 254 bp, Homo sapiens
tcgcttagtctacctgttttgagtgactgaaagttatgctgagggtgctttggagctgggtttagaacttgaattggggtggagccatgactgagcagagacagaaatggagctggggtcaggatcaggaaggaggttagagttggagccaggtcacgttcccacctgttcattgcccaccaggtagaccttgatgtcaggtagagagaggcctcgagacaaggtagagccgaggggctaccgcgcctcgaaac

SEQ ID NO: 551121 - DNA, 889 bp, Homo sapiens
  misc_feature (8)..(8): n is a, c, g, or t
  misc_feature (10)..(10): n is a, c, g, or t
  misc_feature (34)..(34): n is a, c, g, or t
  misc_feature (41)..(41): n is a, c, g, or t
  misc_feature (62)..(62): n is a, c, g, or t
  misc_feature (79)..(79): n is a, c, g, or t
  misc_feature (135)..(135): n is a, c, g, or t
  misc_feature (137)..(137): n is a, c, g, or t
  misc_feature (146)..(146): n is a, c, g, or t
  misc_feature (148)..(148): n is a, c, g, or t
  misc_feature (179)..(180): n is a, c, g, or t
  misc_feature (243)..(243): n is a, c, g, or t
  misc_feature (248)..(248): n is a, c, g, or t
  misc_feature (283)..(283): n is a, c, g, or t
  misc_feature (330)..(330): n is a, c, g, or t
  misc_feature (344)..(344): n is a, c, g, or t
  misc_feature (373)..(373): n is a, c, g, or t
  misc_feature (397)..(397): n is a, c, g, or t
  misc_feature (406)..(406): n is a, c, g, or t
  misc_feature (414)..(414): n is a, c, g, or t
  misc_feature (417)..(417): n is a, c, g, or t
  misc_feature (421)..(421): n is a, c, g, or t
  misc_feature (423)..(423): n is a, c, g, or t
  misc_feature (437)..(437): n is a, c, g, or t
  misc_feature (465)..(465): n is a, c, g, or t
  misc_feature (473)..(473): n is a, c, g, or t
  misc_feature (500)..(500): n is a, c, g, or t
  misc_feature (607)..(607): n is a, c, g, or t
  misc_feature (633)..(633): n is a, c, g, or t
  misc_feature (719)..(719): n is a, c, g, or t
  misc_feature (721)..(721): n is a, c, g, or t
  misc_feature (736)..(736): n is a, c, g, or t
  misc_feature (758)..(758): n is a, c, g, or t
  misc_feature (762)..(762): n is a, c, g, or t
  misc_feature (867)..(867): n is a, c, g, or t
tgcatgantnagaaaaatgaaacatctattttancagcaanaggctgtaagggatggggtanaaaaggcatcctgaganagttctagaccgacccaggtcctgtggcacactatacgggtcaggaggggtggaananaggcctaancnctaggacggtgaatctcggggctatttgtanntttgttaaaaacagacattcttttggccttttcctggcactggtgttgccggcaggtgggcanaagtnagccaccagtcactgttcagtcattgccaccacanatcttcagcagaatcttccggtaatcccctgaagtatctcccgaaangtcgtggtacagcnacttgccgtacatccgcttataccctganctgatgtccaggaggtcggtctcnctgcgaaanaccatgangcnaatnanggtccggtcctttnttcctgcccccctcatggcctttttgancctctccncaaaaaaggctggggtattcttgaaanatttcaccacggccaacatgccctcctccaggtccccggacatctcccggcaaaagctcttctcaatttcccggcctttcattctctggtactcattgaaaactgcnaccaggtgggcccggctccgggagcncagaaccgcattgaacttggactcgtctgttcccaggcggttctccccggccgcatacagctcctgggcatctctctgggcgagtnanaagtccacgtttgtnctttcatcacggtttccctganaaanaaaaaagaggagccgctggaagtgccccgatgtgtcgcttcgaatggcctcttccagggtctttttgaattctgctttgtaggctctgtttaattctcggatgtnctcattgctgccggaagcgagg

SEQ ID NO: 551122 - DNA, 261 bp, Homo sapiens
cagtatatcttcctatagaaaaccaagtcaggcgggcatggtggctcacacctgtaatcccatcactttgggaggccaaggtgggcagatcatgaggtcaagagatcaagaccatcctggccaagatgctgaaacgccgtctctactaaaaatgcaaaaattaggcaggcgtggtggcaggcacttgtagtcccagctacccgggaggctgaggcaggaaaatcgcttgaacctgggaggcacagatgggtaccgagctcg

SEQ ID NO: 551123 - DNA, 111 bp, Homo sapiens
  misc_feature (102)..(102): n is a, c, g, or t
agaacttcgtgcactttaaatgccacgatagtcgaatcacacaagcattagccaatttgttgaaagcataggtactggagcctcaaaggcccaccatgtggnggagcaatt

SEQ ID NO: 551124 - DNA, 365 bp, Homo sapiens
acaatatatataccatcgacgagctgtctttcacgcagtggaagatttggcactgcaaaaccatgattcaggagcaagtcatctccatcgaggactcgtatgtgaacagccaggagtggacgctgagccgctccgataccgagagcttaaagtgtgtgcatagtggggaacctgtatagcgagaagtcaggccatggtgcagcgatatctgacggggacctatgtccaggaggagtcccctgaaaggggggcggtttaagaaggagattgtggtgaatggacagagttacctgctgctgatccgagatgacggaggcccccctgaagctccagtttgctgcctgggtggatgcacaaatccggaa

SEQ ID NO: 551125 - DNA, 204 bp, Homo sapiens
aggagggggatttcgtgtgtttgcatgagtgtgcgcttccgcccttgggagttggcaaaagggagggaaggaaggaaagcaaaatcttcggaaggtgttttttggacctgaggggtccccccctgaatccccaaagtctcccctgtgaactgaggaggggaggggtgtgctggggaataaatcttgtatgagacccatctttta

SEQ ID NO: 551126 - DNA, 1032 bp, Homo sapiens
tgctgtagctggattcgtggtggccagagtccgtgatacgatgaccgctcgtcatccttgtgacccgacatattctctaggcgagcgagtgcgcggataatgtacttcaggaaccgtgatcaggccagtttaactcagggccatgagaactacttccacccgctggggatcccacaccttgggagtaacgccacattggctgtgtacaagtaatgctgattggaatactatatatgcatatggggacctgtccttttataatatgtgggtgaatctgtcgagaccattgggaatgagatagcgtgggggcctttcctgcgtggaaccaccccggaggagtgaccacgtccgttcgatgtggaacgaacctgcttaccaaagctacatgtgcagcagtctcggaccccaggaaaattaaccatcagtttctggccattgcgtgaatggcagtgctgatgcctacatgcgcagtaattgtgcattgcctgttggggagaagacatcatgcttgggctgcttggtgggatcgagctattgtgtggaggctttcggcccctgcatggataccataggtcttcgaacgagccaggacttccagatcatggtgtcccaggaccccgtgttggaagacgctggcatggcataccagtcctggcgaaaggctaggttcttctgctggagaacgtcagccatggttgccgtcatgggcatgacggtgtggggtgggcccgtcctgggtgtagagaggagatgatccttatcacaggtggccgaggcatgtacgggcaggccatgagagggtgtacccaatttgaccgggggcctcagggcatccgcacggttgtgtgtttgggattcccctgaactcagtgtgaacggcggattaaaggtacggtgcatatcaggctggccccttggttaagagaatgaaggactctaaacatgagatcttgccaagtaatcagaggcgtgtgcacctgaaacgttcgtcacacacagtggcgcacgagtgtaaaaaaacccggtattgac

SEQ ID NO: 551127 - DNA, 840 bp, Homo sapiens
ggccgggcgcggtggctcacgcctgtaatcccagcactttgggaggcagaggcgggcggatcatgaggtcaggagatcgagaccatcctggctaacacagtgaaaccccgcctctactaaaaatacaaaaaattagccgggcgtcgtggcgggcgcctgtagtcccagctactcgggaggctgaggcaggagaatggcgtgaacccgggaggcggagcttgcagtgagccaagatcacgccactgcactccagcctgggcaacagagtgagactccgtctcaaaaaatacactaaaatttttttaaaaaggtcaacaatgctataaaatttaacatctactatttaaatttataaaggagatgcagtgataattatgcatatgcgttttgacttgttagctacattcttttttactatacttgctttcctttattaagttctacatttgtcctacattaatatgaatcatttgaagtactttattctaatttacattttgaaaatactattttctggaaaaaatgtattttattttggaagctctccacttttaaaaattggtggttaatatcctgagcacattaacagtagctgtctggcccttaaaacatgttacgagaatctgagtgctacagatttatggccactaataacattacttgacctgtttaaatcactactacattttttatgctgctaataaagcggatattgcgccgtggtagacaacactctagcctgatcggcacacatacacggggcgcacggacaagcacaacgcgccctcacacacgtcaaaggaagggcaatccgacataaccaacgggtcccccaacggg

SEQ ID NO: 551128 - DNA, 379 bp, Homo sapiens
gaatcgagccggtccgagcggacagcaaagccctttccacatcatcaatcatcttagaaatacacgaggaagtagagaggtcagtttatgagaggctaaaaggctcctcctcctctacccaactgcgcagaaaaaatagaaatagaaattttaaaaattacatcttaaatccaggtcccggtttgggaaacaattaaaaaaaaaaacaccggtacattggcggtagggcacaccaagtggcatcatgatgtttaaaaggtctttataaaatcagttggggaagggcaggtgtgtgtccgggaagggtggggaagggaggttaaaaatcaaagctgagctccagtgagtagggatggggttcgcctggcttgtaccgctg

SEQ ID NO: 551129 - DNA, 350 bp, Homo sapiens
gagaatattcgtggtcaccgtggcctcatctttgaggcaaggacctttctgtgttcttcgatagcttatagtatagctggtcggtgtgactttcatcccaaaacctcatgtgtcggaaatttatatcctcagtgctcccagtctttagaggtgggacctttttcatatgattaggtcttgcggggtgagctccctcatctcaattagtttcgttcttgagagagtgtgttccattagaatattgtgtttggccctctctggctctcccttgcatgctcccttgcccttctgccatctgccctggaatgactcagcctggtccttgcctagatgtttgcccctttacctta

SEQ ID NO: 551130 - DNA, 295 bp, Homo sapiens
agatataaagtatatgaagtatgctttgttgctcatagagagaacccatgacagagttaacccaagaatatgtttggttaaaataaaaatagaagcttaataatgggcattcatactttttaaagagaaatgaatgacgaaatcggttatcctgctgtagttaactattgggtaagtcttagtaaagaagagaatgctgaagtcggccgtggcgataccctcctaggaactgagaggtgtggcttgcccattacccgcttgaagctcacatctttaccctcctctcccactgtgg

SEQ ID NO: 551131 - DNA, 274 bp, Homo sapiens
aggaaatgactcagaacgggttggggatcaaattcttaaagacagattgtggggagaagctagaaaagaagacccagagagtatggaggttaatgtttgagcaacctggtgaacatgtgaccacatgggacagggtgttccagtgaatgatgtgtgaatcatgtaagtggtgccatggaacagctgtgacttgcaaagcaattgttgagagtgaacttgatgtcttgccaaggtcttgggcagcatgacgggtcttgtagtagatgctgggcca

SEQ ID NO: 551132 - DNA, 241 bp, Homo sapiens
ggggttcccccaaaaaggggccccttttttggggggggcttaaaaggtccccatgtttttaatttgggggggccttaaaaaaaaaccgggtttaatttccccccgttttggaaaatcccccccccaatggaaaaggggggggggggggggttttaaaaaaaacccccctgaaggggattaaagggggggtttttgggggccgtaaccctttgaaaaccttttttaaaaggaatttttttta

SEQ ID NO: 551133 - DNA, 317 bp, Homo sapiens
ttccaattaagttttgcttttgttaaagtgtggccccttttttctgtttggagtaagccaaaaattgttttgccataggttccctagggtccccttgctttagcatcctttaaaggcccctgttgcaaagtttcccttttatgctgaatttgccttttgtcaggcccccgtagaaagcccccagtacatgctttgccctttcctttgctccctttttccaattttttattgcatatccttttgttgtaatccagaaagcagcatttttaaatgtccgtgttaagaattggccccctggtccccacttttaacccata

SEQ ID NO: 551134 - DNA, 132 bp, Homo sapiens
caacacacagtatcgtcccctggctgtgttcgagaatgagtattcctatacacccagatagactacaaccccgaggaccgtctgctctattgcctggtcacaatggccaccaggtcacttaccatgtgccct

SEQ ID NO: 551135 - DNA, 1414 bp, Homo sapiens
  misc_feature (179)..(179): n is a, c, g, or t
  misc_feature (378)..(378): n is a, c, g, or t
  misc_feature (409)..(409): n is a, c, g, or t
cgctcattaaatactcactacgcatcccgaagacgtctctcttcggcagtgaactctcgattcccatcagtctccgtcgcgctttctgtcaacccctcgttctttccctgatagacgcactcccacacagtccacgatgtgtgttagatctgccaggagatcgcgctcagtggttcagnggagctcgcgacacctcggggaggtacaagtcacgtggtcggtctatacaaagtcggccgtggtgagcatcatggcaatcgactagaaggaggacttgacaacaatctatagacttatgtgataacatggtaggactggcgagtacagatctgatgtacacgtacgtctacacgaacatcttgtgtgcccgtataacantccaggaactgtgtgactcgtgacccttgantcagtaaaataccgctaagcgcatcgccaagattcaattcatgcacgaagatcacggacagagcttctacatctctacacgtgcatacgctcattcatgaggctcatgtgcgcaagacttcctacctcctgcggcatgaagcttttgctttaccaaactctcacggactgtcagcgaggttgtcgagcacatgttattgtttgtgtcgcaacgtctcgtgcattctgtcttgcacaatcacccgtgcaggctccttaccagtattcatttctgtccacgaaccataggacctatcctgacgcgttttcattgagtcctttgcgttcctatttgtggactacatcaagcatcaggagactggtcattagtggactccagttacattgctgaaggcattgccatatgggattaagccatgatgaaagctctgctgaagagaaagataatgaatgattcagtggaaagagagaattgaaagggaatggattaatttacagtgaaggcaaaccacaccaggaaaagcccgctgtttcacaatttctgacagagggataacacacggaacagtattttgaggagattattgtagaaatgaaagacacgaacacggcatgattatgataagatagaaaaggagaagaaaaaaattattagagagaaacacaggggaaagtaatataacaagatattataaaattataacacgtcttgatgaaccaaggagcaactatatttgaagcagagggataacccccaccacaagtatattgaaaaaggctctgtttgtagataaatagatataagaaaaacaaaaaagaaacaaaaagtagaaaacaacacaactagacggaatgatcaaaaaaagaagagaaaaaaagattattataaaaagagagaaacaaagtaaaataaagatagaaactcaaaaaaagataaagaaaaagaatagagataaaaaagaaaaagaagacagaaaaaagtaatatataaaaaaataataaaaaa

SEQ ID NO: 551136 - DNA, 121 bp, Homo sapiens
catccctcgaatgggtctctgcggagtattcatctgtgggttcggggcctggcccacactggcttcctgtgacttggctatgatcgcagttctagagatcgacgaatgatcgagaatgcca

SEQ ID NO: 551137 - DNA, 465 bp, Homo sapiens
  misc_feature (44)..(44): n is a, c, g, or t
  misc_feature (56)..(56): n is a, c, g, or t
tctcgaatcgacggtttctctgcggtggggattgatcctgtgcnatgtaggatttngttttttggttttggggttttttttggttgtttttttgaggtggagtctcactctgtctcccaggctgagtgcagtggtgcgatttcagcccactgcaaactccgtctcccgggttcaagtgattatcctgcctcagcctcccgagtagctgggatcacaggcacccgccatcatgtccggctaattttggtatttttagtagaaacggtgtttcaccatgtggttcaggctggtcttgaactcctgacctgaagaaatccacccgcctcggcctcccaaagtgctgggattacaggcatgaaccaccacgcccagccatttcttggtatttctagtagagatggggttcaccatgttggccaggttggtcttgaactgagctcaagtgatccacctgcctcggcctcc

SEQ ID NO: 551138 - DNA, 183 bp, Homo sapiens
gcgggcctgacgtcagccctgcatcccccaggcctcgggccagcggccaggagctgcctccccagcgtggggtgacggtatgcggcgtgagtgagtggagaactgagacaggaggttgagcagctctggatccagatccgggatgcgtgaaaagcatgtggagagtcaagaatgagaaagatc

SEQ ID NO: 551139 - DNA, 459 bp, Homo sapiens
taataaattcattattaaaagctatggacacattcgttagatcaagcgagatacatgtatgaacaggcatgtggtcacagagccagtatagtctctggccacgctcagtacatgagtattcccccaagttcagcgtcctaggtctcggtgtcaggctttacggcagatctgtgaagaatctctcgaggcgtgtgaccagcccttgtgaaagagccagtgtgtgatggctaagataattgcataggctcacaagacagtgactgacatacagcgcaactctggcttatgaaccaggaaaggatcagtagtgagttcacatatttgactcataggataaggccaggcagatccctctgggtaggtcctggaaatacaaaggtcattacctttgaaggtcagtccatcgacagaggcctgtaaaatacgcatgacgatgacctcgagtgcctaacaggcttg

SEQ ID NO: 551140 - DNA, 138 bp, Homo sapiens
  misc_feature (38)..(38): n is a, c, g, or t
  misc_feature (67)..(67): n is a, c, g, or t
  misc_feature (110)..(110): n is a, c, g, or t
  misc_feature (126)..(126): n is a, c, g, or t
  misc_feature (135)..(135): n is a, c, g, or t
gacaagtcgagcggcaagcactacggccaattcacctncgagggctgcaaaagtttcttcaagaggngcgtccgcaggaacttaacttacacatgccgtgccaacagganctgtcccatcgaccancaccaccgnaac

SEQ ID NO: 551141 - DNA, 415 bp, Homo sapiens
  misc_feature (47)..(47): n is a, c, g, or t
aataaacagaaaattcggctggtctctagagaggttaatttgtgtanaatccactgagctatatacccctcattaaaaatctctgaccattgtgcatactgctctcttgcttcacaagatcacccacagtattctcatctcctttaccaagaacctgaacttcattctcctgcaaaagctgcttgctcttacacctgttcctgtttgacccggttctcaaccaggcgcacttggcctttaaccggcatctgctcctgggcacagtcctcagagcgccaaaatttccctgcccattatcagaccggtggtaacaagaataactctacacacctttgccatgttcccccttgaaaaactctagagtcaaatgtgagtcagagacacagctcaggttccatacacacactctgcttcc

SEQ ID NO: 551142 - DNA, 895 bp, Homo sapiens
gggcgggctaccgcgcccgggccctacccgccctggcgcactgctcttcccggtcatggaggcgccagccgccggcttgtttctgctcctgttgcttgggacttgggccccggcgccgggcagcgcctcctccgaggcaccgccgctgatcaatgaggacgtgaagcgcacagtggacctaagcagccacctggctaaggtgacggccgaggtggtcctggcgcacctgggcggcggctccacgtcccgagctacctctttcctgctggctttggagcctgagctcgaggcccggctggcgcacctgggcgtgcaggtactagggagaagatgaggacagagaacaatttgggaagtacgtgaaaccaaaattaagggtacaagtgggagattcttcacagtcaagctcccagtggctcttgatcctggggccaagatttcagtcattgtggaaaacagtctacacccattgttgcttcatccgtattccaagccagattcacccagtcagagacaccagattgtggtgttgaggggaaccattatttctaatcttccctatccaaggaagacacaaccatgcgtgtgaagcttggctctcgaaatgtggagagctacaccaagctggggaaccccagcgctctgaggacctagtgaattcatgggcctttcagagatgtgcctgctaatagtcaggatactttaaagtacattatgagaacaacagcctttcaggaccatcaccagtttgacccggagtcattgaaggtctctcactgggtaataatggtgtggaagaaacgtggacttaaagccacaggaactggataagggcctctccaggctatgatcccagaacgccaatagggatatccccaccgcttgaaacatctcc

SEQ ID NO: 551143 - DNA, 872 bp, Homo sapiens
taggcagtacgaggctggggttaaatcggccgagggaggcgccagccgccggcttgtttctgctcctgttgcttgggacttgggccccggcgccgggcagcgcctcctccgaggcaccgccgctgatcaatgaggacgtgaagcgcacagtggacctaagcagccacctggctaaggtgacggccgaggtggtcctggcgcacctgggcggcggctccacgtcccgagctacctctttcctgctggctttggagcctgagctcgaggcccggctggcgcacctgggcgtgcaggtactagggagaagatgaggacagagaacaatttgggaagtacgtgaaaccaaaattaagggtacaagtgggagattcttcacagtcaagctcccagtggctcttgatcctggggccaagatttcagtcattgtggaaaacagtctacacccattgttgcttcatccgtattccaagccagattcacccagtcagagacaccagattgtggtgttgaggggaaccattatttctaatcttccctatccaaggaagacacaaccatgcgtgtgaagcttggctctcgaaatgtggagagctacaccaagctggggaaccccagcgctctgaggacctagtgaattcatgggcctttcagagatgtgcctgctaatagtcaggatactttaaagtacattatgagaacaacagcctttcaggaccatcaccagtttgacccggagtcattgaaggtctctcactgggtaataatggtgtggaagaaacgtggacttaaagccacaggaactggataagggcctctccaggctatgatcccagaacgccaatagggatatccccaccgcttgaaacatctcc

SEQ ID NO: 551144 - DNA, 950 bp, Homo sapiens
tggtaattaacatgtcctgaaggttccaatggatttttgaaatggactggtaagacgcattaagttagaaagatgttaagcgcattcagtcccattagggtttccacttgggtgttaatctcattatacaggctattagaatgggcgggcagtaactatttcctctttctggtagaagtccataaattaatagttatagaccatatttacgcaatggccttttgaaaggggattattggttactccagggtcaacattcaatggttatcacctaaacacagagaataagctcatctttggcctaatcgaggctgtgtaattggactatctatgtaaacttctgccctatgtaacatagggatatctcaatataaacatatctatacaccaccatctttctaagtctccttaaaataatattggtcgcttcctgagacatacacatagagtttaaaacgcgaatatatttttgtgcaaaatgtttccttggcgactaatccaccaatgcgctttataagttatatttcctcaagaaaacgcatgggttccggttatttaagaagacaaatatctggtgtgtaaccaggggagggcgaagaaattaacggcgccaatgtcctctggggctaatttttaaatatttggggcaaatatgggcgctttctaaaataacgcccatggggctcttcccatggtgtggtgctcaccctaaatccagctataatattctgggtgctgggaaatcatctttagcacactattttcacacacgatgtacacgcgccacgggtgggttacaaacatcccctcgaaaagggaacaacctttttatcgccaggaagtcacatcacttcgggggggtgcaccaagttttttaaaactatcctgtttgcacaaatgagagaggcgcttatttttctaacccaaatgggatttttcaaaattttggg

SEQ ID NO: 551145 - DNA, 275 bp, Homo sapiens
tctacaccaaaaatataaaagtacattctagcccagatggaacggagatagtggtgctcaaatcttcatcaagtgtgttgtcccttatcacatggctccatgtcgcctagatcccccgatcgatccagtgttctatggtggtctccgtctctcattaggtgtggaatagtagttatctagtgattatgtgtatcatcccatattgctcatcttaatttcttcccgatcaggttacttatcggagtagaggttccgggtcaatgtgtagaagttga

SEQ ID NO: 551146 - DNA, 487 bp, Homo sapiens
taggcagtacgaggctggggttaaatcggccgagggaggcgccagccgccggcttgtttctgctcctgttgcttgggacttgggccccggcgccgggcagcgcctcctccgaggcaccgccgctgatcaatgaggacgtgaagcgcacagtggacctaagcagccacctggctaaggtgacggccgaggtggtcctggcgcacctgggcggcggctccacgtcccgagctacctctttcctgctggctttggagcctgagctcgaggcccggctggcgcacctgggcgtgcaggtgagtgtgggcgacccctcgccgccgctcccgggacccttcccgcctcccttcctggcggtccccgactccgcccgggccctctaggcctcaggaaatgcggagacccgggcggcgggaggggcacagggggtccgtgggattgcctcggggcccgcgaggagtcctgggtggccaggggccccggcgcctcc

SEQ ID NO: 551147 - DNA, 232 bp, Homo sapiens
ataatgttgtgataatatgttgcactgcgcagctcagcatagattgtgctactgtcacgaggcaagtctgtagtatagtcattacggtcctctgtgtgatttttttctccgaaaagaggtcattgtgcccgcaggttgtttgtgattagctgtctctaactattgttcatacaataattgttcattattgttctcaacttggggctctccccaacctggggacccttcctta

SEQ ID NO: 551148 - DNA, 87 bp, Homo sapiens
aatttgaaaggggttgatttgcaaatttggatttaccccccttgttttggaagcccaccagctgaaaaaagttggggttttttttta

SEQ ID NO: 551149 - DNA, 913 bp, Homo sapiens
  misc_feature (58)..(59): n is a, c, g, or t
  misc_feature (67)..(67): n is a, c, g, or t
ccaagtttgtaccacaaagcgtgtattaaacgacggcatactatacgactaggtacgnngctggtgngatcggccggaggcgccagccgccggcttgtttctgctcctgttgcttgggacttgggccccggcgccgggcagcgcctcctccgaggcaccgccgctgatcaatgaggacgtgaagcgcacagtggacctaagcagccacctggctaaggtgacggccgaggtggtcctggcgcacctgggcggcggctccacgtcccgagctacctctttcctgctggctttggagcctgagctcgaggcccggctggcgcacctgggcgtgcaggtactagggagaagatgaggacagagaacaatttgggaagtacgtgaaaccaaaattaagggtacaagtgggagattcttcacagtcaagctcccagtggctcttgatcctggggccaagatttcagtcattgtggaaaacagtctacacccattgttgcttcatccgtattccaagccagattcacccagtcagagacaccagattgtggtgttgaggggaaccattatttctaatcttccctatccaaggaagacacaaccatgcgtgtgaagcttggctctcgaaatgtggagagctacaccaagctggggaaccccagcgctctgaggacctagtgaattcatgggcctttcagagatgtgcctgctaatagtcaggatactttaaagtacattatgagaacaacagcctttcaggaccatcaccagtttgacccggagtcattgaaggtctctcactgggtaataatggtgtggaagaaacgtggacttaaagccacaggaactggataagggcctctccaggctatgatcccagaacgccaatagggatatccccaccgcttgaaacatctcc

SEQ ID NO: 551150 - DNA, 1186 bp, Homo sapiens
gcctccactgctgggctgcacacacacatatcagtgctatggactataacatacaatgatgcatctcgaccggatgtgactgagcaggctcaacataaggaggtagagcactgcgacaaggcgcaaccgaatgaggatgaggaggatacctggtgaagagactattgcatagataagcatgacatgagtggagtgactgcaatagaagactgttgagcacatgtcagtctcaaaagcgagggaggaacggaatagaaggcttaacacgacctgagcgagcgattgtaagatctctaaagccgccaagatcaactgcaagagaagcagcaaaggctacatcgaaccgtaaggcagcgtaacaccaaatgcatatgaggaacaccttggagtgcatagcttgagtctttccttctacctcggttaccacttcccctgctaagtatggtggctcccctatggaagagggacgcttgcgcacgcctagttgggttgagcaactctcaatgacttacacgttactagagcaagcattttcatccgccagtctaagaccaggcttcccagctggtagaggcggttaagcttgcaattgtcggttaaagcattggtaaatctcttccaatcgaagtaatcatactgtgcccatgtagtgactattcaaggagacccgtggtgatcctgtagcaagaagaactactatggtaacattgtatgggtacgtggatactgtaagcaaatgaacgtcaatctacgcgacacattctgggttgaacttccctggggctgtatgggttgccctggtcacaagggtttgccagagccgtgcctcagcatgaggttaacctagaacgtttccgattcggcggcggggcccccagttagtcacgcgaaataaaggaccgttagggggagaccgaaaggggaggcctgggtcaatgaaaaatgtgcttgattcgtcgcgcatggaaaacagcccgggcgccagggccgaaaggagaatcccgttgagggcgaggcctggcggggcaaaccgcgggccgccgctggatcctcgccgcggggagggcgggaaacccatacataaggcggggagtaaagaaacacaccggtgtacaccaagtgttcgcaccaagaggggagagacaacagaagcaaggaggaaagagacaacacaccacagcattaa

SEQ ID NO: 551151 - DNA, 117 bp, Homo sapiens
atcagtgcgaagactgtggatcggcgaagactgtggcaattccccgtgagtttttgtagggaaacacagccaaaccatattattctgaccctgacacccccacagtcttcacctgat

SEQ ID NO: 551152 - DNA, 603 bp, Homo sapiens
  misc_feature (603)..(603): n is a, c, g, or t
gtcgtgtggtggtggctgtagcgcttcggagagactgtctccgccctttcccggtctggagccggagtccgagggggcggccgggggatcagaacccgaggctgtggacagcgacaccgagggggaggacattttcaccggcgccgcggggggcagtaaacatcagtctacaaagataactacatcccttcttccgatcaacaatggctccaaagtgggatccatgaagaacaagaccaagagccacaggatctctttgcagatgccacagtggagctatacttggacagcacacacaatatttagacgaaggtgctagtcccaacctatgaggagctagaggaagatgaacaggaggatcaatttgatttgacagtcagcataactgatcctgagaagatagctgatggattgaatgcatatgcagcctacaaaggtacatcacaggcaagcttaccattgcttagatgcaacaggttgcagtacaacgtagatttagtgactgtgtggagcgttatgagacgctatgcgagcagcactctcagaatgcttcattgtgctgcaccgctgaggagagtctcatatgcatgacagagtggttgn

SEQ ID NO: 551153 - DNA, 550 bp, Homo sapiens
gattgccgatgacccacgcgtatgctaagttgtggaccacatgctccccgctggcatgaacgccccgtttatgtcacggtggatttataaacaacgctccacttgagggctatatcaaggggggtgacttcaaccacatttgtgcactactgtggcgacactcatacgcggactccggccgttgtggcatccctttccccgccgtttcccagtggattactaatacagggtgccaatgcagatgcagcctttcttcaacacaagaggtagcaaatcgattctgggcggtgtacccaccatgatgactggaaaatatatggggagacaaagttttattgtcccccctttactggtcggtgagacagtacgccacccctcatgactaccatgtttctgctgcccaccaggtacgtcaaatctgtacaagaagggttcttgtatcaagacctccggcgttttacgagcctcccttctagtcgtcgttggactcaactagacacggtgcaaagtagggcgtttgcgtggcgtccgtttttttagaccccaagca

SEQ ID NO: 551154 - DNA, 307 bp, Homo sapiens
caggcgttcctttagaactgtgtctgaaactaaatacaaacatgctaataccaactgtgtaacatagtctctcctgcttttctcttctacaccactcgtctcaatgtctcatatgcagaatacatcagcaagaatggagggcatatcctcacgaaactcactaatgtcactaagaacatcagatgcctgctcatgctccagacctcctctaattacatgatatgacacactcctagagagcctgctggaactccctccatgctgaactatcatcgctctcattttcactgaggatccgacataaacg

SEQ ID NO: 551155 - DNA, 720 bp, Homo sapiens
ttaaatctgggaagcacccgggaccaccccgtctgtgggacgccccttaactccaggaacatatcccgacccttcccagcacaatggatgggattttcaatttaaggtaattggggccagcaatcactgctggatggtaacggctttttaaatcctatggggtctcctgcaatgagaacattctcccgacgagctctctttcgctcccataaggggctggttcatctatagaggtgccagaaatccttgtttttctttttgagaccggagtctccgccacatgttgccccaggctggagacaccagtggccgcggatcttggcatccacctgcaagagctcccgcctcccgagttcaagccattctcctgcctcagcctcccgagtagctgggattacaggtgcctgccaccacacccagctaatgttttgtatttttagtagagatggggtttcaccatgttggccaggcagatctccaactcctgacctcgtgatgcacccccctcggcctccccaagtgctgggattacatgcgtgagcccctgcgccctgcctgtttgtagtaatttttaggcacccaatttccctcatcttttagtgcccttttcctttctgttcaggtaaatgtcaccctgtgcccagaatggatgacccggaaccttaaagagtggctgtaaaagattgcagagttatcataattaattgcttacttgcgtta

SEQ ID NO: 551156 - DNA, 112 bp, Homo sapiens
cagacaaggcatctgcgggaatgccaatttcgcacccatcgcgtacggcaacccgacgcccatcgtccccagccccccgtgagttgagccagcgacgcggttcgtcgaaacg

SEQ ID NO: 551157 - DNA, 936 bp, Homo sapiens
gggacgtgccggctcccctcgggactcctcgccatggacgcggacgactccctgtggcccccaagggctccttgcggaagttcctggagcacctctccggggctggcaatggccatctgggtgctgaccagcggcggggatgctcaatggtatgaacgctgacgtccagtgccgtggttgctgcatgggtatctactgtgtgggtgccaatggtgtacttcatctactgatgggctaccagggcatggtggaccggaggctcaaacatctgcagaaggcctgactgggagagttgtctccagccatcctgcagagtgtggcgtggactgactcaatttgtgccagtgccgcgggtgcccaagggcctttccgaactgcgggggaaggccgccctgaatgtgcatgctttggcaaacttgctcgcagcgcgggaatcaccaagcttgtgtgtgatcggcggggactggggagccttcaccggggccaacacttcttccgcgaaagggcaggtggaggtgggcatagctggaggacgcttgggccactgagaacggacaagatcagatacatgggatgggcccgttgcagaaagtgtaacgccgatacccatccaaatcgtggttggggcgatttggttggggactccaattccagaacacatggaatctccttggcaggggacagcggactattggaaaccgaattcgggaccacgtgactccggggcccgtggtgaaagagggatacaatcgggagggatacggatcgagaggccaacatcgataggaagcacatgggtgcacatcaaagaccacccaagaaggaaccctatacgatcaccttgggcagggttgattggggacgcgacaacctagtgggggtaacctggagccctggttgacgtcgcttttgcgccttggagggtgacggacatgg

SEQ ID NO: 551158 - DNA, 555 bp, Homo sapiens
  misc_feature (15)..(15): n is a, c, g, or t
acgcggcaccgcggntcaaggaagagctaacctcactgcttgtaggtagaaggaaaaaaggctctaaggtagcaaaagcttctcatttcagagagatgccaggatcctaagtgcctgccaaacttaccaattctaaggaataagtggatggatggcattactgattcctacattactgaatgattctgcatccgaaaatggttttattaaaaacattctacatcatgtgtggggagataaggaggataaaatgaagagaaagaatattatggaggggaagtacttctgaatacaaaatgtgttgaatttgttaaataagtattacattcacagggttcaaactatttgaggtaaagagattatatatcaagaatccatccctcaacttacccaggtggtcacttgtcttttcctggtgtatctgcccagtattcattcctgctgatatcagtcaagaatgaatgatacgtgtctccttcactttatttcattctagccaggtagcagactgtgtagacttttctgcactgcccttgtcataacaatctatctcgc

SEQ ID NO: 551159 - DNA, 393 bp, Homo sapiens
gcagcccctactactactaaattcgcggcctgcggacgagaataattacagatcattctctgagaacactgtcctagtaggacgagttatagttcataggcacttgggtataaacaggaaagccaagataaataaagatggtagtgcatttacactgaaatttctccgtacaattttggttaccgcttcacttaagaaattcgtaagggtcagttacagtgcctcacacctgtagtccctgcactttgggaggccgtgaggggaactgcttgaacccaggagttagaaaccagcctgagcaacatagtaagaccccatctctacaaaaaaaatttttttaattaggcaggcgtggtcatgtgcctgtagttctagctacttcggaggctgagg

SEQ ID NO: 551160 - DNA, 150 bp, Homo sapiens
gattaaggatgacctcaggcacatttggggacaacacacggtagactttcaaaactcccaaatggaaggtggctgctgtcctagggcaggggactgctgttccctgacgtgctggggtagtttggtctaaggggcccctaggctgcccac

SEQ ID NO: 551161 - DNA, 262 bp, Homo sapiens
  misc_feature (7)..(7): n is a, c, g, or t
aacaagngcagttaacccactggttcccctgaacaaggcagttaacccactgttcctagaccagttaacccactgttcctagaccagttaacccactgttcccctgaacaaggcagttaacccgctgttccactgaacaaggcagttaacccactgttcccctgaacaaggcagttaacccactgttcccctgaacaaggcagttaacccactgttcccctggacaaggcagttaacccactgttcccctggacgtcgacgc

SEQ ID NO: 551162 - DNA, 474 bp, Homo sapiens
  misc_feature (13)..(13): n is a, c, g, or t
  misc_feature (220)..(220): n is a, c, g, or t
  misc_feature (230)..(230): n is a, c, g, or t
  misc_feature (248)..(248): n is a, c, g, or t
  misc_feature (262)..(262): n is a, c, g, or t
  misc_feature (269)..(269): n is a, c, g, or t
  misc_feature (274)..(274): n is a, c, g, or t
  misc_feature (349)..(349): n is a, c, g, or t
  misc_feature (374)..(374): n is a, c, g, or t
  misc_feature (432)..(432): n is a, c, g, or t
  misc_feature (466)..(466): n is a, c, g, or t
ggctggcagtganactgactgcgtcggggttgagactgggtggatgaggctcaccccggcggggagaagggacgaggaggggcggacagcggggtccgggagtgtccgccatgtcgtttgaggtgaccgttgcgtaattgtgagtctgtgagagaagatgtgaagtatggcctcgtcccggtcatctgggcgtgcgggtcccgggttttgatcgcgcgtnagtgtagttntaacttctagtcatggcnaatgatcgcagganagcacanactgnaccctgctacgatctctcttggagtggatcagactgatgatcaccaacaaccaactcattcccggataaatgaanaatagagtgttacctacttcagtgnggtttcaaccctacttcttgcatcttgacactgtatggtttcagcgtagtgcccctgntcattagtccccctgatgttccattcctctctcntctttctc

SEQ ID NO: 551163 - DNA, 368 bp, Homo sapiens
  misc_feature (6)..(6): n is a, c, g, or t
  misc_feature (20)..(20): n is a, c, g, or t
  misc_feature (66)..(66): n is a, c, g, or t
  misc_feature (134)..(134): n is a, c, g, or t
  misc_feature (146)..(146): n is a, c, g, or t
  misc_feature (153)..(153): n is a, c, g, or t
  misc_feature (188)..(188): n is a, c, g, or t
  misc_feature (217)..(217): n is a, c, g, or t
  misc_feature (336)..(336): n is a, c, g, or t
  misc_feature (358)..(358): n is a, c, g, or t
ggaganacacgctgggccgnccccagagcggcgctggacagagccaacacaatctatagatttctnttgaactcggaatctcatagcaccaatattttttgcacagacactcttacttacatgtctcatcgganactccagaacanacatcanaaggaaaacatttaaagttgatgatatgttatcanaagtagagaaaatgacaggagagcaagantctcatagcttgtcagctcatttgcagcttacatttttggtttcttccacaaaaatgataagccatcaccaaactcagaaaatgaacaaaattctgttaccctgggagtcctgcttgtnaaagtttgcacaaaaaaagaanggatgtatgt

SEQ ID NO: 551164 - DNA, 281 bp, Homo sapiens
ggcacgagggaggcaaaagacacttcttacattgtggcaagaaaaaatgaggaagaagcaaaagcagaaacccctgataaactgatcagatctcatgagacttattcactgtcacgagaatagcacgggaaagactggcccccatgattcaattacctccccctgggtctgtcccacaacacgtgggaattctgggagatacaattcaagttgagatttgtggggggacacaaccaaaccatatcagcatccttccaattatctaatattcttgctcgtgc

SEQ ID NO: 551165 - DNA, 317 bp, Homo sapiens
  misc_feature (128)..(128): n is a, c, g, or t
  misc_feature (143)..(143): n is a, c, g, or t
  misc_feature (317)..(317): n is a, c, g, or t
agaacaaagaaagaataaggcaggtacgaggctgggttggtgcaactctcgcactctgtacttccgccgctccgccgtcgcgtattctacttgcccgggatcggcaaaattgtggaacaggaaacgcnggaattccggcccgncggtcctgggtttcatttttggaaccaaatgtgggggcttaccctggggcaattggtttggccaaaaatggccttgtggtttttattggcgttaggggggggggaaacctggaaactgggcctctccccacccccgtggaagggcccctcggtttggtatttttccccttttgn

SEQ ID NO: 551166 - DNA, 145 bp, Homo sapiens
agttacttggctgttcaatcatctccagtgtcctcgttacattctctttgcacgcattccatgtccattgcagggcctcttgtgcctcccacttgtctccagtatgaggcacacaatttggtgtgcagggcggcagtcatgtgca

SEQ ID NO: 551167 - DNA, 349 bp, Homo sapiens
gtggctctggcctatggactcagctgtagttgactgaagtcgctaaacaggacggatttaagtagaggtgatatgtccagtcaccggcatagagacctcctctgcgtcaccatccacacacagggcttctggtagacatcaggcaaagccctccatgttaatattcatctgaatatggataattagggtggctagcaaaactatcactgttaaaatagtggagatttctgtctaggccatctatggctttcatgtcctctgcagtcaactggaactcaaacacctgcacgttctgtctgatgcgctgctcattgtagctcttggccagaaccacaaatatcggcggatc

SEQ ID NO: 551168 - DNA, 152 bp, Homo sapiens
gtgttccttccatcgtcgggcgccgagaaccgggcgtcatggtggcgcttgggccagaaggactcctacgtgcgcgacgaggcccagagcaagcgtggcactcctgaccctcgaagtaccccatttaagcattggcactcgtcaccaagctg

SEQ ID NO: 551169 - DNA, 677 bp, Homo sapiens
gggtgtcctctcagccccatttctgagaacaggtgaatggcagaacagccctggccttggcccaggcagtctctctgtgtggcgccctatagagacctctgtcgccctcagttccgtcctgctcttggcaaattccagaccctttgcagaaatggccgagagccctaatgcctctccgtcgactctgcactcccaagaaacagcaacgaagtttaaggatgcttctctttcgggtggtggtggttgtagaagttctcaggaatttagaagaatcattgctccgaccaaaaagaagaagaaaaccaacaaaaaaaaggggggggagcagcacgagaagagtatgtcccccaagcgaggggccccaacgaatcatcacccgcaacgccccaagtgtattccgacgtcaaaagagtgggtacccacaatacaggggggagatcagaatctgaagacccaaatccgccagtaggccacgatctcgctacccacaaacgggaccgcaaccccgacgcgccaaaaccagcggctcaacaccacggagaacaaccctctgcaacagcagagagcccccataaatccaacccggaggagcgctgccaccaccacaggggcgcaaacaagaagccccaaagaaaaagaattatcacaagcacctcccaggggaccaccctctcccc

SEQ ID NO: 551170 - DNA, 162 bp, Homo sapiens
ttcccagggggggggttgggggggggggggccggggcccccccggggggggcccgggggggttttttttttgggcctgggcccccccccccccccccccccttgggcgcggccctttttccccggtggggtttttttttttttttgggggggttttctttta

SEQ ID NO: 551171 - DNA, 293 bp, Homo sapiens
ctggctctgaacttaggggaccaggtgcatcgactgtcatattgaaatacacgtcgtctgtaaggtcccgcggaagttctgtggacgcgcgtgtgatttctggccagtgctctgaatgtcatagtggagacattctgtgacgcgcggtatatacggggggagcatctatgactctcttaaagtagccaaatgcctcgttatctaattagggatgcgcatgaatggatgaggcgagattcctagagtccgtacttatggagctaggtctaagtacagagccagggggtaccgag

SEQ ID NO: 551172 - DNA, 201 bp, Homo sapiens
  misc_feature (86)..(86): n is a, c, g, or t
  misc_feature (197)..(197): n is a, c, g, or t
tgagaccagcctgggcagcatggtgggaccctgcctgtactaaaaattttaaaaagcattggctgggcatggtggctggtacctgnagtcccaggctgacgtaggaggatggctcgagcctgggaggtggaggttgcagtgaaccatgataggccactgcactgaggcctgggcaacagagcgagaccctgtctccnaaaa

SEQ ID NO: 551173 - DNA, 272 bp, Homo sapiens
ccccccagaacccggcagcccagcccccggtgagggggccagtggggggaaaagggggggggtgccccgggatgggccccgggcagggaatgggctggctccagggctgggcccggggcagatttaggttgggggagactttgggttttaagcaaatgggggcctggattcccgttgggtttttcgggggccagacaaaatggtggccttcccggccctgggcgggccgggctttggttggggggtggcccattaattggcccccccctcca

SEQ ID NO: 551174 - DNA, 431 bp, Homo sapiens
gaaaactgaccaagggttgtcagaggtttgttcaggggacagtgattgactagagaaagcacaaaagaatttttacagtggtagaactaacctttatgactttgtagaggtggatacatgatgctatgtatttgtcaagtccataaactgcaaatcataaagagtgacctttaatgtatgcaaacaaaaataaatcaatcaggagatgtggaaccctagaatggaatgcagactgtggcaaatgactctcctagtaataaaaatgtatgaaataatctcagtgaaattgatgtaaagaaaattaagatctaacatagaaaaacataattttgaaaaagaatggtttgactagaaattataaggctaaagaccaaaggaactatatacataaacactgcattccagctggtaaatttgtttcccataaggct

SEQ ID NO: 551175 - DNA, 512 bp, Homo sapiens
  misc_feature (286)..(286): n is a, c, g, or t
  misc_feature (308)..(308): n is a, c, g, or t
  misc_feature (466)..(466): n is a, c, g, or t
  misc_feature (489)..(489): n is a, c, g, or t
tcgtgccgaattcggcacgaggagaagtcgactccctagcagcagccgccgtcagagaggcccgcccaccagttcgcccgtccccctgccccgtccacaatgcagcctgcttttgcaaaggggtccaaccgaagggactatgtcttcttgaattttgggttgaagacagtaaggatgttaatgtaaattttgaaaaatccaaacttacattcagttgtctcggaggaagtgataattttaagcatttaaatgaaattgatctttttcactgtatgatccaaatgantccaagcataaaagaaacgggnaacagatcaaacttttaatgtttggtttacggaacaaggcagaatcgtggccgagtcatggtgcaaggtttaacaaacagaaagggcaaagcttaattggcttagtgtcgacttcaagtaattgggacaagaaactgggcaaggcactgaactttcangactgacacgcacatgtcttaanttcttgaatccgtttcttctgga

SEQ ID NO: 551176 - DNA, 1063 bp, Homo sapiens
ggaacggagccgagatagcaggctgccggcacggcgacggactcgctgtaccccatcgcggtgctcatagacgaactccgcaatgaggacgtacagcttcgcctcaacagcatcaacggaagctgtccaccatcgcttggcccttgaggttgaaaggacccgaagtgagcttctgcctttccttacagataccatctatgatgaactatgatgtcctcctggccctggcagaacatgctgggaaccttcactacccctggatgtgtggagtcccagagtacgtgcacatgcgctgttgccaccgctggagtcgctggccacagtggaggagacaagtggtgcgggacaaggaagtggagtcacttatgggcccatactcaaacatgatgacactcggaccatctgagctggaaaggcggccacatttagtagacccggcatagatgaaagcgactggctgggcgagcgattggctatcaaccatgaccagagagccttctgagccatgacgagactcattatccagatatgataaaccacaagcagtgtacaaagctaagtgaaaaggaagaaacaatcagacagcgaccttatacgaaacacctgtgcttcacgaatgaccaccgaccatggatgcaggagagggtaaacaccatccacgataagggaagtgatggccaagtagctggagactggaaaagtcccaaagtagatattcatccaaatggtactacacaacttggagctataaagagaagacccacgtgcggatgactgcagaggacgcagcatgacaatcgaacaatagagaccacaaaaggatccgaggcacagaataggaagacttgacagacgaaacaacaaccagggacgaagaacaggtgagacagacagggaaaacaccgaggagacacaaaaagcgtccacccaggaccgtatacgtagggaggacgacacgacagaagagttgcacacacgagaaaacatccaaagacgaacgaacagacagctacagccaccgcacagcaccataaaggcctacaatccgaacagctagaagaac

SEQ ID NO: 551177 - DNA, 123 bp, Homo sapiens
tgtgacgccactcactgcctggccttttttgtactactttgactttttacttatacgtgtacgtaacgtcttacggttaccaacacacactcaaacaccctgacttacttaacttaacactaa

SEQ ID NO: 551178 - DNA, 489 bp, Homo sapiens
atttcagccccaattctctcaattcctaatgattgacactggacaaattaccctaacttctatgtgctccgttttatcatctctaacatgcgactagctaccacatgagggtgctgtccgcctgcactccactccttagcctcacacttgctgagccaccactctcgcacatagtacgcccctcaataaatatttgctgatagaacaatttattaatgggatagtgatataattccatttccagagtggacttctggtgggcacatagagtttgatggaaatactagtttttcaattctgtgaagacactctatttgcaccactcagtacaatctgcatccctaatagcaattatcgctactcaactcaacttctcactttttttcctgcgaaggcaatcttgctctgtctcccaggcttggctcagagatctcggctaaaggcaacctcccacctcccgggttccaagcgattctcctgcctcagcct

SEQ ID NO: 551179 - DNA, 279 bp, Homo sapiens
atccaccatcgagctaacctgactagaaaagctactagctaacacaacaacacagaaacaaagacaccaccaccatcatcaccacaacccaaaacggcataattaaactaaaactaccactctaacttctacccactcatcctagccctacacctaatcacataaccaatacccccaagcaatctcaattacaatatctacaccaacaaacaatgttcaaccagtaactactactaatcaacgcccatagacatacaaagcccccccgagtattgcgga

SEQ ID NO: 551180 - DNA, 132 bp, Homo sapiens
  misc_feature (71)..(71): n is a, c, g, or t
gtgagctggcacctacttgagaagagacgagatgctggtggcagggcataggacagcaatggttgtatcanactatgaaagagctcgtccgcgctggtgctgaatgggtgaggagcttcctcagtctcccca

SEQ ID NO: 551181 - DNA, 653 bp, Homo sapiens
  misc_feature (222)..(222): n is a, c, g, or t
  misc_feature (564)..(564): n is a, c, g, or t
  misc_feature (566)..(566): n is a, c, g, or t
  misc_feature (570)..(570): n is a, c, g, or t
  misc_feature (572)..(572): n is a, c, g, or t
  misc_feature (588)..(588): n is a, c, g, or t
  misc_feature (590)..(590): n is a, c, g, or t
  misc_feature (628)..(628): n is a, c, g, or t
tggacactgattgatttgcataaagagttcttgggcctggagtaaaactatgtgctctattaaaatcattggtactttttgaataaatatttcattgttatagtaaaaatctcaatcttaaacaataaagccagaaggaggcgggggatggaatcgtagttgactgaatctggctctggttcacactgatgtgggtatgatttttgtggccctcagaggtcnacatgctggagcttgaactccgtgtggggtagtgagagcagagagatagtgggagatgctgtggtcagctgggctgggctctgtgctgaagaggctaagagttcttagtctttccccagctgctcgatagctatgtgatgtctcgatattcccccaccccatgcgggctccacggtgtgatacaccaggagggttgtcaccagagcttcaccgatggtagtgccttgccattggatctcagaattatgagctaattaaaccccatacctcttcataaaattaacctgccttcaagattttgttatagtaataaaagcggattaattcaaaaaaaacggcacnanctcntncccccgaaaccaaacnantacctaaaaacaattttatgaatcaactcgtctatgtngcaaatgtgagaagattttaggtag

SEQ ID NO: 551182 - DNA, 112 bp, Homo sapiens
gactgtctgaccagtgttgtgtccataatcccctcagcctcttctctgcacgttgcttaaggtccagtgcttgcctcacagttccatgcttgagcaataaagtggaaactat

SEQ ID NO: 551183 - DNA, 572 bp, Homo sapiens
agtcacttgttcccatccaagccccaggcaagggcaggcactccctggctcctgcgtacctcagacacctccagcagctcctaccatggacaggtggtacctgggtggcagtgcaaggggacagagaatcccttcgagtacgactatgaaaccgtccgcaaaggaggcctgatcttcgcgggcctggccttcgtcgtgggcctcctcatcattctcagcaaaaggttccgctgtgggggcggtaagaaacataggcaggtcaatgaagatgaactgtgacagaagagccggcagtgcccacgggtgcatgggcaccagcgatgaccaccttcccccagtgcgcaccacagaccccagcacagtcagcatgggctgaaggaagtgccaggcatcctgggaaccccttcatggtcatcccctcctgcctcagatccttaacttcctctcttccccagcttctctaacaccccactccctgttccaagttgaggagcatgtgtagcctcatccccctggttttcaatgaatccttgtataagcaactgccaatgaaatcgggctcgctgtggtca

SEQ ID NO: 551184 - DNA, 112 bp, Homo sapiens
ggatttgctggtgcagtacaactaggcttaatagggacatgtagtaaaaagtatacttatacaatgttttgtacttgtatttcatgaaattaaaacagtgatgctaaaacca

SEQ ID NO: 551185 - DNA, 287 bp, Homo sapiens
tttgggagatcccctctgctcttcctcccttcgctcgcaccatggctgatcagctgaccgaagaacagattgctgaattcaagggggcattactcattgttggacaaagatgacgatggcaccatcacaacaaaggaacttggaacgtgacatgagagcactgggtcagaacccaacagaagctgaattgcaggatatgatcaatgaagtggatgctgatggtaatggcaccattgacttccccgaatttttgactatgatggctagaaaaatgaaagatacagata

SEQ ID NO: 551186 - DNA, 474 bp, Homo sapiens
agtcacttgttcccatccaagccccaggcaagggcaggcactccctggctcctgcgtacctcagacacctccagcagctcctaccatggacaggtggtacctgggtggcagtgcaaggggacagagaatcccttcgagtacgactatgaaaccgtccgcaaaggaggcctgatcttcgcgggcctggccttcgtcgtgggcctcctcatcattctcagcaaaaggttccgctgtgggggcggtaagaaacataggcaggtcaatgaagatgaactgtgacagaagagccggcagtgcccacgggtgcatgggcaccagcgatgaccaccttcccccagtgcgcaccacagaccccagcttctctaacaccccactccctgttccaagttgaggagcatgtgtagcctcatccccctggttttcaatgaatccttgtataagcaactgccaatgaaatcgggctcgctgtggtca

SEQ ID NO: 551187 - DNA, 1102 bp, Homo sapiens
tccagccctggccgggaggatgggaccggctctgctgtgagcggtggactcggtggcctcgtgctgtgtggcgcgcacacgcagtgcggtggcggccctggggtgctggggcctctgcgcggctgaccaggctccacagagcatgtcgagcagccgacacatggcctgagccagatccagccagacccctggggcggacgagtgactgcgtgcggaccaagctgtggagacgccgggctggaaggccccggaggacgccggccccagcccggaagttatgagatccgacactatggaccagccaagtgggtcagcacgtccgtggagtctatggactgggattcagccatccagacgggctttacgaaactgaacagctacattcaaggcaacaacgcagaaagagatgaacacatcacagatgacagctccagtgacaagctacgtggagccctggttcaggtccttatagtgagtctacacattaccatgtccctgtatattcccgtctgaacagcaatttgatccacccaggcctttagcagtcagattgtcttcattgacggatagaggcgaaatgactgtgtgtgtacggtctattcgatggattactagtgcccaaaagaatcaagaccaactcatgacattagcacgcatctcacgggacgatggcacacgtcgccacgagaagggttactacactgccaggctacaacacgacctgaccacttgcttaactcgcaacacatgcactgcgggtggctcaccacacctgacccccaccacagcacaccgcccgaccaacactcccgcacgccgcgcgccagcgggccacaccggcaccagcggcctcaaataccaaacgcaaggcgaccacacaccacacacgcacacacgcagaccaacacagggggtcgcaccacacacacgagggcacagcagcaccacaacaacaggcgccagaagcccaaacaccggcgaacaaacagagccacacaggcacacagcgcccagctgagatgaaccaacgcacgagcacacacgacatcaagaccgagagccacatcgcaaacgctaagccgacacgacacgacaacgcgac

SEQ ID NO: 551188 - DNA, 144 bp, Homo sapiens
gactcagactgaggctcgcgccttgctgatccccacagctcacatggtagaggctgctcctcctctcctagcactgtatcagccttgtcctttggtaccggacactatggctttggccctgtgtagggagaaacggtgccacag

SEQ ID NO: 551189 - DNA, 286 bp, Homo sapiens
agaagtttcaatagctggagatagctatcatgggaataatcaaggaaaatatcctgctcgaggaaaaaaaattaaacacgacacacgagaaacagaacagatagaactggagagcgtcccagtccgtaaataggttatatgccgccagaagacctcatcatattagacgatctgattataaacagataaactttgggtaatgaggcatgtcactatagattcatctaacctacaacacccattgtgcagaaacattccagttgctattgaaacttctagaaactag

SEQ ID NO: 551190 - DNA, 317 bp, Homo sapiens
tgtagcacaataaggaagggtccccaggttggggagagccccaagttgagaacaataatgaacaattattgtatgaacaatggttagaaacagctaatcacaaacaacctgcgggcacaatgacctcattccacacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 551191 - DNA, 165 bp, Homo sapiens
catcttcttttcttcagatgcgacggcgcgctctttgctggtgctgcaacgagcaccgtggtttcttgcacctgtcatcatcaggtatgcctcccgccgggatcattgagccctgccggagctagtggggagaggtttacaaggtcaaggttgtgagcgccgtcc

SEQ ID NO: 551192 - DNA, 255 bp, Homo sapiens
ctctagaggacacccacgctgcacgacggatcaaagttaagaacgggaagaatgggtgcaaggtggctcctggaagagctcacccagcacaggtgccctgagctcggggccttagtttactagtccctaggggaatatttatatattaactaacattgtttctatagaagtacacagaagaaatagagaaatataaaaatctcgaggggtatggggaagaaaacgtgaggggactacagcagggaagccagaagc

SEQ ID NO: 551193 - DNA, 104 bp, Homo sapiens
tcaggagtgttgagaatgagtgtgaggcagtattataccatagccgcactaggttttaatagtacttgcggcaagtactattgatccatgacgagtgggggctt

SEQ ID NO: 551194 - DNA, 113 bp, Homo sapiens
gactagttctagatcgcgagcggcgcccttttttttgtttttcccttacaggataaaagcctttatacagaaacaaattggaacctttcatataaaaccttttctttaaaggc

SEQ ID NO: 551195 - DNA, 959 bp, Homo sapiens
gtgccccatcgtcaacataaatataatactagcataggaacatctcacttctaggaatactaatatatcgccatcatgcctcagtgttctccctacctgatgccgtagaagtggtagtaggtactatctgcgtgtacatttatagctaaaactctgtaactcgcttcattacccgacatcgccgtctgtatcccagtatggtggcctattgcacatactggattcttggccgcgctgtgaagcccatgttgggcctagccctactagtctcgatctccgtacttcattatggacattaccattacgttcgtaacctaaaactattcctaatgctcatggacgtactctgtcccagcaattatttttacttagcattggacgtgagttgccaaagatacacattaattttgaatctaacatcggccaccacaagcgcttagtaattgagtatcgttccctcttacgtgattgtttacccaactgtcaatcaacaatcgctatgtgagcttgttgcccacaagctttaacctccgagcccgataaaaacccccctcctaaatataactaacttgatcctatcccgcacacatcatcggatgacaaggccattatccagtgggccactatgacgaagaaagagtctaacctgtctatagtaatttaccctgcaaatcgccttagttatacattcacaggcacagaggtaacagtatttatatcttcttggaacgcagatatcccagccttggtatctatacgatgaggtacatgcagatgctgaacaggcctattctattataaccttataaggtactcccatctgaaattactgaacacaggcaaaattaatgagccctgccaaataaacggccatataaaatatcaaaatatgaaactggcagaaaacaagggcacgaacaggacaaagggaaacaccgcacaaccaggaaagaaaaagc

SEQ ID NO: 551196 - DNA, 347 bp, Homo sapiens
agacagggtcttgctccgttgcccaggttggagtgcagtggcccatcagggctccctgtaccctccgattcttgggttcaagtgcccctcccccctcaccctttcaagtagttgggactacaggggcccccccccccctggctaatttttgtattttttgtaaaaaggggggtctccctgggttgcccaggctggtttcgaactcctgggctcaagcggtccccccgccccccccccccaaagggttgggattgcaggcatgagccccggccccccccccggtatttttatttttcaaaaatttattttttttttccctgttttaaaataaacccaaagttttgata

SEQ ID NO: 551197 - DNA, 304 bp, Homo sapiens
cacatgtggtacccactgagatagttataatggccaatatagtaaggagagtataagctagacgacccgcttcgagaggtactggacgtaggagaagacacgtgctcaggctagggagagtcgtgggttctgctctttggattagatgccttagaagactccctctgcggcgacagagacaaactgcacctgtcgtggacccagaggcatttgtggtccagaggggcagagaggcaggcacagcgaccaacaaagttcaccagctagttctccaaaccttagtcctcccaccacaaacgtggga

SEQ ID NO: 551198 - DNA, 216 bp, Homo sapiens
caatagtcggctcggaccacgatatcggtcacaatgaactagttattaacagctacgtgacagcgacgatagaaccgttggctagattggtcccacctcctctcgtgtacaaagaaggaaatggaggccacgtcctatctcaactgcaaggttccttggtactcctatttccaaaaacctgctctaactacttttatgagcaatacaggtaactgg

SEQ ID NO: 551199 - DNA, 152 bp, Homo sapiens
tctaccagtcttctcccacagtctccctgtcttccaattccagttatttttcctttctagtagagacaaagaagacacattttatccgtggacccaaaactccggcgccagtcacagactcgggaagatagtcttcccttggtgtttaatcg

SEQ ID NO: 551200 - DNA, 229 bp, Homo sapiens
aggtgtctagagatcccggctgatatgatgagggagagatgactgaggctgctcatcgaggaacatgaggcgagctggtgatggactccacgtcatcagtacgggacttacaaaatgaagtgtgggaatcatttaacctatgagcatctcatgggggcccaggactctgacgggacggagactgggccatgtccgtgctgatgctgacggctggccatcttcagaatgg

SEQ ID NO: 551201 - DNA, 435 bp, Homo sapiens
gctggctctagtgtggagaaatgcagacatgctccttacactgttttcccattccttggtatttctaactgcatacccatcatccccagtgttgacttagcctcccaggagaaggcagcaaggaacagcaactattaatagaaggtgtagaggccgggcagtggctcatgcctgtaatctcagctctttgggaggctgatgcgggtgggtcgcctgcggtcgggagttcgagaccggcttgacagatatggtgaggccccgtctctactaggagtgcaagaacgagctgggcgtggtggcgggggcttgtggtcccggctgctcggggggctgtgacgggagagctgcttgagcccgggaggcggatgttgcggtgggccaggatcgcgccactgcgctccagcctgggcaacagagtgagactctgtctcaaaa

SEQ ID NO: 551202 - DNA, 1250 bp, Homo sapiens
tctctgttttctcttttgttctatgtgtgtctgtttctgtgggtgtttggtgcggctgtcctggttgtttgtgtggtgctgttttttgttttgccctgtttgctccgtggtctggcgctttctgtgttcatacctgtggtttttgattccgtgtcttttgttggatatgtgtgtatcagttttcacccttctggtgatttttttacgccgttttaggctcctgttttggttgacggctgttccttgctcattgtgtctaccgtgtgttatacgtgtgtactgctcacggttatgtttcagtttgatgtttttcttgtgtttaaccttctagtagttctttagtgtactggatttattgaagtttgtgctctataatttggtaatctagggttcaatggaaagtcgttcagtcttcggtactatgacctgtatgtctgtggcacttccagtgtaataataaggtgatgaataagatgagctaagtatgtttatggtgaatgattctcctgcctgccctatctcagagccatgaaggtcatctttgtctagagctatttttacctatgtatttatcgttctgtgatcatatatgccgcttgatttacgtatcatgctatctcttaaggacctagtagcactttatgtagtttttaatttaatcttaagatctggttacggtgactgattatgcctgtctgccagttcctttggaaatcaagtggcatagatctgtaattggtttttacggggccccacttcccaattcatgtaggtatgacatgtggatatacacgacaaggatcttagattgatattttgggcttggggcagtgatgggcttagtacaccccaagtggtttgggaaaggaggaaggtgagtggtgggtttatagggcggaggaggaggccaggctggtctaagtgctgactggcctacgtagttcgggcaaatcctccataagggaaagggaggatttgcttagaaggatggcgctcccagtgactactttttgacttctgtttgtcttacgcttctctcagggaaaaacatgcagtcctctagtgtttcatgtacattctgtgggggatgaacaccttggtatctggttaaacagcctgtacttttgatagctgtgccaggaagggttaggaccaactacaaattaatgatggtgtcaaatgtagtgtgtttccctactcaccgtgttcctgagaacaaatatcgtcccgctttgtctgtcctgtctccc

SEQ ID NO: 551203 - DNA, 1002 bp, Homo sapiens
agttggtggcaccacagaagaatctttgatggaccgtgtcataaaaatcggggggtgagataaatccttttgttgtgggggaaaaaaccattgatggttgtgagatgggaagccaacctccggtgcacaccaacgggggttctctctctttcacagggtgttgttaaagagatctttctctcgcgtagacattatataggggacggcgggccttcgtggttgtttggggagaccctcagaacagatgatttggccacacgctggagtactcccctctctaaggcgctctcaacgaagacccctctcggggagaattcacggagggcacgcgtcgggccacagggggtttcacctctctatcaaatatccctctggcagaaccccccacacctgggtttccacacaccgcgtgggggagaactcacacagaggggggaatataccgcagggacgcactatcacacacgctcttggggggagacacaccaacagggccacgttgtgcacacacatggcgtgagtctaccacgcgcattggggaagaaattttttgtgtatacaggtctgttcgccacacaccccaagtcttctacccccacaagcgtttatagcgcccccgggagagagccctgtgactgttttttctcctctagtcttctgtgtaggcgccaccagccctgattaagaatctctgtaatagttgggataaacacagggggttaaccacacaagtgggttacacatggagataaatagtgggacattggcttcataggacaccaccctagggggacccttgggccccccaaagctggtggtgaaaatgaaggagaggagccccacattttagaagagccccttatttggaggagccctgaaggcttcacgaaaatggtagggtttatcaggggggtataaattgtccaaattgttaagggggcttacccagattatttctaatttttaaaccctagaattaaaaggacacccggggttttttta

SEQ ID NO: 551204 - DNA, 925 bp, Homo sapiens
tctggggagaaatgttcttgggggtggcccaccgaggaggggtggagtttgttcttcgggcggcgtgattatgtggtcttccccgcgcgatccaacctgctgatgtgtttttcttggggggggggcgcgtcctttttttcccctcgctggctcaagtgttgtgcgcctacatacggtcacccccctcgcgcggtatgatgtctttcattgccgctgtctgttttgatggagagggaggtacccccgcgcggcgtctgtctgtctgtctggctgaatggcgcagccccccgctcttgtctttcgcgtgcgtgcgcggggtgcttcctctcccatctgtggggggtcggctgtgagagtaggagagcgggcacgacacgatatgagatgaggctgcgtgagtgtaatgaactctctctctggtcgctcccgcataatgatagaagaggaggtgatttttttcttagagagaggagagctccctccgccgcggaccccgacggttgtcttcatcacacgtggtggggtttttgtcccacagtaactcactccaccacccagcgatctgtcggcgggggtgtatatccgaccgccgcgccgcacctacatctgtgtgggttccgcacacaccacggcggtggttgactcattcctcgtctgctgtctttgttcgccccgctgtgatggttccccacaggaacaactgatttctttgttcttgggctgtcttcctcgcaccgcgggggtggagccctcccgccgcccctcgtacagagaagggaagagatccaccaccaagggaccccagtgggggcgtggggggcggcgggaaaacaacgaagaagagaggggaaaaccccccccccccccccggggggggggttttttttttttttccccccaaaaaaccggggccccccctctttta

SEQ ID NO: 551205 - DNA, 588 bp, Homo sapiens
ctctttccgtgctgcggagtcgtagctcatggctctcttggctacacacccaagactccttggaaagctttctagtactgcttctccccaaactatgtcgagaggaagaaaagtctggtattctgagttctactttttttcatttccagtagtaagtaagtgctgctccaccaagctgagaagaaatggcccttggctgtcctcggggccagtgctaggaactctggaccagccgtctgtagtggggcatgacttcgtgctcgggcaagtggagggcgaattccaaggccactaacaccgggaattcaaaggcaatcagttctcgcctgttcagccggaacttctcttccagtttgtcaattaaatgcttgacttcgtgttttttgaggtcacttccaattttggctgctaacagaacacatgccccagcacacagcttccggttctgtttgttgagttccccttgagggcgagcttttcaaagtagacgaagggcatggccaccgtgggctcctcaaggccacagtcctcctgcgcaagtttccgaatctctcggttcagactcctaatttggctgagtgtcagctt

SEQ ID NO: 551206 - DNA, 326 bp, Homo sapiens
ttggatgcaatcttggcgggcaggtggaaacccttctccggtgtgtgcaatgtgttgaagcttgtttcctgcagccagaagatgggttttcttcttattctttcctttcttatttccttatttttttttttttaaattttttggtcttgacaagacccatccccgggggcgtaatattcttcaaaggacacggatctaataggtagtagagtagtgtgtagtgtcctatgctcgcgtgtgtaatgggaggtaataattaaatgagtagccggtgcggcggtgtactatggccgagctactgtgtctccaagccccccgccaggggg

SEQ ID NO: 551207 - DNA, 213 bp, Homo sapiens
ctctatttcagcagagagagaacagattgaactatcttggctaagtgtcatcctgccagtcaggaagaagccaccctccaggtaccacagactcaaagtggctgtggtaggagacccaccgacctgggatagggtgatgtcacagacactagagaggtttccagtctgcagatggccaaggagctgcagccttctgccactgctggagcattg

SEQ ID NO: 551208 - DNA, 1276 bp, Homo sapiens
  misc_feature (556)..(556): n is a, c, g, or t
gcaggagccaggtcggtatagagcgccagacggtccgtcggccgtcggcgtcaagctggtccacatcccctgggctctagcccgcacactagtcagcccttgaccgtgcgttacgccacaagatttacttgcaatcacatctgaataaatcacttgaagaaagctatatatgcgtgctactggcgaccaggtgtggcgatatggggccgcgtgtttggcatgggactgatctgaccgttatcgtgatctcaggtgatctgaggtgctatgaagacttgcatcaacaaggaggtccaagaatgccaattaccgtttcgacgaacgtgtcaatatggaatactaccagactgctagtctagtgagatttccagcctggtcttgcgcgggctagtatgaccctgcttgttgcgtgaatagcaagcccaattctgacgtagaaggaaatatccagtatttcgtagagctcatgttcaccaatgggtgcacaattctcacaaacctattagaggagagaatgcaactagccatttaaggatatctctggagatcaccaagngacctaaagttgggatgcgtgcagaatgagatctctgtccatcgtcttcattggactagaagagcaaggacaacttcgatgacaaaacagagtattgatactcgtccggcatgcggtgggggtacggcaacttggggtgtaatgactcggtggactaacatgctcaagtagaggaacccgtggttctcctggcgatcatgacgatgacactaattgtgcacggttcaacgcacgcgttgtggtttgtaaaacagctacagtggaacaacgaaaaggacatcgagatataggcgtgaggagacgatgcatattagatgaccgacagaacatagcggtaaacagacgatcctcacggtggccatcgatttcgcacaagggcgacgctacctccgtgaagacattccccatctatctcacaacacacggctgggatacgccccctttagttctctttctctcgatgggtgaacacctctcattgtcaagcatctatcggggagctttttcacaacaggcgcgaaactgcgggacgaaagagaactggcaatattcgcgccgcggacaaacactggtctcaatgaacgtagctgcagcatcacccagtgtgtcacgtagtgcacatgtaaactccccgcctgtgtaaaagccccactgctgattgcaacaacaggatgggacgcgaaaacgcatcttagatccaacgcagatgtgccgtcatta

SEQ ID NO: 551209 - DNA, 378 bp, Homo sapiens
  misc_feature (258)..(258): n is a, c, g, or t
  misc_feature (303)..(303): n is a, c, g, or t
  misc_feature (333)..(333): n is a, c, g, or t
  misc_feature (339)..(339): n is a, c, g, or t
gctcagctagatccgagttattgtctcatgaccaggaaaaattaggcacgggaacatcaaagagtgagtggaatagaatttattaagcgaaaaggaatgatctcagcaaaaagagcggtcctgaaagcaggttgctggttgtcttccttcatagttgaacacaagggcttctatatccgctgatggggctgggttccctatttgcatagggcatcaattcttggttggctccaccccatctttccagtgcgcgtgcgngtccttagtctgagccactccacattgatttatttcctttacttncggcatgtgtttaaggggacggaatttttncattgncggggcattgttttggggcaagcctttctgttgccacaa

SEQ ID NO: 551210 - DNA, 423 bp, Homo sapiens
gtagactataggttgaatcgaatataaattgtatgatatgaatatgctacagtacatgtatccagtctactagttagtggacattgggtacattctgaattctaggcttatacaatgaaagcttcttttctccttctgctgtgcttgtattcacacttctgttgagtacagatccagaagtaggaacgctgggtcagcggcccagtagagtctgcgcttgtggataagtctgtctctaagttctgtaactttatggttcacatactttgatcattatatgaagtgcattgctctcttattgataattgtataatctacctattgaattggccttcgagtgagatatgaaatgcctctcttcctctaacatcgctcaccacctgcagtacgcagggtctgatgatgagttaaactgtggaagct

SEQ ID NO: 551211 - DNA, 323 bp, Homo sapiens
  misc_feature (59)..(59): n is a, c, g, or t
tggggggggctttccccttttggtttttttacccccggggggggggcccaaaaaaaaantttggcccccccccaaaaggggggggggtttttttttttcccccccttcccctagggggggatcccccccccccccccgggggggggggggggggaaaggttttttttttttgcccctcttttggaccccccccccaaaagagggggggggttttttttttttttttttttttttttcccccccccccccctttggggggggggggggggggggccccccttttttttttgggggaggggttttttttttctgggggcccccca

SEQ ID NO: 551212 - DNA, 341 bp, Homo sapiens
tcatgataatagatggcgaaggtggttatgtgtgtagatactaataaaatatagtaaaataattcgaacatgaagatttttgagtattatcttgttttaatatagtttagttggaagtttatgtactataattttcttttcttttttttctttttttttggagacagagtttcgctttggtcgcccaggttagagtgcaatggcactatctgggatcactgcagtctccgcctcccaggttcaagtgattctacggcttcagcctcccgagtagctggaattacaggtgcctgtcaccacacccagctaattttggtatcttaaatagacaaagggaaaca

SEQ ID NO: 551213 - DNA, 495 bp, Homo sapiens
gcagccacagaactcatttgggtgaagcagtggtccaaatttgtccaaatatgtaagcatcagttaaagaaaaatctcttccacagactctaccctcatttttccaggaatgtgtatggttggacatagtgggaacaagtttaaaaagtggggacttctgctttcaggaagatggagtagatgtacattgccctattcctcccactaaaacaactgaaaaccttgagcattatatgtaaaataaacataagaagactgaaaggtggagagaaggcatacacactagggacctcagcacccaaggaataacacggtggtgagttccatgggttttctttttgcctaatatatcccaggcttggaactgaagaagctggcagcctggaaacagcaatgggtacagacttgaaaaaccctgttctctttaactcgaaggacgaggaaaaagacagcctagcaagccagaaaacttttagaccataactgctgtgctct

SEQ ID NO: 551214 - DNA, 758 bp, Homo sapiens
gacgccacaggggcaagagggtggtcagaatggtcccggggaataatggagggtcacaagtatgcctcgatcggacatgtatgccagaaagggctactgtacaaagaggacagtacttgcagcccagctaagatccaacggtagaaatagataccacacgatacggagaagggttctcgacaaccgtgattacagaaacgcagttgtgctgcgtgacacacgaagcggcgcgtatcccggggatgagttaaacatatcgcacagaactgccgtagcaatattagtccgtacgtgcacagactgatagccgtcggaaagacatgcttgcaggaccaccgagacgcaaaagaaccgcgtatcaggctcaggcacggtgaccgagaacacgtgagcggacggccaaagacactaacacacacccgccagcgcggagaccgaagtcccgtaggagagacagaataagcagacaacgcgaacagcaggccagccgcgggggaggcagacagaagagcggtaggagcggaaacacagaggagaaggcaaggacgttggagccattaagcataggaggaatctacgataacagcatataggcgaggacctcgcgtagacgtatacagctattcgttagccacgctgccaagcataccgacccgagggcttatcccgagtcgtaaccggcaaccagagaacaatcagccagcgcacaaaggacagacagttggtaaggcgccatctcgggcacaacgcattaccca

SEQ ID NO: 551215 - DNA, 126 bp, Homo sapiens
atatgggtgccagtattattaggggaactagtcagttgccaagctccgattactctgggtattactatgaagaagattattacaaatgcatgggctgtgacgactacgttgtagatgtggtcggta

SEQ ID NO: 551216 - DNA, 177 bp, Homo sapiens
agtggtctggctctctgccgcacattcggcttccttcgtcggccatgtggcattcgtgctgttttccacgcattcgcttctccatcctgctcccccccactcagtgccgcaggccgcctcatctgtctgccccaaaccttccgtcctcaggggctccctccattcacttcagggcac

SEQ ID NO: 551217 - DNA, 104 bp, Homo sapiens
atcagtgggcaagcattttcaggtagcaggcgacaacactcacgcagcctgtgtgcgtttgctgcatccatggtggcatccgtctcagcatgtcgcaccgtgcc

SEQ ID NO: 551218 - DNA, 333 bp, Homo sapiens
aaaccaccaagccctcccgcctgcccatcatatatgtggcccccccgcatgttggggccccgccccaggaatggggtttggacgtgggcccggtctggttcgtgtaaagtccatccatcccaacctggctccgtcccacccaaccaactttccccccaccccggaaacagacaagcaacccaacctgaacccccccccaagccaaaaaatgggaggcaatttcacatggcatgtggaaaatatttttttcttttgcattgatctctcaaactaagttttgatttttgcccagccgaacaggaccaaaacccaaaagtgcattgcactttacca

SEQ ID NO: 551219 - DNA, 418 bp, Homo sapiens
aaaaaaaaggtccccccccccccccctgttaaatccgttaatttttggaaaggcaggggaacccctgccttaggttgcaaaaaagcatcccccccatcctgggtcaaaaaccctggtttccggggcacttgtaaccccccgggctgttttttggtttgggggggtttttcaaaccagctttagggttcaggccgagccaggttccccctcaaaaaaaggtttccccctccccctttgggggttacaatgggggggttatggctgcccccggggggccttagttctggtcccttttaggcagttgacggggcagtcaaatttttaaagttttggacaaagttttcctttggaatccctccccttttttcttaaccacccacctgttgggggttttatttttgaattcaaaggttgtgga

SEQ ID NO: 551220 - DNA, 685 bp, Homo sapiens
ctatgagggtgcctctgtgctccatcctaggcaacagagtgagacgctgtttaaaaaggaaaagaatccttccctagagctagtatcctaaagctgcagagctagcccagacctcattggtttccttgtccttggggtgtcttgtcctgaatctttgggggtgaagggagtgttgctcccagtccagagggcctgattctgttcggactgggttctcaaggagcacgagccaggttctcaggacgacgagtccccttgtgcctccccattaagagggggttcgtcagaagcaagaacagcccctctccgccgagtcacagtctgcaagggtaaggccccgagagcttccatcacattcgccccctagctgctccattagcttctcatgaccatgcattgtgtagaactggcagttcatcgtttgaagggaatgggggagggagcctgggggacacaaagccttattatacgaatagcaatagctattgcatttagagctaagatattaagctctacgcattacgccactttcaatggcgagaaatcgtgcgagcatactaatgggggtaagaaagagcgctgtcggccctaaggaaagcgttgggaggatggttggggacatcgggctccatggtagggtcagatgaggacggaaggggaccaggagtgtgggcggaccatgtca

SEQ ID NO: 551221 - DNA, 380 bp, Homo sapiens
gcgttactcaaacagatcacactggggctttgcctatggagctgtctagaagagggcactatcctccagaccccagaatggtagatccacaaacagcttgcgccattgcacctggaaaagctgcagacactcaacagcaacgccatgaaagcatctgggaggggagctgtatcctgcaaagccacagggctggagctgctgaaggctgtgggagcctacctcttgcatcagcatgatctggatgtgagacatggagtcaagaggaaattatttcagagctttaagacttaattactacctcattggatttgagtcttgcatggggcctggagtccctttgttttggccaatttctcccgtatggacattcggcgtgtgca

SEQ ID NO: 551222 - DNA, 328 bp, Homo sapiens
  misc_feature (91)..(91): n is a, c, g, or t
aaaggtggcctgtcttctccctgctctgatgggaagaaagcaggaggccgggcgcggtggttcacgctaataatctcagcactttggaggnctgaggcaggtcaatcacctgaggttaggagtttgagaccagcctggacaatatggtgaaaccctgtctctactaaaaatacaaaaattagccaggcacggtggtgcatgcctgtagtcccagctacttgggaggctgagccaggagaatcgcttgaacccaggaggtggaggttgcagtgagccgggattgtgccattgcactccagcctgggcaacagagcaagactctgtctca

SEQ ID NO: 551223 - DNA, 119 bp, Homo sapiens
  misc_feature (31)..(31): n is a, c, g, or t
  misc_feature (69)..(69): n is a, c, g, or t
  misc_feature (78)..(78): n is a, c, g, or t
  misc_feature (94)..(94): n is a, c, g, or t
ccctcaacaggcagaagtgtccgttgtcctnggggaagccaagacaggaagagtcataaccatgttgtnggactttanaaactttcctagcctnttgtccagcacatttccaagaacaa

SEQ ID NO: 551224 - DNA, 184 bp, Homo sapiens
gctgtgtgtaagcccctctcataaagggcttaagctcattcaccatggaagagctctcatgacctaatcacctccaaagaccccacctcttaatactattgcattgcagattaagtttcaacatgaattttggagggatacaaatattcacaccatagattatagtaatatagtatagtatata

SEQ ID NO: 551225 - DNA, 251 bp, Homo sapiens
agcttgctgagtagctgggattacaggtgtgcaccactacaacttggctaatttttatacttttagtagagatggggtttcaccatattggccatgctggccttgatctcctgacctcaggtgatccgcccgcctcggcctcccaaagtgctggggttacaggcgtgagccaccgcacccggctgagaatatgtatatttattaagataaagatttgatttagatgtttgtaaaactttttattaatgtca

SEQ ID NO: 551226 - DNA, 231 bp, Homo sapiens
atttgattttcttttttctttctttttttggcctccttaacctttcctttgaaatgcatattgtttttgaaggactttgtttttagcataaatgttgggccttttattttagtgtttggatggaaacctttgtgttggttagctttcctttgctttgtatatttaataatgggcctttattttcccgtatgcctaccttttgtattgccccataaatttttttttagctga

SEQ ID NO: 551227 - DNA, 840 bp, Homo sapiens
gttcttggacaaatggcgccatgtgtgctgctcggtagcggcggggggggggcccagtcggtgtatgccttctcgggcgcccgtgccggcgtgagcctgtgagcctgggctccctgcgggccaaggtactacttatcgagaatgtggcgttccctctgaggcaccagggtccgggaactacaccccagatgaacgagctgcagcggcgcttccggacccgtgggcccttgttgtgctccgggttcccgcgttgcaacccagttgtggggcattcagggaggaacggccaaggaaacggaaggaaggattctggaattccccttcaaagtacgtccgggcctggttgggtggggttccgagcccaattttcaatggctcttccgagaacagtggcgaggttgacacgggtggcggggggccgccacccttcttcttcggccttcctggcgggaaggccctggccaagctcccaggggaaggagcggccacccggggctttatgaagccggaccccaaaagttcattcacctgttcctccgggcgtggtggtccggcacaccgattgttcgcctcttggaacctttcgtggagaaagttcccgtgggtgggggggcccctcgacagggtggttggccaccttaagggcagggtacacgcgccggcgggtttcccaagaaccatgtggaacaatcggaggccttggacatcggaagacccttggtggtcctacaaagggggacaagttgttgccttaagggggggccctttctttaaccgggggttggttgggaattcgcaggtgtgcgtgactccgggggggggtacaccacaatgaggggg

SEQ ID NO: 551228 - DNA, 345 bp, Homo sapiens
ctggaaaaggtgggccctaaatccagtgagaggataggaaggccagcactcttattctgtcctaataagagacagagacgggcacgcagagacacagaagaaggccatgtgttgatggaggcagagactggagtgatgccgtcccaagccagggagtgcctggctccgccaggcactggaagaggcactgaatggatgcttctcgagagcctttggagggagcatgaccctgctgacaccttgattttgcacttctggcttctggaactatgagagggtaaatttttatggcagccctagaagacgaatcccagagccaataaagatccctcttcccctgaaaaa

SEQ ID NO: 551229 - DNA, 239 bp, Homo sapiens
cgcgtcggttatgaactatgtgatctcagttctctttcaatatccagtactgtaagtttctgtgacctgtagtgtaccattctcaggtggtgttatggtttggatgttttgtcccctccaaatctcatgttcaaagtgtgactttcagtgctagaggtgggcctagtaggaggtatttgggtcatgggggcggatcccttatgtatgactttgtgccatccacatagttcagcgtctga

SEQ ID NO: 551230 - DNA, 244 bp, Homo sapiens
gacttgttgaggatcagcggggcggattccagcacgaggagtataccagcactttgtgaggccaaggaggacaagttgcttgaggtcagaagttcgagaccagcctggggaacatagcgaaaccctgtctctacaaaaaaaaaaatggaaaaattggcccggtttagtggcaggcgcttgtggtcccagctttccgggaggctgaagtgggagatttgcttgagctggaaagggggaggttgca

SEQ ID NO: 551231 - DNA, 801 bp, Homo sapiens
ggagcagaagtggagagggcccgtcgtgacagccacagacggccatgcgcagctggctagcgtgctggcggctaccaccatcaccgctcgcacccctagccgtccctggtcccgcgaccaggcagcgagctggcctgcctggcgtgtgtactcgggacgtgatggctggccggagcaggctgatggatgcgacgtgagcagtgacgcgctgctgccagctgcggtccacgctgtctcatgcacttccagtactcaaactccgtgcactcttccatcaaccccgtgccctggtgcttgggtggctccgtatgatgctggccgtcggaacgctgatctccagagtcctcgcgctctgacgtcgctttgctcagctctgccccgcgcactcctcgaggctccgtgcccgcagctggctgtcggtccctgctctctgctgcccacgtgtgctgcgcttccacggacaccccggtcccccagcagccatgtgatcgaagacgccactgaaagccaggcgctgctggaaggtgatgacggatgaatcgagaatctgccgtgatgtgtgctggccgccttgcttgggagtccgtttcatcctgcgtcatcgttctactttccagagacgtatcgttgcacccccagtcatgcgggaggaatccctttggttgttggacagtctgctgccggatcggtggtcccgatagccccctgcatggaactctacgagcccaatccagctggagcttctcgacatctgctgtcctgcaccaggatgcgggtgggaccctgtgactgacacgtgcg

SEQ ID NO: 551232 - DNA, 378 bp, Homo sapiens
ttctagcaacactttcttttctttttctttttctgagcccaggctggaaatggtgtagcacaagcatggctcactgttgccagatctcctgatgtcaagtgatcctcccacctcagactccctagtagctgggaccacaggtgtttgccaccacacttggctgcattttggtagagctgggggtcttgctatgttgcccaggccaggctgaggcaggcgaattgcgtgaacccaggaggcagagtgtgcagtgagtcgagattgcaccactcttcccttctaggataacagtacctataagcaacttgtcactatcggttgtttttttttcccccacctcttgatagcgagggtctatcggaagtataaagcgtttag

SEQ ID NO: 551233 - DNA, 378 bp, Homo sapiens
cctgcttttttcccgttttccagatttcctaataagcgatgtgacttcacagcgtgacctttttatatacattttatatctggtatttgtttagaccttagcagtgttctgaggccgggcgtgtggctcatgcctgtgatcccagcactttgggtggctgaggtgcacggatcacctgaggtcaggagtttgagaccatcctggctaacgtggtgaaaccccgtccctactacaaatatccaaattagccgggcgtgggggtgggcgcctgtagtatcgcatgatctgcagggtaaggcggaacaatggcgtgaattcgggagtggagatcgagcctgtgcactccagtctgggccgcagaacaagagtccgtctcaa

SEQ ID NO: 551234 - DNA, 304 bp, Homo sapiens
  misc_feature (73)..(73): n is a, c, g, or t
gttcttgaaaaaaaaagaacccgggtttttccctaaaatgggataattaggaaaaaaatcctttggtcaaaangggttaatttcctttaaaattcccggtggccttattaacaaaataatcagggcctttgaatattttttaccccgccctagggggccctttcccctttcaaatgggcacagggttgggcaggggggctcatcccaaaaattccacccctttgggggggtaaaggggggggatcccttggggccaggagtttgaacccaggtggggcaatttagtgagccctttttttcccca

SEQ ID NO: 551235 - DNA, 933 bp, Homo sapiens
gagcggggtaatacggctgagtatggtggcataggtgcagcgcgcagcggtgaagtggatgcccttaaaggaaccagtgactgccctggaagcgccagatgcgtgaaactggaagagaagcttggcctgtggaaagctgataatctgacacaatgaaactatatggaacagtgcgtgacagggagtgagattcagaatatcgaaggaggaagatggctcagtcgaaccttcagctgtataccaaagagacatgataaaaagttatagaatgtgccccttggacaatttgagaatatgtctacctagtgagtgaaagcctgacgtggaaaagggcggatgggcgagagcacgggaaattataataatgcaactgcattgacaaataggtgatagacagttcaccttgaaaggcctgagagggaaaagcgtacaatcctgggacttaacagctatgccctgatggggtgacttaacctaggttcacaataagaggaaaacatttgcatgaatataaaggggaaagcgaggtttggaaaaccttaagaaggaatgagaacaagggggtagtatacaagagagaaaagaatattgtcaagataatagtccggaatgaaacgcagtagaaagtaaaggagagtatggggagcaacactttatgctatctgatgaaatattaataaaccaagaagacaggagacttatgctataaacgaatccttccaaattgtccatgtaacaaaggaagaaaagtgacttcgcatagggtgacagatatctggccgaagttgttgtcagggatgcggcaaagcaatatgaaattagggggaaataagggcaattagaggcatcatagatacattgaaaacaaaacggaaaacacggccataacggaagaaatattgagaagagaaacagagttacaaccaacataat

SEQ ID NO: 551236 - DNA, 152 bp, Homo sapiens
cactgagcacgacgagtttcccagggcgtgactgagcaacacctgacgaaagtcattagaactgctttgttcttttagtggtgactgtgcagctgtgtttttttgttttttgggctagggggtttgaagttttaaacttttctttattattc

SEQ ID NO: 551237 - DNA, 223 bp, Homo sapiens
aggatatggcccgcaaggaatgtgggtgccggcaggacaggcgattggtggctatggaccgccccctacaggaagaggagcccccacgttgtaccaaacaggaggttgctacatgacgggcaagtgcctagctaataatacgactcactatagggaccaatgagcagaagaaggaggggggtggggggcgcgtgtgggtggtgggtgtgctgtgggtgtggcg

SEQ ID NO: 551238 - DNA, 385 bp, Homo sapiens
tttcacgtgtgtggcaagatgctgagctcggcttatatttcggaccacatgaaggtgcacagccagggtcctcaccatgtctgtgagctctgcaacaaaggtatctggtgaggtatggtccaatgtgcggtcggccagcggcagccggccggacagcggcagacagcggtctagccagtatgcaggaccctcccacaggctgtgggctccctctcgggggcggccgggcggtgcctgtgagctctcagacaacttccctcccaaccctggtgagctccaagattggttgcagggggagaggggagaatggagtagagtcccttgggtacagagctcctctccccacctcatgtacccaccaaatccgtatatacctaccaaacaa

SEQ ID NO: 551239 - DNA, 200 bp, Homo sapiens
tcgtatagcatacagtctttgtgcattcaggcaatacagccactagactttcttcacctgtttgttaacacagtcaggctctgtctcactgaagagaggatgaatcatgacatttccttaccagccacaggctggcgactaaatttgccttgatatcgtacaacgtctgtcaggtcttaccatcgattaatctttattag

SEQ ID NO: 551240 - DNA, 235 bp, Homo sapiens
aactcagcaaacagtctccagcagtaaggtactcaggactaaactactctacataacaacctccgtggtgtcagggcgcctacttactggcatgaaacaatgctcctgatggagtcttaagtaccaggtaagtatatgtacagtataaacatatacaggagcggagcaccactgggaaggtagaccgacacccattactataccgagccatgggcagagggcttttgggcgccat

SEQ ID NO: 551241 - DNA, 274 bp, Homo sapiens
  misc_feature (191)..(191): n is a, c, g, or t
  misc_feature (202)..(202): n is a, c, g, or t
  misc_feature (238)..(238): n is a, c, g, or t
  misc_feature (240)..(240): n is a, c, g, or t
tttcacgtgtgtggcaagatgctgagctcggcttatatttcggaccacatgaaggtgcacagccagggtcctcaccatgtctgtgagctctgcaacaaaggtacatgccaagggctgccgggagggccaagggcaaaaggtgggcacctgaccaaacaccttgccacagatacaggttaaaggtgctatanccaaaaactcntaacgtctaaattcctacaaaaagtcaaagaaacancnaggggacacctaaataaacatcattaaactctaa

SEQ ID NO: 551242 - DNA, 401 bp, Homo sapiens
ccgcgctctaggcgtcagcgagtgcgcggtccactgcggtcgcaacctgtcgcaactcctagagcgcgccttgtggagacacgggtcccagacctgcggcttctacatgggagtgcgctcggcggaagatatgctggactcgctggagagagactacgcaggaaagcgcccaggcacccatcaaatcagagagaagggattcaccttcttacgctatggcaggttagaaagtactcaatggctatgcacaccaggaacccaaggctttcaacggatccttgagaaatgtggctgtagatgaactgagcacgcagggctgtaccgtgacagaggctgagttgtatgccatgaactctgagccgcgggccacagacgatatcactggtactctctcttcctgg

SEQ ID NO: 551243 - DNA, 384 bp, Homo sapiens
tgtcgtcggtagctcggctggttcatggagcgcgccgaatctgaagacccagaactgcagcgcatggttcggatgatcctggatcgtgtccagcccaagtaattcgttcgaatgccgctggcaggcctcacggttgctgctggcggcgtatctccttgcccagctgtttgcgctgggcgcgctgttgtcgctcgacctgccttattcaagcctcggaatgctggtgtgcatggcgcacgctgcctgggtcttgccgcgtcatctgttactgactcaccgttcgtcgattcgtggcttgcgtcgcgatgaagatggctggcaattgtacagtgacgagcgcggctggcactccgtgcagttgcgtcccgatagcgtcgcattgcc

SEQ ID NO: 551244 - DNA, 137 bp, Homo sapiens
ttcttggagatcactgtgcagcatggtgactatgatactgctatgtttatttaaattttcagaagagtagatctatgtgtttcttttccccttctcccagtaaaaggacattatttgagggtgatgggatatgttta

SEQ ID NO: 551245 - DNA, 2248 bp, Homo sapiens
caggcgatcgtgacatgctaaccgatctttgcgggccagactacatcagagagcgtaggcttcgcaactgatatggtaacgctgagttaggcataccagaatgaatagatgcgtagtcgagttattctcagttgctaatccacgaaaatgaaatatatacccgctcgcatatgccataatgcatacgacgtgcctaggtcaacgtacttatgcttcaaccgcaacgctacagccgaagtctcacataatgtccttcgaattcagactagtcctcatgtgaagcaagtattactttctccaggaccagatgaatgcatagagccacatatatgtaccgcacatcaacgatatctgtcattcaactaagtcataaactaggtcgtatacgacacattacaccatgtaagcgcatatagcacgccactgttcagcttcctgagttgcgcaggaggattgacctcaatgggcactcgctctacttgataatgccgtgtgctgtctctcgttctacgaaatgcaatagaatatacttaggctcaccatcttcagctcatataccgaaatctttatcgctcacgtaccatggtaaggcacgttcgtcgcatgcaccatcgtctcgaattcgtatatccagtcatacgcgggacaagcatcgacggtggactgtaagatcaaatgccagactagggcaaagaatcgttagcaataagtccctcaaattagccacactcggaaggaacttcaaaagggggaactactggtaccaacccttataggtaagccaattctaaacttgacgtatttattattattcccaagtaattaccgggattcctacgtgagtcataacaaggtcaaagccaagaccgtgataagattcttcgcctctgacaaactgacttggtatcaccctatatgcgaaccgcgctacatggggtggcccgaacggttttggcatggcgtcaacatgcaaaatagtgtctccccagaagcaggaacctagccattcacgcctcgacgcccagctaagaggcagaactccccctgcctctcttatacgctcagtcagttcgttgttcgcgtctctttcttcacatacatacacaataactaacacacaatccaatacaaacagtcaaaacgctaaaagtcaaaacaaaacaataaaaacaatgacaactgaaaaaaacaataaaaagaataaaaaaaaacaagaataaaaacaaaaaaacacaacgaaacaaacaaacatcagcgagtgaaatataaataagcacaaactaaataaaaaataaaaaaataaacaacaataaaaaatacaaacacaaacctaaacaacacacaagacatagagaaaaagaaacaaaaagaagcgaagaagagagagagagcaaagagaccaacgagatagaaagaccagagagagagaagaaaaggaaggaagagcaagaggagagaaagacagaaagaagagaaaaagaagaagagaaaagagagagacacaggaagaaaacaagaggacgagagaagaagaagaaagacaggacgcaacaggaaagaacagaagaaaaagagagcaaacaaaaaaagaaacaaagagaagggaaagaaaacagaaagaggaagagagaaacgagaagaaatagagaaaagaaaagcgaggaaccaaaagaagcacaaagccgaaagagaggaccggaaggagaaagacaaaagaccgaagagcacaaaaaacggaaaaggaacaacacaaagaaaagaacaagacaaggagaaaacagaaagcgaaagagcggacaaaaagaagatagcaagaaaaagagcaggagaagacgagcaaagcaggggcagaagaaagaaaagaaaacgaaacacgagaaaagagaagaaaaggacgacgcgataaagagaacagaaaagacaagaagaggggaagagataaccgcaagagagaaatagcagatgagaaagagcaaggatagacgagaggaaaaacaaaaggagaacgcacaggaagacacacgaagaagagagaagagagcaagcggaagcagagagcagagagagagagagagaagaagcgaaggagaaggaggaggcagaaagacagagagacagagaggagcagagacgagagaaaagcgaagaggaaaaacgaagagaaagaaaggagaacgcagcagaggaagaatagaacacataggagagagcagaacgcagacaaagaaaggaaagacaacagagaata

SEQ ID NO: 551246 - DNA, 189 bp, Homo sapiens
tcccaagtgtataatgtgggtgtggagtttcatgacagaatatacacttttggtaaatctgtactttttccaaatatggaatgccttattttggaattcttaaggattttaaaattgggagaaaagcacttaaagtttcgtatatatgaatatacatgtaaagctgttaaaatacgttaactctcagtg

SEQ ID NO: 551247 - DNA, 99 bp, Homo sapiens
gacacgaccttgatgaacatcagaacaaaatatggcctgtctaaagaagaaaacccgtatgctagatttgacaacactaaagcgctccacacatcagtc

SEQ ID NO: 551248 - DNA, 412 bp, Homo sapiens
atgaaatttttaaattgtagtaaatatacatgagaaaatgtagaattttaactattttgaagggtatgatgcagtggcattaaatacattcacaatgatgttttgagaactactttcatcatcccaaataggaactctccccattatatagtaacaccccattctcacctcccccagccccttgtacgttcttaataatctttttgtctcaatgaattcgcctattttattttattttatttttgagactcagtctcactctgtcaccgaggctggagtgcagtggcccagtcttggctcactggcagcctccgcctcccaggttttaagtggattcttcctggccttcagccttcctcaagtggctggggactacaggtgtggaggccagtgtggccgggcctgggaattt

SEQ ID NO: 551249 - DNA, 1177 bp, Homo sapiens
gaaaaatggcggctggcggtggcggcaggatgcagatacgaacgggaccggaggcagcagcgggatggaggtggatgcagcagtaagtccccagcgtgatggcctgcaggagatgactgggagatgtaaccgtcgcttctccatccccttgtcatatctcaaacgatcgtcagaccacttggaatccgaaatgcagctccacaggaagggggcggacctgttgcgaggtgaattggagagctctgattgggcaagccaggaggtgccgaacatatcgacggtgaatgaaactccatattgaagcatggcatagtcccaacaaccagatggaacgcacgaacgattaatcatttgaacaacggacatattaattatacaccgaaggcaggcagcaagtataaaaccagagtgtccaacgcgagctgagaagattctggcgagatatgggtattaccaacaagaggggggccaaccttgtaccccctcggggaacaattcacaacgttccaattaaagcacgcgctgatgctgaaggaatcgatcgagagaggcccacacaaatcatatatcctgcaaaggtctgaaaacgccattaatgaaaccaaaggcaacaacagacaatctatcccatgctacaagcagatacactacggaacgcactcctggctccaattcggaatagattacattcgaactaggcgcaacaagggccccagaaaattggcctggatgacaggccatgacggccttgaaaccattacaacattccatgtggccccacacaagaaacgagacaaacaggccagtgaacaagcggcgcccaattggggcacacggtattaagagaacccccaaccggtatagacaccgccccgggacaaacgtttggcacacccaagtgctacaaaaatcataacgtggggcacacatggacgtgagtagaacaagcaaaaagtgtgacaaaagccttcactgccacaccagcagttggacatgagcagccacattgggatacaagcacagagccgccttttagtacatatacgtgactcaaaagcaccaaagcaccaacccacacatgcacgcagagaaccacgcaacgtacatccaacaacacgcgcacaacttagtactccattgtgacaccacaaaccaaaggttgaaacctcgataccgc

SEQ ID NO: 551250 - DNA, 133 bp, Homo sapiens
atcatgaacgacaccgtaactatccgcactagaagctcatgaccaaccgactacttcagaggaaacaaatggtcattgatgtccttcaccccgggaaggcgacattaccttatgacaagaaattcgggaaaat

SEQ ID NO: 551251 - DNA, 190 bp, Homo sapiens
ctggccaacatggtgaaacaggttctctactgaaaaatgcaagattagccaggtgtggtggtgcgcacctgtaattaggaggctgaggcattataatagcttgaacctgggaggtggaggctgcagtaaggcgaggtgagatggggccactacactccatcctgggcgacaaagcaagactctctttcga

SEQ ID NO: 551252 - DNA, 248 bp, Homo sapiens
caaaaggttgggggaagggaccaaggaaaagggcttaaaaaaggtcttttaacaccttggttggaatgggccaaagccccggaggaacattaaattacaaaactggctccttgagctgagtggaacagcagcaaccaggcatttgacctcggtgggaaagcacccatgttgcacgaggcttcataaatttctggttctccctggagtctctgcttctagaacacattagccacacaaaatcctcaaaa

SEQ ID NO: 551253 - DNA, 137 bp, Homo sapiens
gtgatgagaggattggttatgaggttgagactgtacctgtctgatctcaggcaactgccgcgcagtacccagggatgagggcgatgtggtctttctgcgtggtcaggtctgatgaaggggagatcatggtcgagatg

SEQ ID NO: 551254 - DNA, 395 bp, Homo sapiens
  misc_feature (13)..(13): n is a, c, g, or t
  misc_feature (122)..(122): n is a, c, g, or t
  misc_feature (154)..(154): n is a, c, g, or t
  misc_feature (200)..(200): n is a, c, g, or t
  misc_feature (232)..(232): n is a, c, g, or t
  misc_feature (361)..(361): n is a, c, g, or t
  misc_feature (376)..(376): n is a, c, g, or t
  misc_feature (386)..(386): n is a, c, g, or t
ttcggcgacacanggaagaagaaaggaaaaggcgagaggaagaagaacttgcccgaagaaacaggaagaggctctgcgtcgccagcgggacaagaaattgcattaaggcgacacgatgaagnggaagaaagacagcagcaagaagaagctcttngaagactggaagagaggagaagagaagaggaagaaaggcggaacanggaagaattgttactcaaacaggaatacgganggctgcaaaatgggcccgggaagaagaagaaccccagcgtccgattagaggaagaacccggcttgccggattggaaagaggaggcatcccagactcccggcattgaaggaaagaatgaaccggaatganaaaaggagcttgganggttccaccnggccagaat

SEQ ID NO: 551255 - DNA, 875 bp, Homo sapiens
tcaatttgaaagcaggtactgtttattaaccaaccagcttaaaaaaataatcatggtagacacctttagttcattcttctaattaagccgtgtttgactctggtccctcccgtgttggccagcatctccaccttctacaaaagtggggtggtctttttcttcattccacctcggtggagaagacaattgtgaagggccacaggaagttattggccctctttgaagcgttttccaacagtattaaatcctcatgaattcaaattcctccagtgcagatgatgccgtatttaccaagagactcgagcaattcaaagcgtttattctggtcaaagcaattccgctttcttaattggattttggccataaaccacgtcttgtagattaagttccatttatctggatcttcgagatattgggggtaaccccctatgcaattatatggctctacgaatcctcaagcgagtgtttaatcgaagcctttggttgagcttcacaagaggtcccatgtgaagaattggacgaaggcgaaagaagcgtgcaacaacctttcgaaccttggggcctcacctccattgatacctcgtgattctgatgacaaacgccaattggggtctctgcaggtacatagaagttgccagcttttcattggcatcctcgcattcgaatttcagtcctggacatctgcctaatatccttgagatagagaatagcttttcaataagataaggtatctcctagcctttcgagcctctttggggaaaattttttctcaggcgtgaattgcagttttggaagtacttgggtttactaaggggtctggacagaaggacctcccttttctcttgaaagccgttggtttgaccccagctcagtta

SEQ ID NO: 551256 - DNA, 168 bp, Homo sapiens
ctacggacctcctccagagtttcctcttgcttagccctgctccaggcataagtcaccatctttcgggttctaacgacgtgcgctcgtgctccacctcacctgcgcggctgttgagactggtccggtggtctcgtccttctgcgcgaaactcataatcgtacccaggtt

SEQ ID NO: 551257 - DNA, 477 bp, Homo sapiens
  misc_feature (279)..(279): n is a, c, g, or t
gcgtggtcgcggccgaggtactgccttggtcatggggcatttttggaggtctcggggtgtgcaagaaacctccagtaaggggggttgagtagacagggaaaaactcagacgcggagactggcagaaaatgggaaacaggaattctaggcctgggagccaaaggaaagagggagccaaagagactccgtctgacattcccctggatagtcctttggggagattgttgcaggtttggtggaacaaccctcgaaccagggacaaggaaaaggaaaagatgantaagtattgctgttttgtctggcccaaagaccccattcataagccttctgtcttttggcctaagtttggctcagatgaggattgtgttctaagctttaattctctctgtgaataataaaacttcatcctcacaagaagagataggttactctctgctgaatcaaggaattagcccccatgatccccctcaaaaaagaa

SEQ ID NO: 551258 - DNA, 180 bp, Homo sapiens
aactgcagtctggccagctctcccttgctcattaacctgatacataggagctagtaccattcatttccaaatgctcccctttgtggagtgcataggttggcctgacagtagtcactgaccccagggctctcctatgcccctggaagtacccacatggccttgagtcaccatctattaaat

SEQ ID NO: 551259 - DNA, 106 bp, Homo sapiens
gcctggcagtgcagtgagctgtctggccttttgtccttgatccttggttaaggaaatgaccaaccagtacggtattctcttcaaacaagagcaagcccatgatgac

SEQ ID NO: 551260 - DNA, 668 bp, Homo sapiens
  misc_feature (259)..(259): n is a, c, g, or t
  misc_feature (472)..(472): n is a, c, g, or t
  misc_feature (538)..(538): n is a, c, g, or t
  misc_feature (574)..(574): n is a, c, g, or t
tattcctgcgccggcctcgcctcgcttctcaatccaaggctcgtgacactaaggtattgatagaagacacagatgatgaagctaacacttgaattttctgaagtctagcttaacatctttggttttcctactctacaatcctttcctcgaccaacgcaacctctagtacctttccagccgaaaacaggagaaaacacataacacattttccgagctcttccggatcggatcctatggactccaaacaagctcactgggnttcttttcttttcttctgggttaattttaattttctattttcaaaacaaatatttacttcatttgccaatcagaggatgttttaagaaacaaaacatagtatcttatggattggttacaatcaccaggacatagatacctatcaagatgaagaacaagccttgcaaggaccctctgatgggacggtactgagatatcttggctttcgctcaancccggtttgacttggttgaacccgacaattggttttaaatttttttgcagtttatggtgagaaatntttttttttcttcatacccaacggcaaaggactggncgaacttgcagggggaacttaaagcagtccttcaattatggactactttttaattggagtaacctttcttttttggggttgctggggggggggg

SEQ ID NO: 551261 - DNA, 695 bp, Homo sapiens
  misc_feature (299)..(299): n is a, c, g, or t
  misc_feature (317)..(317): n is a, c, g, or t
  misc_feature (348)..(349): n is a, c, g, or t
  misc_feature (352)..(352): n is a, c, g, or t
agcggagctccagcaagagcgcgggcgggtggcccaggcacgcagcggtgaggaccgcggccacagctcggcgccaaccaccgcgggcctcccagccagccccgcggcggggcagccgcaggagccctggctgtggtcggggggcagtgggccatgctgggggcagtggaaggccccaggtggaagcaggcggaggacattagagacatctacgacttccgagatgttctgggcacgggggccttctcggaggtgatcctggcagaagataagaggacgcagaagctggtggccatcanatgcattgccaaggaggncctggagggcaaggaaggcagcatggagatnngantctgtcctgcacaagatcaagcaccccaacattgtagccctggatgacatctatgagagtgggggccacctctacctcatcatgcagctggtgtcgggtggggagctctttgaccgtattgtggaaaaaggcttctacaacggaggcgggaccgccaagccgcctcaatcttccaggtgctgggatgctgtgaaatacctgcattgacctgggcaattgtaacaccgggatcttcagccagaggaatctgctgtactacaagctggatgaaggactcccaaatcatgatctccgacttttggcctctccaaggatggaggaacccgggcagtgtgctcttcaa

SEQ ID NO: 551262 - DNA, 528 bp, Homo sapiens
actgtatccacctctacctgcagtaagagagcaaggagcgggtccggatgtaagctaggaaggagacgctgtcctgatgagaggtgctagactctggtttcggagattgagaccaagccatcaggatccaggctatttcagaggaaaggcggtggagatacaagagatcacgctgataggagcagagcatctgtggattccggcagctctgaggaaccatggtggagctccaggagcgttttttccaaccttggtgcccctgggccttggtgctggcagttgggagccgtggctagtgggggttggccagagctcgggcacaggaaagaacggtcgacccggagttcaactccagacgctacaggacaggacattaggctagtcagacttctgagaactccaggggaatttgggagcccaatgacaaaccttggagccctcttcggatcactccaggagacatccctcggaggaaaagaagagtatgttgccacccacttagagcaccacagagaccacagaacccaa

SEQ ID NO: 551263 - DNA, 339 bp, Homo sapiens
ggaggctgaggcaggagaatcgcttgaacctgggaggtagaggttgcggcaagccaagatggcgacattgcactccagcctgggcaacaagagtgaaactccatctcaaaaaaaaaaagattatattatcggtcggacattagatattttcaattaatctcttattgttagacatgtcatctgttccaaataactgccactcatacttctggcagagccagaactagaatacaaacacccagtagatatatgtaaaaatgtctctactaaaagtacaaaattagctgggcgtggtggtgcatccctgtaatcccagctacttgggaggttgaagtggga

SEQ ID NO: 551264 - DNA, 1158 bp, Homo sapiens
gggcctaacgccaggcgtataaaagccggtacggaactagctaccggagggcacggcgctaccgtaaggccacccaactagcaaggacccctaccccctacgggcgctacccataggcacagtatacgcgtatcgagagtagacctagcactacgctagctatacagctaggatagcacccatacccaatagcaccccctagcgcgctaggcagcgcaaagccaaggaagccgcaggcccggccccctacacccatagccgggccgccaaccgatacccacagcgccggcaggactaccgggcccgaactacctaggcaaataccagtatccaaggtatacagaccactacctaagcaacacctaggcggtgaccgctatatacccccatacgccagtagctagcccacgataggcagtaggcccagctaacctacctagagcacaggcagaaccaggcctagaaaacagcccagcacgccccacccaaccaccggaccccatacagaacagcctaggccctatcgcaaccctagaacccggcctaccggactagtacccacggacagcccaccaataccctaacacgcgcctaccagcgggcccaaccacccaccaacatcgatagccggcccacaaagtcgcgcttactacaagcacaccaggaacctggccaacagtaacctaccttacacaggcccctatcatcgcactgggcctcacctttacccttaggctcattacgccattgccccgggcacattgaacccctagccccggtcatcacccacttacaccccttataccccctatgcccccaagaaacatccggctaaattaccccttaagggcaactaagccgacccccttatagcaccttctttcctcccgcgcacactcctttggaaccttaaccttatcaacctccttatgcacacaccccttatagctaaggggactctccggccgcatcggttaatccttaataggggtgccactacttatcgtaaacaccttagcgccctcctgttttagagcccccacctcaagagtcaatcataaaatctctccgtctaggcacaggtcaagcccccctatgcatgatctgtaacatgttatagctcctcgtgccttcaaccaccgcagttcttggacacca

SEQ ID NO: 551265 - DNA, 441 bp, Homo sapiens
tcgtgctggactacaggcatgcacacatgccagctaatttaaaattttatagagatggggtctctatgttgcctggtagtctcaaactatggtctcaagcaatccttctgcttcggcttcccaaaatggctgggattctagtgtgaaagctggcgagtgtctcatcaagacactggcagacaagggccactgacttaatataaatggtcacatatctgtacatagctgctcccctactcacctggtggactcccatgtcctgctgcagctgtggctattgcaaaagcagaagccggtgaaacagagcagtgggcattgtccgccgtctgtcctggttatttgaaaagaaaggaaatggaatggtgaggcaaatggataatattctgtaacaaaaatcatcatttttcttcctgcaccagatgaaggactgggccaaatgcc

SEQ ID NO: 551266 - DNA, 106 bp, Homo sapiens
tgactgtgtattatctttgcgagaagcaaagatatggccaggtggtatggtgacgatagtggtggtgatggtgatgtgtgacgatggtggtgatggtggtggtggt

SEQ ID NO: 551267 - DNA, 266 bp, Homo sapiens
tacgctgactcttctgaactgtcatgtacacccgctttatgagagggattccacttcatagcactgaacactcatagatgtgtcctgtagctaaaattcaataatgtcaataatgtttcctgggcttgtaaggaaaattctcaagtgaaattggctttgcttttttacagtgagtgacagtgcctggctctgaggaacacagtgactattagtgcagtctgatgttgctgcatgtgtgccgaggttaccagttttacccaccacgg

SEQ ID NO: 551268 - DNA, 824 bp, Homo sapiens
  misc_feature (209)..(209): n is a, c, g, or t
ggtcctccgtgcgatctgtgcatgcgtgcattacaaagtagagatggatcacaccgctcgtgccttacagggacgctttcacgtggtgcgtatcccttgatgtactggtagactcaatgagtgcccatgtgcttaggtcactctatgcaaatgcgatacactcacgtataacgtgagttagcaggtcctgtgaactgctcgagagtgcnatctatgtgaattctgatacagtcgtgacaaatgtcgcatagtgctgtcttactcactaagtatagattcttgctgaagagggtaccatggagcatgatggttcgtagcttggttgcgacatgtctacgagttgccaaatggttgtgtgcacgagtaagtacagaatcctcgtgtgtagagtcctcgacgatagtgactagtcactacccagcgaaatacctgggtcaggaggggtcggtgggtgtttggcaggcttgcgtgtctcgccgcgtgagagcccacactgctcaagtgtaccttgagcgcgtctttcaaacattcactgtgaacacattgcgactatatcctcgtaagtccgcaggcaagtcccttctggccgagtctcgacgcgactatccttgatgcaattactcgacgcccaagcgctgaactatctagcgctcatcaacggcagcgcagtcatatactgtctacacacatacccataacctatatgccgctggtcgtacacaccaagattcctcctttgtgacgcttttgtgtcacgcttgccacttgccaatgactactgacacaaggagagcatcaaattcagtggggcaccacttgtaatg

SEQ ID NO: 551269 - DNA, 258 bp, Homo sapiens
gtcgagaactactaatttcatgctatttctttctctctccctttgttgttatttgatttgggggaagggagtgaggcttgtccaaattcgagctatctgaacacatcaacagaaatcctatgccgaccatctgaactgagccttccattcagaagcgaacacacttgcgggctgaaccatatctgagcaacgagactctgctgccttgcatatgttaatgtctcatgctgtggcttttttttacagctttatgaaact

SEQ ID NO: 551270 - DNA, 474 bp, Homo sapiens
cagctgccaagtaaaattgatgtttgatacttagaatttttggagtgaaacagcttctggttgaatagttgaattagataacccgactcacctctgaaaggcctactgtgataaagcaatgacatttaaccaaggctgtaatttaattgtactgtaccctttagcaatagctcattgatctgtgaaaatatttgctgcttggtttaattaatttatgatgttagtgagttatttgcaaaatgaataactgcatgttccaaatttcaggcttcagtttataaaacccactttctttggaaaagttgttaactttttcaatgtggttggacagtaggtgtttctgattccatagagcttagaagtagctcagtccaaatgaagccaccaattttatatttccaccaattttatatttcaacttcaacacttgaagtgccacaattacaaactactttacaaagcaagaattcattg

SEQ ID NO: 551271 - DNA, 233 bp, Homo sapiens
ttccccttgcccctgatttttttttaaatggtaaaagcccctgtaaataaaaattgccaaatcatgggacccaaaaaggtgaaaaatttgtttttatgaaaaatgtattgtgctttgaaactaaaaatctgtaaaatgttagttttggtaattttttttttgctgggggatttacaaattaaattttttttgctgggggataaacattaaaattaatcatgtttcaaagttta

SEQ ID NO: 551272 - DNA, 965 bp, Homo sapiens
tgaggcggcgctcgacagttccgtctgcttcagccgcagtgtctccctgcccgtctcgttgcattctccagagaggggacggacctccacttcctctttcagaaaaatgtctgctccagctcaaccgcctgctgaagggacagaaggagctgcccctggtgggggtcctcctggtcctcctcccaacatgaccagtaacaggcggttacagcagacccaggcacaagtggaggaggtggtggacatcatgcgtgtgaatgtggacaaggtcttggagagggaccagaagttgtcagagctggatgaccgggctgacgccttgcaggccggagcatcacaatttgagagcagtgctgccaagctaaaaaggaagtactggtggaaaaactgcaagatgatgatcatgctgggagctatctgtgccatcatcgtggtagtgattgtaatctacttttttacttgagaatgtgccatcccttccctgttctccattgccacccaagctcatgtctcttcccctctgtttgctttctcaacaaactcctccatcctccgttctccatcctggccaggcttctccatgacccttcctttactgttgcgttcatttgcacccttcctcaaaaatagaaatgctgctcgtggtccaagtcctgaagtcactaccgaagacaacggtggagctccctccttacccatttatcgttgtgcctggacctaaaagagttggttgcaagggacggagggccggatggccacgctgactgtcctagaagttagcatactggggagagaaaggatttggtgccgggggtccagcagctgggcttggggagcgccaaaatgaaatagtccacgagtgtttacagttttcggcggatgtatagagaggggctaaagcccacaggtggcacgcgaacacccaaagtgtctctgcaagtggaaccgtgagagaaagcctcacg

SEQ ID NO: 551273 - DNA, 136 bp, Homo sapiens
tcagcaatgtttcccccccgcggacgctagcggagagtagagggcgctgcggtagccttgaagctatggcgcgggccggagattggaagcccgggcctgaccaaaggtgcagatcttggtggtagtagcaatattc

SEQ ID NO: 551274 - DNA, 961 bp, Homo sapiens
  misc_feature (352)..(352): n is a, c, g, or t
  misc_feature (724)..(724): n is a, c, g, or t
ttctgcgcaggagccgcagggccgtaggcagccatggctcccaggccggaaaagcataggacgaagaaggctcgatcaaccatgaaaaacaaggaatgagatgatcaaagctacggaggatcgactgatgcgcaatccaaaagaaccacatgatgataatatagcgccaagaaaccagatggacggcgcacatacatccgcacacctccacgactaatacccaatcatatcctcgaacagatcgacatccccgatcgagtgcagagtatgcagatcagataagggagcggcagcgaggttcagctggtttaatcagtgcctagggagatacttctctaaaatagtccaagantacgacggaaggataggccttcaaaccagacatacaaatggaagaaaaaccggaagggaagcgataatgagaatacctgcaatgatgccctacgaaagccaagcggaacttggcatacaagagagaaaagctgagcgctaaaggacaacctactaaccgcaaaaatgcccgacaagccccctagaagaaagggagaagactggacaaactgaagcggataagacaatcctatcccagcaagagccaatgggcagacggaacttggaccattaactttcaaaaataacaaaaaggcacgaaacagacacgggatatttaatatcgagatttgtcattaatcctggcacattaacaccatgaattatgccctgnatggatctgcccaatgtaccaacattcaaagagcagaggcaaaaaagaatgccagatgaaaatttcattattgcttcaaaaacgaggatttgcggccatgacactttgggaatttttgcccacccaaaaaaaaacagaaaaatacggtatatgatatgttgtcaatttagttggtttaaattggtgttggggttgtaaggggatataaatttttatcttgggcgggctttaattttg

SEQ ID NO: 551275 - DNA, 151 bp, Homo sapiens
tatgttccactatgaagaaggcatgggaatggccggaccgaaacttttctttttttttgatgggaccaaactttcaagccaggaacctgcaacttaacttggcattgaaacttgggaacttaatgaaggcctgggcttaccacccacttcc

SEQ ID NO: 551276 - DNA, 314 bp, Homo sapiens
caccggcatgctcatgtcctcctttaattctaccacactacagtactcgcaatcggcactgaaattagaacgttcaccatcgtacttcaaatcttcggggcatgaagagtcagctagaacaaggaaaaagaaacgtcgcaggtaagtaggtaacgtagagtgggcacatgacaagccaagctgctctgtccaacaccagtgtacatatgctttacactaaataaactccagaggccaacagcagcagacctgctcaattcaccttccatatcagaacaagaccaaaaagctcaggcttgagttgtcaactatgc

SEQ ID NO: 551277 - DNA, 178 bp, Homo sapiens
ccgggaagcgcacggaggcggagaccccgctcatggcggccgacaccaggtgggtgaggaccccgaaggcggggggggtcagctcgagggcgcggaaacagatgtcgcattttgcctcgttgccgacgcagcaggcactatccgtagtctccaccagctgcagcacacacagtgcggc

SEQ ID NO: 551278 - DNA, 545 bp, Homo sapiens
tgtgtagagagtgtgggaggggtggaaggtgcatttgagaaatgaagcatctctctttcggtgaggtagtaatgagtggttgcttgggtaaagtgtctcgttgcgtgatagcagaaaggatatattcattctctccccagcctagagcagaaatggaacagaacatatttctctattttaatgagtatagaattaagtgcacagggttcagaaaaacacttaaagctgtataacgagcactttctcaaaaattggattttgctctcctgagctctcccctagagctttctaccatgtattttagaacgggggggaaaaaaagaaccaccttcacttcttctctcagtggtcaaaacaagacataaaatagatctttctttaagaagagttgagccatttcccagcgatgccactttatctttatggagaaggaagaaatattaccctggggactacaaggtaacatagtgacttaacagcaagactggtaaatactcctttcctgaaaactggtgtaaggaaccaatcactaaaatagaggaaag

SEQ ID NO: 551279 - DNA, 226 bp, Homo sapiens
tgcaaatcatcctcaagcatttgtctggttattgaatcctgataaatagtatcgacaaagccagtacagaagcttctgagagtatttgccagtgtattcagtgcaatatgtagtaaaatatcaatgtagaggtttcctccaggccattctatgaatataggtattagcagttatctcatcgcgtactattaataaatatagcgttcctctagaacatgcacaagat

SEQ ID NO: 551280 - DNA, 221 bp, Homo sapiens
gcgctagcggcattagtgaacgagctcagctgcaatagctgaccgattagcaaaggctgaacatggctgggagaacagcacaaaatccttggggcactggaaatctggggagtttacacactcaggcagactctctctccatgagctgtaccaggctctcagggataagatcagagagccatgagaagttcttcatgccgttcacttaatgccgctagcgc

SEQ ID NO: 551281 - DNA, 818 bp, Homo sapiens
caatagtgtgtacgtgcgaatccggctcgggagggtccattatgccttagctaactgtagctttagttatgggagaagttgaggtggactctatagcccagcatagagtggagcaggtgcgagtcgatacgctacgatagggagaagacggtggagattgctctggagtgcactgtgatcttcaatggtctcattctgtgtcgagttgcggggacgtgcggtgtgtgtcactcatgcacaccgtgactaatctggagcgtgggtattatctgcggagaggagacacgatagtatgagcggtgaagtctcccagaggtagttgtttggaaaaatatggacagctgctggggaccataagtgggagcacaggaataatcgggcaagtgctcagatcagagctgtttggtgcacggggatctgctaaagaatggagttcttaatgcgtgtccacaagaagttcctaggaatcataaatacaggggagtctacatggacctgtctgatgcagtaccgagaccttgaatagcatcgcataaaccgcaggtacagagcatgtttgagagactatgtcccaatagcatgtggggcatgtccctgaagttgactaaaaacgacgggctgcggtgaccttgcagaggcataaggtggcgggcgccaagaaacagctcagagggacgtcactggcaatctcttgacgacggttttgtagatttgcagggatacggaatatgtaccgtgtgtggccaacatgacgacggcatggcaaacgtgagggagggttgcacgaacaaacttgcttcctgctgccagcactcctg

SEQ ID NO: 551282 - DNA, 573 bp, Homo sapiens
ggttgtttcagcctgctgctgctgcttgctgttgcggcataggggaaccgtcgtggggaacggactggtgtgctgaaaaatgtgaaaagaaacttggtacgtgtatattcagtgtccaggaataccattgtgacaagactgggatgctagggaattagcccgaagccaggggacacaaggctgggcttgggcacaacgcaaacaagtgtctttgcaacatgttgaacaatattttacaacagggcctttttgtggagagcattttgcacaagattactatcgaacatagagggccaagaagggacactgggggggaagcttccccaattaaacatctgggcaaccaagaggggcaaaacaattttttaaacggacggggggattttaatccgccatttttccgagcacgaaaacgcgcgcgtcttcgcggggggcactaccacacggggaaaaacaaccgtcttatactatgcgcgagggcacattctaaggcagtgcacctcaaacgagggcagtattttctgtcgccccctttttgggggcctttgtgcgccccaaagtcgccgccatcaa

SEQ ID NO: 551283 - DNA, 1172 bp, Homo sapiens
tacacggacgccctgtgaccccctgtgcacatcccacatcgtgcgtgacggtggcagctgcgtgctggcagtgtcggatcgccatccctggggcctggcggtgtggcaggaaattctgtattgctggtcagcaacctcaacccagagagagtcacaccccaaagcctactttattcttttcggctgtctacggatgacgtgcatgctgcgtgaaagatcctgattcaactaacgaacggagaacgccctagtgcaagatgagctggactgtgaaaccatgtgcccatgcatggccactgagccacactgaacagggcacacaatgctgacactggagaacgccgatccgcatcaactgctatcgaaggcaccagaacgtgcagacttgcacccgcagatgggccacggaggaccaagggacctgacccaaggacctactggcaactcagccccatgtcaaccgcattcaagaagccgggctccaagaaagttccagaacatattcccgacacttcggccactcatgaacctacctccaacatcaccgaacctcagaacataccgagagcaggaacgtccaacggtcactagacaaaccaagcaaatgacaaggcagtaaagacacaagagatcacaagatctatccaagaaagagacccgcaaaaaatgagcactgaaaccacgattggacacaccgaagaagagaagccggaccaacagacacacaaaagaaactgaaccaaacaacagacccagacgatagaagcaacacaaccaacaatacagagacaaccaacatcacaaaacacaagcaacctacgggccaaaaggaacaccacacgcacgagacacaatggagaccaaccacaaaccatcccgaagataacagccccccctaacacaagaccgtcacgttaactaaaccaaacagaaaaatccaatcgaccaaaaacaaacaaaaaacacagcaccacgactacccaagaacatacacacacacaaccacagcagcccagccgaagccacacgcccagaacccacgtgaacagagcaaccaacaaaacgacaacacaaaacagcaaacaaaatagagcctcactcaacaaccaacaaacacaccacaaaaagactccaaaacaagaagaacacacaacagaaaacaaagagaacag

SEQ ID NO: 551284 - DNA, 465 bp, Homo sapiens
ggccctccactacgtatcctatggcagggcgtctccaggatggaaggatacaacattctaatagtgggttcggctagacggggcatagcggcatggccctggtggggagcacagacagcaggataggactccatttctggctaccattccttcatgtctaggagtcactagctttcttctttcctgttactccgggctcaagcccatgaatttcttcttttccggcaggggttgagagctttctgccttagcctaccatgtgaaactctaccctgaagaaagggatggataggaagtagacctctttttcttaccagtctcctcgcctactctgcccctaagctggctgtacctgttcctcccccataaaatgatcctgccaatctaatgtgagtgtgaagctttgcacactagtttatgctacctagtctccactttctcaatgcttaggatacagtagggaga

SEQ ID NO: 551285 - DNA, 564 bp, Homo sapiens
gaccttgttgcccttgaaacttgaaaatagggattctggggtgaggatacaaagacattgtcttgcatatccataagcaggtcttagagcattattccaaactctagctgtttcagtagttctatgaggattgcaagtcataggtgtgtgtggcatatcaatccatctccctcatctccattctcagtttcttccccacaaaatttggaatcaaagcttttatgacgtttgccaattgcagaacttcttcagctaaggttaatttgacgccttttataaaactgagagatgtcaaaaagcctcttaaaaattttaatcttgaaagaactttcagggtttctcattttttaggtggggggtggcaagggttatttcttttttaacaaataaaagggatttaagtaaaactaaaaatgaaaaaaattgggcctttttaacattgtgaacttggggggtttggacccctttggcttgtaacaaattttaatttttgttacccaagaactgtatgaataaaaaaaaaatcccaccccgattatgtgttgaataaatatccaactgtgg

SEQ ID NO: 551286 - DNA, 517 bp, Homo sapiens
gcctgtagccagcactgaggaccgagagctgcagcactctctcatgatggagtcggacctgcccgcctggtgcgcaagggtctaccatctttactggccaagtccaagagccctcgggaggttccttctcccaaagtcatcaagactcgcgagtggtgaagaagacagagtcacccatcaaactctccccggctacccctagtcggaagcggagtgtcgcagtttctgatgaggaagaagttgaggaggaagctgagaggaggaaggagaggtgcaagcggggcagatttgttgtgaaggaggaaaagaaggactcgaatgagctctcagacagtgctggggaagaggactcggctgacctcaagagagctcagaaagataaagggctgcacgtggaggtgcgtgtgaacagggagtggtacacgggccgtgtcacagccgtggaggtgggcaagcatgtggtgcggtggaaggtgaagtttgactacgtgcccacagacacgacaccaagagaccg

SEQ ID NO: 551287 - DNA, 105 bp, Homo sapiens
cagctcggtcccctgatctgcccgcctcggcctcccaaagtgctgggattacaggtgtgggccaccatgcccagcacccctcacttctgagaaacagaacaagaa

SEQ ID NO: 551288 - DNA, 102 bp, Homo sapiens
ctttgccccaatatagcgataccagacatatatggaactcctctggtccgaggttaaaggtctccactaacccgtaggtctcttgccgatcagtagcgtaaa

SEQ ID NO: 551289 - DNA, 1159 bp, Homo sapiens
acaagaggttctattgactgtaaaggagctatacacttgtatgctggtatcaatagtagttcatgtagccgaagaggtggcaatgattacagtgaaaactgcttcaaagctaacagacagttgtatacgcactttacacacaacgagcgtttatgtgatgtaaaattatcggctagggaagcagcagcgggccaggtgtggtggcttacccctgtaatcccagcactattggagaggccaaagcaggacgatcacttgagcccaggagttcaacaccagcttgggcaacataagaagaccggtgatctctggagatttagagtaatgatgaacattagccgaggtcacaagaggagcaatgcgcgcctgcgaaatcaccaggataattgtggaacggcttagacgtgaacccaggacacacatcgaagggacaaatggcggcattggcacaatgaagcccaagtgtgatacttggcgcacactgttaattccaaacccttggggtaaaacaagggtcaagagcaaccaaattcctcaacataaacacaaagaaagcgcgtggcgcgacggacgaaaatagcgccacggcatagccagatagagagccacacagacgggaaacaaaaagacagagcaaggacggagataactagcacaagacgacaaggggagcaaccacgggtaccaacgatgacgaaaaccagtcccacaaaaggaagagcacacaacagagaaagggaagcggcaccccaaaaggagaaaaaaacacaaaaatcaagaggacaaggcgcaggaagacaagcccacaaagagaagaggagggagacgacaccaagggagggacccagggacacgacccaagaagagtaaaacacaaaaagggcggacgctgagggagcattagtgtaccacaatatattaaagaacaatagaacaaaatagagaaacaaaaaatcgggatgacgaaccgagggcgctagtaccccacattagagtaactgaaatcacaacaaaatgggaagaacacatcatacaaccgccgttcaaaggtggggccgcgatcatgtaattcaaagaaatgtagtataagaaggggcaagtcactcgtaatgagcagcgcaggtgatggtcggcaagtcgacgagagacaagaattgca

SEQ ID NO: 551290 - DNA, 668 bp, Homo sapiens
  misc_feature (495)..(495): n is a, c, g, or t
  misc_feature (514)..(514): n is a, c, g, or t
  misc_feature (531)..(531): n is a, c, g, or t
  misc_feature (616)..(616): n is a, c, g, or t
gactagagccttgaagatgaggagtgcagtggccagtcatcggaaatggataatgaccaattgagaacatcatcgaagctgatcctcttacaactataagagagctgcccaagaactcaatgttgaccattttatggtcgttcggcatttgaagcaaattgaaaaggtgaaaaagctcaataaatgggtgcctcatgagctgagtgaaaaataaaaaaattcgttgttttgaagtgtcattttctctattctatgcaacaataatgaatcatttctctatcggattgtgatgtgtgccaaaaggtggattttatacgacaactggcgatgaccagctcagtggctggactgaaagaagctccaaagcacttcccaaagccaaacttgctccaaaaaatggtcatggtcattggttggtggtttgctgccagtctgatccactacagctttctgaatccaggtgaaaccattacatctgataagtatgctcagcanatcaatgagatgcacaaanacttgcatgcctgcaancggcatttgccaccagaagggccccatgactaattggctatgaagtttgcctatctgcatatcacttgactcttgccacaactancactcttaagcatctaacacgtttgagggaaatgcttcacactggcggaaca

SEQ ID NO: 551291 - DNA, 762 bp, Homo sapiens
gggcaaaaaccctgtctctgctaaaaatacaaaaactggccagacatggtggcacacacctgcagtcccagctactcgggagacagaggttgcagtgagctgagatcgcgccattgtactccagcctggacgacagagcaagactctgttctcaaaaaaaaaaaaattgccaagacaggctaaagggctaggcctcttaccccggtaaaccaagttggtgacattgcaagggaacaagttcttgcaaggacgttacacagtgctactcccagtaaacacagggccctaacttccctttcaaggctataaaggcctgagcaggtgaggaagctgcagaacgacacgtttggaagttcacccaaggttgggctcccagtgaaggcttcacgcgggagcagaagccgtgctattcttgttctaaccattaaacaggtgttacggaattacaggcgagcacagctgcagtgaactgggagcaaagcctgccacgcaaagtttatctccagcatacatctgagctgacagaggtgggccacacagtataaaccaactgacaactttctccccacatgcgtcagcgattgaacaaacctgggcccttctcaagtggggcaacacattagaaccacccaattgtgaggggaacttcccccaattaagttctaggaacgcacagcaagttccaatggcacctaagctcaggttccacaaacacaggcaaccgggtgctagactcccccctagcgttgcaacgacggggct

SEQ ID NO: 551292 - DNA, 104 bp, Homo sapiens
gaggtgaacatgagaatcgcgtgggcctgggaggctgaggtagacaatcgactgttggctagtgtctgatctattcaaaatcccatcttcacatatgctaatga

SEQ ID NO: 551293 - DNA, 945 bp, Homo sapiens
tggcggaagtggcgactaggctagtcgaggctcgtgtaatcggcacaggctgagtgcggccttgtggcaacggcttctggccctgacgtggctgccaatcggctgtgggtgactcccggggagcgggagcccgccgtggcgccggactttgtgcccttcgtgcagctgcgcccgctgagcgcgctggctgaagctggagaggcggtgctgctgctgcgggaggggcttctgcgccgcgtgcgttgcctgcagctggggtccccagtgtcctggccccgtggcccgccggcccgggcccgcctccgtctctggccttgccgcggggtccggccgcgactgcgtgctgctgcaagaggactttctggcgcacaggggccgaccccacgttacctgcagcgcatcagctcaaaacccacggagcgcgtggcgcgctgcagactgtggggcccactgccggccagccccaaggccttcaccaggtacccttggagaagggtcggagaccatacagttcctcctcttactcaggccggtccccgctacgcccacttgggtttggtgcaccctgggtggttgtggccgccaagaagctgggtgaaccgcctccaaagttgctccaagaaggcagttgattagacggtgctgtgggtggttggcccgttctcttgcccccatttaaaccccaaggttctcaaaaggcaaagcagccaagggaggctcaagggcgcttggcgggaattgcccggaagggacatgctggagcctcttggacattccagcggcggagctgttaagaaccaccagatctctggcgtaagtcttcagcccaggagtggatttagcaagatcactgaaccacagcccggtggcttcacgtgaactgagcgctataatgctctccggtgcagccaatgtaccctcctaccaggggggacaatggcaccc

SEQ ID NO: 551294 - DNA, 152 bp, Homo sapiens
ccacctctgcctcccaaaatgctgagattacaggtgtgagctaccggacccagccccaagggcaccattttctaagaggagagggcccagcagtgacaaacctgcacggatctgcatggtctactcacagggcaagaactaaccaagaattg

SEQ ID NO: 551295 - DNA, 162 bp, Homo sapiens
gggggggtttttccccccccccccccccccaaggggggggtttaaaaaatgtttcccccccctttttttttgggggttaaagctggcccccccctgggggggggggcgggggggggggtttgccccctcccccctttttcccccaaaagttggggggtttta

SEQ ID NO: 551296 - DNA, 124 bp, Homo sapiens
  misc_feature (13)..(13): n is a, c, g, or t
  misc_feature (82)..(83): n is a, c, g, or t
  misc_feature (85)..(85): n is a, c, g, or t
  misc_feature (101)..(101): n is a, c, g, or t
  misc_feature (106)..(106): n is a, c, g, or t
catggcacctcangactgggtactagttttaatacttaacacttacggacccaacagaagttgggacttacctggcatatannantggaggtgaataaaangaaanatggtggtgttctgttac

SEQ ID NO: 551297 - DNA, 266 bp, Homo sapiens
gtggtcaacagaacagacagtgaggacaacggagcgatcaggatagttcttctgttgacttgtgtcatcatgcacttcagtctcaggaatcctcttggttgaagtccagagtgtcctttctgattcctgaagtatattagacaggcctgggcgccaaggagatacgcctgccgcagtcgatatcagcctgcgcatctccgactcagcattttgctcggtgcagattcagaccgtgctctccgttcccctgtgtgagtggcttgtcc

SEQ ID NO: 551298 - DNA, 389 bp, Homo sapiens
caatcgtctttacttgtcttgactctttttcaggctaccagttgcaattttaaatatggtcgtcaagcaggcctcactgaggtgacatgacgaccatattcaaattgcaatggtaccctgaacaatcgtcttacttgtcttggatcgtttccatagcatacgttggccacatatctagtatctcagatatagatttactctattgatatctagctgttatgatactagtagataccatgcatagaatctatgtaactgatgagggtaagcacctattgattttgtgcgctgctgtaacccaagtgtttcagaacgtgtacctagcacacagtaggcattcaatactgtatcatatatatgtgttaataaattaaagatatttagaatga

SEQ ID NO: 551299 - DNA, 285 bp, Homo sapiens
  misc_feature (109)..(109): n is a, c, g, or t
  misc_feature (137)..(137): n is a, c, g, or t
  misc_feature (176)..(176): n is a, c, g, or t
  misc_feature (195)..(195): n is a, c, g, or t
  misc_feature (202)..(202): n is a, c, g, or t
  misc_feature (212)..(212): n is a, c, g, or t
  misc_feature (215)..(215): n is a, c, g, or t
  misc_feature (235)..(235): n is a, c, g, or t
  misc_feature (238)..(238): n is a, c, g, or t
  misc_feature (243)..(243): n is a, c, g, or t
  misc_feature (246)..(246): n is a, c, g, or t
  misc_feature (257)..(257): n is a, c, g, or t
  misc_feature (260)..(260): n is a, c, g, or t
  misc_feature (267)..(267): n is a, c, g, or t
cttttggggtctttgctcttttggggtctttgctctctctctctctctcctgtctctcagagtccagcctgggcgacagagcgagaccccgtctcaaaaaaaaaaaggnccccttttagattatatggaaattcatnggggctgcccccttacaatttttttcacaggcctggcanggggcctcatgcctgtttncccagcntttggggagnccnggccagggggtttgcttganctnagganttnaagaccagttngcngcctggncaacatagcaaagacccc

SEQ ID NO: 551300 - DNA, 369 bp, Homo sapiens
accttctttagtagagactgggtttcaccatgttggccaggatggtctctatctcctgaccttgtgatctgcctgcctcagcttcccaaagtgctgagatgacaggtgtgagccatcagacccagcattttttttttttaatttaaatttaaatttttttcatttttttgagaggttttttttgttttgttttgttgttgttgttgttgttgttgttgttgtttttgagacagtcttggctctgtcacccaggctgggagtgcagtggcgtgatctctgcaacctctacctcccaggttcaagcaattcttgtgcctcagcctcccaagtaactgggactacaggtgcacgctaccacacctggctgat

SEQ ID NO: 551301 - DNA, 215 bp, Homo sapiens
acagcgtgctatctccactgtgaattctggaaaacgcttctgaagttctcctttagtaaacactcgaagagaactatagcatgggatcgtatcggagaagcctgtgcagttctctaagagcactaccaatcatgttctcttttctttgtttagtatgcttcttgagacagggatctcactcgtgtcacctagggctgacagtgcatgtggtgtga

SEQ ID NO: 551302 - DNA, 231 bp, Homo sapiens
atttccttcaaagtttgctactcattttgtttctaatagaacataaaggaagagacatctaagagctaatgtactgatagtttatgatatcactcaaagcagtttaatattttgtggtttagtatcttcagggaatgaggaggttccttctcttagtttttttatttgactgaggccagactggtatgaaagaagtttattttacaattctaaaatctatagccaaaaaaa

SEQ ID NO: 551303 - DNA, 197 bp, Homo sapiens
ggcgctttcgggagccgcggctttattggtgcagacatggccaagtccaagaaccacaccacacacacccagttccggaaaattggcacagaaattggtattaaggagaccccgattcacacagatacggaatctcttaaggggggttggacccaaggttcctgagggacatgcggctttgccaaggaagcacacaa

SEQ ID NO: 551304 - DNA, 156 bp, Homo sapiens
aaatggggagagatgaacagaaaagtacggtgtgtattgtagtggccacaatgaagctgttagtcattacaagttgcgcttcagcagacagaaattcacaacttgatccagaaaattggcaacttctccatcgtgcgactgcttggattacaagga

SEQ ID NO: 551305 - DNA, 988 bp, Homo sapiens
  misc_feature (83)..(83): n is a, c, g, or t
  misc_feature (546)..(546): n is a, c, g, or t
gccccgatagcgttagctgtgcctgcagcactcgcgatctggctctcagtattagtttgtgcttgcgtaatacgctgttgtcnagtcgtgtgtgccacatcccgtcgtgtgttgtaccgcccctttccgatgtgttggcgtcttctacacaccccgccgttgtggtggttggccacaccccccccggtttgtgggcacacatgtgggggttgaataccttccgctcttaatggggcataaaaaactccggcggctcttaagagcttagcgccctgggtaaattttcgccggcgaccacaacccgctccgtgtggttcgtaagccccaaactttgaccgggcccttttcctctcccgggaagcacttttctccgtcccaaggcacgttgttttaaaccggacaaatctcctcgggtattttaattggtcccttggccccccccctctccttttcaggggtaaaaatacttagagggttcccccaaagtctctaagatctgttgtctaaaaaccgaggcccacgaacgccccattgtggtctgaaaancctttgcacgcacctacatcatacttgttagcaaacagtattcattcgacaccttgtaaaattattcgttcgccacacaaaaaaaagattctgtgttgtcccttagagagaacacgagagtctcaacgttgctgtgacccaccggtcagggggccaaaccggtcccacccaaaatggctctgcgccacatgcgcgcccaccctccgcgccgccccagggggtcgctccccccacccgcgcgcgtctcctccaaatgacgtgtggatgtacaatcgccagagggctcccgcaccaccgctgggcgcccaaacaagaaacagagggtgcacaccatctgagcaaaacacatggcaccgcaaggtcgcttcttcaagagagggcccaactgcacctaccactcttttttttttaaaaaaaaccgaagccctaacaaacaaaacaa

SEQ ID NO: 551306 - DNA, 998 bp, Homo sapiens
aaccgagattgattgtcggaccagtggatgctcctaatcaacgacgccaagcgcggaaggtatgctcctcggagtcacagttgaactcgccaacattttgggaggccagttaccacctcagtggatcacagcagtcgcgatattcctaattactattagttgcgcgaatatctacaatggtagcgagtctcctactctccgactcgcttcgggatcatttgtaacactcccacgtagtggctgccaacacggactcatttgagcaggattctggcaagatgcagggactccaaaaagtttcgtacagatgaatgcatgtagtttcagtacgagtgggccttctcaagagtacggaagagtgtattcatagatccatactttggccttgccatgtaggatatgactggtgacattagggtccatagcattcacacaggacgccgttcccctctgttccctagatattcgattgtaataagcgtaatcgagtgaatcattggcacatccctgtccgagagaatgacgggtatccagcagatgaacgatgaaaaggtgcatgccatgtggacaggagtccggtgggtcctgtgacaggtcctgctaagaagctgaagcctgtcatagtccctctaaccacagatacccactgggcaggaacttggatgagatatcagggtaattcatctctctccagggtaaccgccgacaaaagggatggcacccaggattgatagggacggatggcgcaacgcgagagggtcctgcagacatccggatcaaaacgcagacaacactttgccgaagaactataacaaccaccccgaaaggagaaaactcgacacaaccagctagcttggaagggggcgaagcaagaataggagcaccgggtacgcaaaccaagcacgggcgcaccatcgatgggtcccggtaaagaaggacacgcagacaccgcaacaacgaaacccggcctcacttaccacacccgcaacccgggaaaa

SEQ ID NO: 551307 - DNA, 243 bp, Homo sapiens
gtaagtgctaacatttagaggctgagtgtggtggctcacacctgctaatcccagctgggaggtctaaggcatagaggattgcttgaagcccaggagttcaagactagcctgggcaacataggccctatctctacaagtaaaaaacaaacatagctgggtgtgatggcgtgtgcctgtggttccaggtactccaaaggctatagcgcaagcattggttgagcccaagaggtccaagtcttccgg

SEQ ID NO: 551308 - DNA, 920 bp, Homo sapiens
  misc_feature (23)..(23): n is a, c, g, or t
  misc_feature (112)..(112): n is a, c, g, or t
  misc_feature (147)..(147): n is a, c, g, or t
  misc_feature (337)..(337): n is a, c, g, or t
  misc_feature (384)..(384): n is a, c, g, or t
  misc_feature (497)..(497): n is a, c, g, or t
  misc_feature (528)..(528): n is a, c, g, or t
  misc_feature (535)..(535): n is a, c, g, or t
  misc_feature (539)..(539): n is a, c, g, or t
ggactctatgtggcggtgaggancaggaagccctgaagggtcaaaagaaatacaaaagcaaaggctattttctttttttttttctttctttcattccttccttcctcgtgtntctttctttcttcctttcatttttttttctttttnaagagcgagcggctctgcgggggcggatgggggtgggcgccgccgaggtgaggtcgtctcgcctcccgcgcgccggtagaatggtggtttcattatggatggaggggatgatggtaaccttattatcaaaaagaggttggtgtctgaggcagaactagatgaacggcgcaacaaggaggcaagaacgaantgggagaacagttcgaaaacctgaagatccagaacgaatgtccaganggaggttatatgaccctcgatctctatatgaaaggctacaggaacagaaggaccaggaagcagcaggagtaccgaggaacagttcaaattcaaaaacatggtcagaggcttanatgaagatgagaccaattcctgatgaggttnctcgacnagcnggaacctattagaaaggcacgacggagacacggaccttgaacgagaactgagggaattcacggaaggttaacctcaagaaggtgggattcctcaagagacaaggaggcatggacaagaactgcgtgtggagctatgaaatccagaacagtttcccagcggagttgttggcaggagctgggaagctataagctccggaagggcacgtgtgcaacggactgaaccgggcctggcgaatgaagaataaggacgtcacgggatgtttgggaaaacccgtagggcccaccatgccctgggggtgtgtggaccccagcggggcctgggagccgcatcaaggggccaacggaatgttctgcaaacttgctgtccagggccaagatagg

SEQ ID NO: 551309 - DNA, 675 bp, Homo sapiens
agttgcttcgcatattcgtctccaatcacactcacttacacatacacccactgtcctggcttgcgacaccgatatgacgtgatacatatgactgcatatagctcgctagcgtccacatggggaccgtgtgttaacaagaggatggcagattagaaggctggaagagtctatgccccaatgacattgttgagctgctgaaccagccctgaagtcacttgtctctaatctcctatgtaagtaaataatacatgtccttatagttaagccattgttatttgggttttctgctacttggagtcaactgcatgcaaactaactgattcatgtattaagggatgaatgagaggcagcagggcagaagctactgtcttgatcttcctgaggatgtcctacttctaacgagacatgctttgaattttctgacattaaaaattaccataacagcatcagcacagaaatcctaattattacagttgcccactatcttcttgattgattaacaggcaactgaatgtattcattcactcatactcttgtgcaaacattcctatgtatgtgtgtggtgcatctagtactcacgtgggatacagagaattctcacacaggatctttacttctaggaggatattgtgtcaaagggaaccaagtcaccgcaccagatgataccggcatgat

SEQ ID NO: 551310 - DNA, 523 bp, Homo sapiens
  misc_feature (54)..(54): n is a, c, g, or t
  misc_feature (71)..(73): n is a, c, g, or t
  misc_feature (87)..(87): n is a, c, g, or t
  misc_feature (94)..(94): n is a, c, g, or t
  misc_feature (153)..(153): n is a, c, g, or t
  misc_feature (156)..(156): n is a, c, g, or t
  misc_feature (158)..(160): n is a, c, g, or t
  misc_feature (169)..(169): n is a, c, g, or t
  misc_feature (185)..(185): n is a, c, g, or t
  misc_feature (188)..(188): n is a, c, g, or t
  misc_feature (194)..(194): n is a, c, g, or t
  misc_feature (196)..(196): n is a, c, g, or t
  misc_feature (209)..(209): n is a, c, g, or t
  misc_feature (288)..(288): n is a, c, g, or t
  misc_feature (363)..(363): n is a, c, g, or t
  misc_feature (406)..(406): n is a, c, g, or t
  misc_feature (433)..(433): n is a, c, g, or t
  misc_feature (446)..(446): n is a, c, g, or t
  misc_feature (517)..(517): n is a, c, g, or t
tctgggtaagtgaggaatattcacagcttcttacacagtgtcagagaaagtgantatctgagctcaccagnnntctgctgtgttgtnggggaanctgtaaaacaagcaaaagtataattacaatctggacttttttcttttttaaataaagtnttncnnntcttttttncttctcatactgtganttnttcttnantccttttcttgtnattcagttttcagaatttccatctttcttctggaactaatgtgtctgttctcttgactgcctgctgggccagcatccgnttgccagccagaaacgtcacactgtcccaggatggccaggttacttcaagggcgggtaacatgttgagctgagtncagtagacatacatgagtcccagcatagcagcatgtcccaggngaaatataatcgtgctaggagcaaaantgaagttggaganattggcaccaatccggatccacagagcgaagagcagaagcaactggcgaggaggatcaggtgcatgtgaantgtatt

SEQ ID NO: 551311 - DNA, 1040 bp, Homo sapiens
  misc_feature (23)..(23): n is a, c, g, or t
  misc_feature (112)..(112): n is a, c, g, or t
  misc_feature (147)..(147): n is a, c, g, or t
  misc_feature (457)..(457): n is a, c, g, or t
  misc_feature (504)..(504): n is a, c, g, or t
  misc_feature (617)..(617): n is a, c, g, or t
  misc_feature (648)..(648): n is a, c, g, or t
  misc_feature (655)..(655): n is a, c, g, or t
  misc_feature (659)..(659): n is a, c, g, or t
ggactctatgtggcggtgaggancaggaagccctgaagggtcaaaagaaatacaaaagcaaaggctattttctttttttttttctttctttcattccttccttcctcgtgtntctttctttcttcctttcatttttttttctttttnaagagcgagcggctctgcgggggcggatgggggtgggcgccgccgaggtgaggtcgtctcgcctcccgcgcgccggtagaatctggcccggtcgctcaggctggggtgcagcggtgtgatctgggctcacggcagcctccgcctcccaggttcaagcgattctcctgcctcagcctcctgagtgggctggggattacagatgggtggtttcattatggatggaggggatgatggtaaccttattatcaaaaagaggttggtgtctgaggcagaactagatgaacggcgcaacaaggaggcaagaacgaantgggagaacagttcgaaaacctgaagatccagaacgaatgtccaganggaggttatatgaccctcgatctctatatgaaaggctacaggaacagaaggaccaggaagcagcaggagtaccgaggaacagttcaaattcaaaaacatggtcagaggcttanatgaagatgagaccaattcctgatgaggttnctcgacnagcnggaacctattagaaaggcacgacggagacacggaccttgaacgagaactgagggaattcacggaaggttaacctcaagaaggtgggattcctcaagagacaaggaggcatggacaagaactgcgtgtggagctatgaaatccagaacagtttcccagcggagttgttggcaggagctgggaagctataagctccggaagggcacgtgtgcaacggactgaaccgggcctggcgaatgaagaataaggacgtcacgggatgtttgggaaaacccgtagggcccaccatgccctgggggtgtgtggaccccagcggggcctgggagccgcatcaaggggccaacggaatgttctgcaaacttgctgtccagggccaagatagg

SEQ ID NO: 551312 - DNA, 164 bp, Homo sapiens
gcggtgtctagaggatcccgttgctaggtgagtgaggggtgatctcggtcatgaagctctgcctccggttacgcattcttctgttcagcttccgagtaggtgggaattacaggcgcccaccaccatgcctggctaattttttttgtatttatatgtagagtatg

SEQ ID NO: 551313 - DNA, 351 bp, Homo sapiens
  misc_feature (60)..(60): n is a, c, g, or t
  misc_feature (123)..(123): n is a, c, g, or t
agattcaattagattagataattagagagagacacatataaaacatcaatgaaacaagancttgttttggggattgtccttgttgttgttgctgctgtttctgagacagggtcttgctctgtnaccccggctggagtgcagtggcatgaccttggctcactggaacctctgcctcccaggttccagtgactctcctgccctagactcccgagtagctgggactacaggtgtgtgccaccatgccaggctaatttttgcatttttagtagagaccgggcttcaccatgttggcggaattccgaaaagatgcttatgatttcaaattacacaaagtacatggcatgagcaggg

SEQ ID NO: 551314 - DNA, 409 bp, Homo sapiens
  misc_feature (19)..(19): n is a, c, g, or t
  misc_feature (99)..(99): n is a, c, g, or t
  misc_feature (197)..(197): n is a, c, g, or t
  misc_feature (199)..(199): n is a, c, g, or t
  misc_feature (201)..(201): n is a, c, g, or t
  misc_feature (226)..(226): n is a, c, g, or t
  misc_feature (342)..(342): n is a, c, g, or t
gaaaaaggatctggaaggncccctaaattgtgtcgcacagacgaaatgccttcgactgccttggaaatgaccccacctttctgctggaagcccacatgncccgggaatgcacccaaagtctgaatctgtcagtaccttactatgctgcaggaaaacaaagtcccacccagaactccagtgcccaggcaggaccttcncntnctaaacgcgctttagaatgttcaantctctctcttctttgtaagcactgtggccctgtggtaaatccatcacagataaaatggcctctacatgagccatgtgctaaaaaaggatacgtacacccattgtgtgttgagtctnaaagttgtttctcaaaaagttttggattgtcccaaattttatatgtgagtttgctgattcagtcatt

SEQ ID NO: 551315 - DNA, 601 bp, Homo sapiens
agaatcactagaaccgggaggcggaggttgcagtgagccgctgaaattgtaccactgcactcctgcctgggcgacagagcaagactccttcttaaaaaaaaaaaaaaaaaaaaatagcgccaggtgtggtatctcattcctgtaatcccagcactttgggaggccgaggtaggtggatcacctgaggtctctactgaaaataccaaaattagctgggtgtgatggcaggtgcctgtaatcccagctgtttgggaggctgaggcaggagaatcgctggaacccaggaggcagaggttgcagtgatccgggatcgcgccactgcactccagcagcctgggcgacagagggagactccatctcaaaaaaaaaaaaaaaaaaaaaaaaatacaccctccaatgctgaaagctacgaaggaaacaaaaccatgtgcgagtgatagggcagcccctctgggaagtgacatttgtgcccagatctgaagaaagaaaaggagccactcatacagaaagactgagacaagatgagctttcgggacaagtcaggctctagggagaacacctgacgaggaaaatgcctgggcagtttgaggaactgaaaagc

SEQ ID NO: 551316 - DNA, 618 bp, Homo sapiens
aattcagtggagcaggaggaggggatatcatatatgatcggggaagggggtgtatatttaggggttgctgattcttcaaagaggcacagagccagatggtagaggaaggatgcaaagtataagattagtgtaatatgactttaacatgcccatatgtcacttggaaatattgacaagaaagggttctgtaaaatggaagacttagtgtgtgaatcgatttagaggagagggtgtctcttttctcggacacttaattctgttctggtatgaatttatcagatggcttgtgtgcattggataacaccaccattcacaagttaagattcttggtatttggatatctgttagatgctactaagaaaatagagatgagctttctttttaaagcttttgatgtggtgtcatagaatagcatgttgtagatacaatcagctgctttgttaccttaaaactaggcatttgtaaatattaaaccataagatggcaggtgatgtcctgtaaacactcagctgttcagattggacataactgacttagttcttcccttctctctctctcaaaattataggagacttgtagttcagtgtggtttcctgtttctaatttgctgctgataat

SEQ ID NO: 551317 - DNA, 865 bp, Homo sapiens
gacattggtcagcaggaattctcgaatgtgttgccctccctcttatggccacaagggtcccccggaaactggaagttgtccagagaaccccgagttcttctccccgcccccgatggacgtgctccgagacccccgttgtggccctcgaaaaaacttcccccttggggacgcgcccctcttttcctgggcgggcttccaccccttctttcaacgcactctccaattccaaagcaatttccgagagccgggcggcgggccgcccgcgggggctgatgtgggccagccctcttcgccgccggcccaattaggccgccttggatttttttttgccgaaaaatgcgaactaactccttttccacacgggcaacacacccgcttgtggaaaaatcaggtgtgcacctccgcagggacactcgtcatgccacaccttctgccacccccgtggggttattttaaaaacaatcgcttcactcccccccacgttaattacatgcgacaacaccttgtctagcagactttcatcataggagacgggagaccaccacatggaaattcattactctggggggaacccgcccgcggtggacagtagcctcggcccccatcaccccatttctgtgtctacacacatgagaaatacaaatttcagcactgcataatgcatcagtttcttgtttgtcgagatttttaagacataggtttttctaaaaatcgtggaatcacccttcatgcatttcgacaacgcgccgacgacccccccacctctttgcaatctcttaataaggaatggcacgacgtatcgagagaacccgtaattcccaccaaccgcacccaccctaaaaaacaaatttaaaaaaaacataac

SEQ ID NO: 551318 - DNA, 112 bp, Homo sapiens
cctgtgttatcctgtacagaacaaattctaattattataaatgcatatataaaatcaaaattcacaataacaatatgattggcataatactccacaataatctggattaact

SEQ ID NO: 551319 - DNA, 166 bp, Homo sapiens
gtgagcggggttaggtgggaagttttacagagagggcctcccatctgccctggactttcccatgagcctcctggaactgccagccccttctctattacaccatgttccatcgctgtgcatgctgacacacacgctaacggatgcctcttagccttggctggggcgc

SEQ ID NO: 551320 - DNA, 662 bp, Homo sapiens
ggaatctgtattttttcatagcaacctcaagtaatctttatcctgagggtcctcgggattgcaggttgaaaaacacaaccttaatcagcaagtaaattcttctctactcggcaggcgcagtggctcatgcctgtaatcccagcaacttgggaggccgaggtgggtggatcacaaggtcaggagttcgagaccagcctgaccaacatggtgaaacgccatctctactaaaaatacaaaaattagccgggcgtggtggtgctcacctgtaatcccagctacccaggaggctgaggcaagagaatcacttgaacccgggaggcagagggtgcagtaagccgaggattgcaccactgcaactccagtcctagcgacagagcgagactcggtctcaaaacaaaaaccaaaaaaaaaagagaatttcttttgctacccatttggcgggccttaggacacttctcccaaaaaagttgtttgcgttatttcaaaaaattaatacattagtaatggaaagcacaaattgtagcagggggaaaattccttttaaaagggaattctttggcttttttggcaccacttgaaaagaagttgcctggacttgccaagggtacatccggcaaaaagttataggggcgaaagtttggaacggtggaaatccagctaaa

SEQ ID NO: 551321 - DNA, 423 bp, Homo sapiens
gttctgcctcatgctcaatatcaatcttttaattggtaatatctctaataagggatatactgcatcatcttctccagtgacctgtcacttccactcgggtgacaggccctgactgtgttttgtcttctcattctcttcccccccattacccctttctctctgacatttgtactcttcagctttcattattatttcaagctaagtgactttttgttccagacacagagcattcctctgccatatacacagagaaaccactcacctgtagtgggtggcccttatcattaatcttataatttatgatatatacatttttttaacccaaatttaaggggcattttcccattctgatcaccatcctcattcagaccaatgcttcaagactgttatagtacatattttaatattaatatacaaatcaag

SEQ ID NO: 551322 - DNA, 726 bp, Homo sapiens
gggtcgcgcgcgtatggccgaggtatggaagcggcgggagctactatcccctgatctaccaccatctgctgcgtggctggctatgtgcgtgcggcgcgggaagtgaaggagcacgagcggtccagaagtgtttcctggctcagcccgtaacccttctaggacatctatacacactggcaacaagacctcagagcttggtcggaagcggaaggcagaggaagatgcggtcactgcaagcctaagcaaaacccgtgtgtcagacccctatcagcacctcggagagctcggcaagaggaggaatgaatgcataagccgaagaccgccaaagtccatcccaagactagcgatctagccaactacctctagttcctgggggtgcgggcacttgccatcaaagcatgacagatcaatcgccaaggccagagacagcagaaagctggcaagactggtgaattccatgccacaaacctgcccacttgggaaagcacggtggcccaaaccttctattactggcgaaggtctccccaggtacgtccagcctgagccctcagccaatttactacgttggtctcaggaaacactgcaggcaggagggccagcgtcccggccttatggagctgctgccaaaccctgggatggtgtcagcggcaccaggaccgacagctacagcgagggacaccttcggttcagtgatgagccagactgtcggggaaccctcagtaaacg

SEQ ID NO: 551323 - DNA, 906 bp, Homo sapiens
gggtcgggtgcggcgctatgccggggcagacgttctcgagtccgggcatgtacaagcgcgtttgcagctgaccgtggtctgcccccggacctcaaatccctggggatcagtaggtgaaagacgaaatttaggaggacttaagaccgttggttctgacgaggcacagggtgtcttgcaagaatgggaggtgtatgcaagagggttattgcaaaggctaagaaaatagacaaaattcaactggtgaaagtgtgtttggaccttcgctcccagtaagaagaaagttaatgacttgggtgatgaacaagatgggagcagttgcaggagttgatgcaagaaggccataaaaaccaatagggaagttcagtatttctggagtctatgaaatccagaagagttgaggtctatacaagaaaaggttaaataagacattgcaagaagatttaggaacgccctacttgaactgtcatgggttgttgtgaaatactattttaaggcttggaaaaacacctgtgaattaagtgaaatgctcttggattttggggtataatgatgccggatattggatcaagatccctagtgacaattgaacaagactatggaattagtagcacttgtatgaactcgagtttggacttaaagagaaagttcttgaattgctgagatgttgaaatgcaatctatccaggcatataagtcttgtgacgttgcttaggtaatcaataagcggttgggtagggtggtgtcatccacagttatttttaaaacatgggtttgactttccttcgttaaaaacacaagtgttggaggtctttccgcatcgggcacaagaaggggagacgaatatatacactgttattaggaaaaaaaaaatggggcggtatatggacgaaaataagagtacagacga

SEQ ID NO: 551324 - DNA, 253 bp, Homo sapiens
ggttggtttttgccccccccttcccccccgggggggggaaacccccccggggggggggtttttttttgggggttttttgccccggcccttttttcccggggggccccccccaggggggattttattttgggggggggggcgcccttttttttttttttttcccccccccccccccggatttttttttttttttgggggggggggggttccccggggggttaaccccgtttttttttgttttttttttccccca

SEQ ID NO: 551325 - DNA, 230 bp, Homo sapiens
gacccccccccttgggagttttccccccaaaatgttcccggggaaaattttttggggttaagggccccccccccccccttttgttttttttaacccaaaaatacgttttgcccccctcttggggttccaaagcctttaaaaaaacccgtcccccattttaatttcccttccaagggccagcccgaaggtgttttttaattcccaaaaaaaggcctttttttgccccttta

SEQ ID NO: 551326 - DNA, 1143 bp, Homo sapiens
  misc_feature (1143)..(1143): n is a, c, g, or t
gataggcggttgtagctggacggcttggaatcctcctttgtgctgtgatcatggcgatcttagaacacagatgtacctagttctattagtgcttcgtaatcgatactcaagagcctggaatcgactgatcaatgcggacgcttgtgttgcgacatgcacagttctgtgcgagtcacttggtgtatcctttctagatcatagtgactctagctacgctgcgatcaccgaaggtcatcattcctgtacttggattaagtagctaagcgcgactcactcgttacgctttgctatgaaatcctggatggaaccctcgctgactttagcctgagattactagacaagcatctagctttgagaacgcttatcggtaatgattattgggacccatgttattaatttagtggctagatggggatctttgcgcaatggcctattgttttcactttagtagtttgcaaatgggaggaacgatgttagagcttaacattaaatattcccgtggcggaactcagactcagtaaaattgccaccaaaaaaataattccgcaataaaacatccaatttaggtatctcactcttcctttgctggctgttcctttttcgtaggtttccaggtcgtttggttggtacccctaatttgagcagttgggctaaccattggggcatcaagtaagttaatcctcacatttagcgacacgtggataaacccttgcgtcgggtgggttttagtccttgacttggcgcatttaacgaaattagaggctgatcgagaaattcaaaagtatttgttagcgatttactatgggatttttaggcttcctcgttgttactagtacacgattttcattaaaatgcgtcgtggtaccgcgtaaataactcttcataaattatttgtataattggttgagcacaaatggtagatgtgagacccagagcgaggtgggttgagattcgaaaggtcatttgtaggtttacacaaagaaaaccatttgagggggaaggtaacatagaaaggccttttgggagataatcgaaattagggtcaagtgagggattttgaaagaggaaagaccatggttttaataacacgagagaaatttaaacatgttcattggatagtgtgactatttagattataacctn

SEQ ID NO: 551327 - DNA, 277 bp, Homo sapiens
tagaggatccatatcgtagcatcagtctcgaaagaataaatgacttcctcgacctgtttcttggtatggtggtctcaatgccaccaaaccttaactgaaataaaccatggtcactccattttatattcatccttcttgccagcaaataaaccaacaaatacctagagataagtagtgtgtagaaccaaacaaatctttctgctctcacagagcttttattccaagaatatatcactaccttcctagccatatgctgatggttctgatacggttttga

SEQ ID NO: 551328 - DNA, 520 bp, Homo sapiens
  misc_feature (409)..(409): n is a, c, g, or t
  misc_feature (411)..(411): n is a, c, g, or t
aaattaggcggcccgtcgacgtcagcaccgcgagcaaagaaattccgcaagcagagcaagaagatccaggttgccatgggtgacgtcaccacgtcgcctcggaaaccatccagggctaccgcgtcgtgcgcacttcggcggtgaggtgtatgagcagaagcgcttcctcaaggccagcctgagcaacaccaacaagcaactgcgcatgacccgtaccggcgcgatctacacgccggcgctgcaactggtgatctacagcgccatgcggtgctgatgttcctggttctgtaccttcgcggtgatgcttctgcaggtgacatggtggcctacatcaccttggccggcctgttgcctaagccgattcgccagctgtccgaagtcagctcgaccatccagaaaggcgtacgantngccgaaagcattttcgagcagttggacgaggatgtagaaatcgatcgcggtaccatcgagcgcgacaaggtcagcggccgcctggaagtgcgcacctgaacttcactac

SEQ ID NO: 551329 - DNA, 828 bp, Homo sapiens
ggcgggaccagaggcggtcacgtgaggggctctgggctaccgggtcacgtgaccgaggcacagatcagctgatgccggagggtttgaagccgcgccgcgagggagcgaggtcgcagtgacatgctggctgggctgatctggacccaggcttgcccctgcctgtaccctgcctgctgtccctgcgctccctgccccaggcattgacatgcccctggctgggtcctgcgctggggtcgagagacctgagctggcttcttgagccccaaagccctgtggtatgggggacccatgtgcgtgggccctttcacgcgtgccccgtcctgacagccccgcagacagagcgacactgacccttctggcccgtacgttctcaaaagtagcttattttcattgaggtcaccttggcggagcaaagctattcgagagccaagtggcctggcaatgcgcctgcaaagcttgatgcgtgcacagtggtccagagatcctgggtgggtcacgggtgccagctacatcgctgtcatggggcgtcagtaatcagactgggctgtgacgattccgggacgaggaacacgcatcgtgccttcccgaaaccgtcttcgctgctggagctactcgggacggagctggatgacagccttacggcaggcctaacacgcgtggagccaggcttgtagccaagggccattcttcacaatggcatgtgggaaccaggataacattggcgttaggccttgacgggtcgtcaccttggtgcccgggtaatagctagtaattagtacctgttggattggaaggggtgacccctttgggacccaaatgggttccagg

SEQ ID NO: 551330 - DNA, 1154 bp, Homo sapiens
  misc_feature (652)..(652): n is a, c, g, or t
tcggggcggggtgatagataaatagtggaaagagagggttttataagtgggggtgcccgcggagacacacacgagtgtgtgtggggggaagacgccgcaaacgcaaacaacgagagcgtgtgttttctccccccccctcgttgtgaaaccacacgagagggggggtgttctttttagtaccccccctctggggctgccggtgtgtggcacactcgtcgtcttgttatctgcgagggttatatagagggcgacacatatatttgcgtggttatcacgcgcgccccatctgcgaggtatatactttgtgagagagaactatatatatatagagagggatatatacacagcgctgtgtgtgtgtgtgtgtgtccacactgtgtgtgtgagagtcgcccccactattttctgtgagcgcggtgtgtctctcacaaactgtgtgggtgtattagtgtgtgataatagaatagagagagagagatagtagagagatattatctctctctgtggatgcgtgtggcgtgagagtatctactcactcagggggcgcgttggtctctcacctctctgggggcgcgccgccacacatagagagagtgttcacgagacgagatattttctcgccacacactgtgtgttctcacatctgtctttnttagagagagagagagagagagagatgttcgccgcccccctatgtgtgtgtgtagagagaggaagagcgcccctcttaagataaagagaagagaggataagaaacacccctgctggggcgccacaacgccctctcccagagatattctggcggttttttgtttctcccaccgcggtttctctcgcggcacccacacacgcggcggcgggatattgtgttctctctagaagaaaacacgcgcgcggccccacaaaaaaaataataagaagaagaggggtgccacacagaaatatgttttataatcatttgtgccccacagagagaatataagagagagaggttaaagagagaaagagcccccgcggccccaattcgcgaagaagaaccccgcaattttcctctttgcgcgagagtttttaatttttagagagttgtgataccccccccggaataaagaatatttttgggggcacacacaataaaaaaagaaccgggtttgtga

SEQ ID NO: 551331 - DNA, 132 bp, Homo sapiens
aagggcgtccccagggggctgcgggagctgcagcttcgaagcctcacagagatcttgaaaggaggggtcttgatccagcggaacccccagctctgctaccagtgacaggggatcctcgtagagtctgatcct

SEQ ID NO: 551332 - DNA, 392 bp, Homo sapiens
taccaaaaacatcacctctatgcatcaccgagtattaagaggcaccgccagtgcccatgtgacacatgtttaacggccgcaggtaccctaaccgtgcaacaggtagacataagttcacttgtgggtcccccctttttaagaggggaacaccgtggagataccttggaaaactttgggccgttccccaagcgaaaggggggtttcaagcagtggtcatcagttacatgttataacccagggtgacaatctgaaccatgcacccggtggacaggaaggccgggggcaattacacgaacaaaggcgagagggaaccggaaagcaaaagggaacacccctgttaaagttggaggcaaaggggcccaattattgttaaacaagttttatttcttaaa

SEQ ID NO: 551333 - DNA, 106 bp, Homo sapiens
catggatttgctggtgcagtacaactaggcttaatagggacatgcataaaaatgactgaaaactaggagaatgtgtgagaaattacttaagaactaagtgggaaaa

SEQ ID NO: 551334 - DNA, 254 bp, Homo sapiens
  misc_feature (193)..(193): n is a, c, g, or t
  misc_feature (197)..(197): n is a, c, g, or t
ccaaggagacggcacggcgggctgaccttgaaggaggacggagcccccagaccctcgcacctgttggagaagatgctatgaagactcccagcccggctgccgaggacgccagggaacccgaggccaaggggaacagctgacggggctcgagggggaaagggggtgggacagggactcggggctggggacgggngggnttgactgcgggtgctttgccttaaaaagaaataaaagatgtgaacttgggctaagtt

SEQ ID NO: 551335 - DNA, 852 bp, Homo sapiens
  misc_feature (547)..(547): n is a, c, g, or t
agcagaaatcatgtcactgcaccctagcctgggcaacagggcgagactctgtctcaaaaaaaaaaaaaattgttcagagacgtcgaaggtgttagggagactaataggatgggttatgggggggggacgaattgaggggaaagattgaagttaaaataggatagccagattgggccttaaatgagaaagagacatctgggctgggtgtggtggctcatgcctggaatcccagcacttggggaggccaaggcgggcggatcacttgaggccaggagttcaagaccagtctggcccacgtggtgaacccccgcctctactaaaaatataaaaattagctaggtgggcggattcttgaggccaggaattcaagaccagcctgggccgacatggtgaaacccccacctctattaaaaataccaaaaattagatgggtatgggggcacgtacctgtagtcctagctactcaggaggctgaggcggcaggatcacttgaaccatgaggttggcggtgcagtgagctaagatggtgccactgtactccggctgngtgacagagacagtgtctgaaaaagaaatcaacagacaaatgggactctctgacagcagtgcgttgccgccgcgtttcggatgcgaaaccccgttggagggctcgtggggaccaattgtccagacccgatggccgttggttaaggtggacaggcgtgtttaggccggggcacatttgggccattttgccgattggaagggcgctgtttggctggaccgggcaagcagagtggggatcaccggggccccgaccatcctggggtaggcatggagggctttcgggaagggccccttgtgccgagatgt

SEQ ID NO: 551336 - DNA, 464 bp, Homo sapiens
tcacacaactctgaatatgcttaagaccattgaattacacactttacgttggtgaattgtatggtatgtaaattatagttcaataacatagttacaaaagataatcaaaagcatgaaagcactattgatgtggtttggatctgtgtcctcaccgagtctcatgttgaaatgtaagccctctggtgggaggcgatgggattatggggcagagtcctcacgaacggtttagcaccacccgctcagtgctgttctcctgatattgagtcctcatcccatctggttgcttcaaagtgtgtggtgcctcccctctatctccctcctgctctggccatataagatgtgcctgcttctccttcgccttctaacatgattgtaagtttcctgaggcctccctagaagcaaaagctgctgtgcttcctgtaccatctacaggaccgtgagccaattaaacctcttttctttat

SEQ ID NO: 551337 - DNA, 106 bp, Homo sapiens
tcgagctggtaccgaatatattacttttaagtcctgtctttacatcctttgaaaacttgtattaccatgagtttggaaaaaggacaacgaaaggcttttcatgtaa

SEQ ID NO: 551338 - DNA, 1106 bp, Homo sapiens
  misc_feature (45)..(45): n is a, c, g, or t
ggccctgaaggtgccactccaggtgcccaccagcctgttcctaantaaaattaagtggtatcattaaaaaaaaaaaaaaaaaaaaaaaaaaaaaaaagtgtgagagagaagaaaagagaacaacaaaaaaaagacaaaaagagaaacaaaaatgaggagagggaggcgagggagaacacaaaagagagaaaagcgagaaaacaagggatcacaacagaccggagaaccaccatgagagaaaaaccgcgggccaccaagcacaaaacagtgcgtgaggaacgtccccccccccactccacaaaaaagcgccgcgaggagtcacaaccgcgacacgcttcgcgaacaacaatccccccaccagcggacctcaccacggcggccacaacgtgggaactctatacaaacccaccgagaggagagcacgacggagcagaccacccgagagatattcaagaataacacggccacaggccggtgcggacccacgcgacgacgccaaccagagggacagccgggaaccgcgcgcccaagaacgacaaccacgtcgcccaccacacatcacgacacaccaacacaacccgccacgaagaccgcggagacaacacgccaacgggcacaaagtgagcacgaggatgtgaagcgacgaaggcaggacaccaacggtagagcaacgaacacccgataggggagaacaacaaaccagaagcagacgcggaaccgatcgacgaccccacgaagcggacggcgcgcagctccacgacaacatgaagatgtgtgtcactataaccagaacaaccatatttcacaccacatccacaccacattcaaagcgcaatcacctacctcaacccacattacatctacaattcacacaccagactcccccctcacatcacttctaccaaaaacccacctcctcccattgaaagccgaccacacaacacaagcggcaggagagcacgcaaacacaaggagagtggcaggaccacccgccagcacggctcgataacaaaggaccacagccgcaagggaaaggaaggcgcacaaccaaggtagcacacaagggggcacagacagaagcaaggcgggaacaaccagcgggacaa

SEQ ID NO: 551339 - DNA, 676 bp, Homo sapiens
ttggtaagaatgtggaggccccccccccattgtcttgtattcacgtaaggtcgcgcaccacagtcgccccaggagattgcgagggcaatagggattctgtctcccagggagagtgcccaaatacttgtataaaggcgctatgtttcttccctctgggcatagtagagacgaccattggcctctcgcgcgcgagacaatacactgtctgttatatagtagcgacacagggggggaggccaccagcggctgttgtggggccgccaaagagaggtgtctgtttcctcctgccactctctcgggccaaaggcggactctcttcgtccgcaagaaggaggtgccaaacggcgttaaatcagtacacatcgcctctctctcccggagagagacaaagccagtgccgtgtggtctccacgcgagaggaagttaatatataggatgaagtgcaccttcggtggaagaaacgcttcctccttttgttcgtatagtaggattacaggatgtagtctaggacaagggtctaaaggtctctgtgctctgtgtgctctagcaaagagaaatagacaatctctcctggagtatcggctatcccgtgggctacaaccgggagaacatatggacgtcatgcaaaatataagacacatccgcagtccagcggagcacgacaaatgtcagaaca

SEQ ID NO: 551340 - DNA, 1709 bp, Homo sapiens
  misc_feature (1709)..(1709): n is a, c, g, or t
tgtcttaagcaaacccgggttctcggggtggggtgggggtataatactaagttggaagatggatatcatttacgggggagaagggcgctttggtgagaatgtaggccttatttctctaggtcctttcggtacaggggagggaatttggaatgtaagataagaaaccggacctgggattacctcgggtactggaactcagatcacgtgtgggacttaaatcggttgagaacaaacgagaaccttaaatacgcgggttggcgccaatcggggatggtcctggatccaacatcggaaggtcggaaacaccctaattggtggagattatgggactctaagaaatgaggcatgcgcgcgctggttatatcccctaaggtgtaacactgggtgcccctgtgtggcgcacaaggtatacatatggcgtatcccatattggcgagttataaggacagtctcgggcttaggcactgcggtgcgagatgtcctttaagcttatgtgtaccctcgggcctcagagacgagttcgcgcgtgtcccatgggcctcacagagagtgtccgcccccacaagcgcagaaaaatttctctaacaatccgcaaagtgtagagcggacacatgttaagcgagactctggggggggattacgggccagagagtacacatggggtgcggcacataacaagcataacaaagattcaacaagggcccccaaaatagggcgaggaacaataacgatgcaggaccctgaggaacgggagtgaaaatatgaggccccccggcaccctccatcacacaagcgggggacagaagagttcccaaagatgtggcacacacgtgggatcaaacaacaagcgcgatcaccaggaagccacgcaaggtgtgggaacaaccccgcatatcggagaggggaaaggccccaatattatcaaacaaaaccagaggggatccccgccatcaacattatacagcgaggaacaccacacaggggtggaccactcaacattcgacgcaaaccccgtgtgggggacagcgggggtcaaaagcgggacaacccccgggacgcgcccccgggatcaaacacaccacttagtcgtttcgctcacccacgtgagagcacacagagagcagggggcagcgaccccacccacataataaaacagcgtggggcacgagcaacgcgatcacgagagagcgagaacaaggcgtaattgtgaggcgaacaaccaacaagcgacgggcggacaaaaaacagcaattgagcacaggcgaggccacccattcaagacagctgtagactcaacaaaccccgttgcccttatatagagaacacggaccagggaacgatggggactcgcaccagcagcgggcgaacacacagaagaaagctgaagcaaacacggcaacgaagacgaacagaggccccagtaccaccactgagccgacggcacacaactgtcgacagcagcaacgcgcagcgaagagagacacacaaaaagacgacagacagcgctgccacactaaaacccacactgagacgccatagaacctaggggcgcgcagacaaacaacaagtgtggcacaccagcgcacaacacccccacgagtgaggcacagcacacgaaggcagcgcgagacgccacctccactacgcagacgcaaagacacgcaacccgtaagcacccaccacaacagacagcgagaacacagccgatn

SEQ ID NO: 551341 - DNA, 245 bp, Homo sapiens
ggcgggtgcggcccggcccggcccgtgagcggcgcacagaatgggccgattgcttgctttttacacggcgggggaccgttgtccctcttcctgcttggtaccagcgtacggttgctggtggcccgggctttccagaggccttatggcagaggatttaggaggaaatttgttaaggaattggaccttgggacatttacctctggagagaggccccctctccctgtatatactcagtaatatttcta

SEQ ID NO: 551342 - DNA, 103 bp, Homo sapiens
cggctcggacccacaggtccttaccagtggcagtagccttgggagttatcccagctgcggtggctataatggtcctaattacttccgggcatcaacttcacag

SEQ ID NO: 551343 - DNA, 354 bp, Homo sapiens
ccgacgacgtgtcaaacggcgagcgattagctgtggtctatcacacagtgtacttatacattgacgaggactgcgagaccagagctcttgtgaaactcatgagcggcgtgcagacaaagaaccgctgactgagttggaggggatatctgaactggaaactaaggggctaagttaactgggccagctttaacagaatattgcagattttaacattgatggtacatgactacacacgctcaagtgaggctgtgggcaagtccatctatggggagaaatttggggatgagaacgttatcctaaagccttcaggtgctggcattttgaacatggtgcgctggaccccacactgctggc

SEQ ID NO: 551344 - DNA, 245 bp, Homo sapiens
  misc_feature (81)..(81): n is a, c, g, or t
gggaacaggcgccaggcagtggcccaggacggcacggacggagtgcataaatactgatggccaggcggggctcctggctgncgccagtgtgggtgggtgaggctgtccatcgagcgctcttgggggggcgtgggctctgggcactgccggctgagacatgaaaggcagaggcaggacattacccagcctcctggatggtactgaggtgacttgagttttggcaatttgcgtttccccaagccgcc

SEQ ID NO: 551345 - DNA, 188 bp, Homo sapiens
acgcaaaacacacacacgcacgcacacacacacacaaaccttcaaaaccctaataaacatagggccacttgctggagtccacgttgtattagaccttacggcaggtcttactatacactcgtctctcttatttcacactttccaattggcaatacacagcaaccacattcaggcatgggtggtcatca

SEQ ID NO: 551346 - DNA, 189 bp, Homo sapiens
cagcctccgcagccttgtgggcagcacgaggtcgctgcaggaaacgtgcaaggggaaccctgcagtttcgccgctcacatgcgcttccgatgactgagtgctccgatggacggaggacgagacatatgccagtgtctgcgcactggcttcttacgaggacccgggtggctctataattggtggatccgt

SEQ ID NO: 551347 - DNA, 517 bp, Homo sapiens
  misc_feature (139)..(139): n is a, c, g, or t
  misc_feature (354)..(354): n is a, c, g, or t
  misc_feature (400)..(400): n is a, c, g, or t
  misc_feature (423)..(423): n is a, c, g, or t
  misc_feature (452)..(452): n is a, c, g, or t
  misc_feature (469)..(469): n is a, c, g, or t
  misc_feature (482)..(482): n is a, c, g, or t
gatttagaagagaggttccagtgggtgtctctgtgtgtgactgagctgaagaacaacgtggctgcttacctggacaatctgcaggctttcctctacttcaggccgcacgaatacaatctggacatcccccgaggggccntgcagtgcagtattgcaatttggcaagagaccttcaccttgaggccttcctgaaatttaagcaacggctagaaggcctggtgtggcagccactgtgcagcctggccaaaagcctgcttggcctcagaacctgatcaagaagcgtctggacaagctactggactttgagcgggtggaagagaagctgctggaggtgggcagtgtgacctaccaggnggaggccgccccggcacacataccaggcactcaactccgctgctantggctgagctcccacagtttaancagctggtcatgcagtggctgggcagatnctgtgcacattcgtgancctccagaggganctttgcaaaacaagttgctgcagagggcagaggga

SEQ ID NO: 551348 - DNA, 919 bp, Homo sapiens
  misc_feature (11)..(12): n is a, c, g, or t
ataaattatcnngcctatctatccagatagtactccggcgttttctacaccggtcttttcacctccctccgcgatttcaactctttcctcaaaatttctacctttgcaccaacccacccgttggtgtgattcccgcccctaacttttcgccccctctctacaagtgcccccctatttggcccttctcttctttaatcggcctcctcaaacaaaagtaaatgccctctttaaccccaactaaataacgggtcttcccctcccccccttcatccccaggaaccactgtccccgccaccaacaaaatgtaacacggggacactgtccctttgaatcgctttttaaatgagcccccgcccccttctttcattcataaccagaagtgctctggcgaaaattctccccacccatgtacttgcaggcaaggttgtctccacatcctcatacgtccacccccccgcggtcttggcctcccccggatagaaaatgtccacttgcttgactacacaccacccacacactgaattatatctgtatgagagaagcaaaccatctttcccctcataccccaggcgtaatttcttttattccacaagtatattaccagacacctcccaccatgtaaaagcagatctcgccccctgtaactacaaaaaccaacatggtgatcccactctggttcgtattccgaacagcaagtgtctgtgattataaagccagaaaagccccagaatacaactcttaacattacagaccaatttagtataatcactcttttatcctagtcacttcctggatatatctagcttatttgggaacctcactttgtgatgtcacaagaacaaataaattccccatactgggctaaacaacacaaacaacaaacctttaaaatatttataataaataagcgaacaaaaca

SEQ ID NO: 551349 - DNA, 327 bp, Homo sapiens
tgcctggatatggcatgtccgtgtccactgacggatagtgcctgactatagatctcagtagccacgggggccatttgcctccaaatgcttgtgtctcccctcagggagtagctgctggccagagcttctgaatccctggcagtcacattggcctagtcaagggctgttagtgccatcctcactgaatttgccgcccgagaaacccgtgtagggaaacttagaggtgcttcattcacatctgtcacaataagcgtgaacttggcaatagaacttgccttgtacttcacagccaaaccctagaggctcaggatatactgctttgaacac

SEQ ID NO: 551350 - DNA, 1744 bp, Homo sapiens
  misc_feature (191)..(191): n is a, c, g, or t
  misc_feature (320)..(320): n is a, c, g, or t
  misc_feature (329)..(329): n is a, c, g, or t
  misc_feature (1744)..(1744): n is a, c, g, or t
ggtacaagcgtggcgggccagctagccctagcacggggccaggagcgcttcgccctttcctcttcgatagctaccgaggttggctgtgctgatcgtgtcgagcttcctgtggtagggtcgaacggggtcatcagctcgctagcgacatcctccagtcgacactacgagttaccagtgtcgtggtgcacagntgagggcaggtcgccagtgcgttctgctgccagtgttctaccctggggcgaactgggcaacaaccatccctagcggtgatgcattgtagactgtccacgacgcgctaggaacccaccgttgctctatcnctcgcgcancgtgctgtcaaggcttgtcatcttagcctcgtgaacgaagggcctgcatgtacgttgcgacgccgtgcacgtaccggtggattagatgacacacgcgtaatatcatgccgcctacacagacacagtagcggcgtgtgtgccacgccgtcatcgagggccaccacttggcgctggcaaggtgtacgctgagagacacgaatgcgcatgcgacgaccgaccacagcgacctatcactgccatgacgtgcaccgacacagcgacgacgaccttcatcttcgactggaacgcccggtccacgcctttgggccaccaagctcctagggttgccccttgcgaacgcaaaaccactcggaactacataaaaccatcctcgtgcaaggacgtccctactccaatgctgcggagacggggtcttttcaagcacggagcgaattgtgggagccgttgaggaacgcaacggccttgggttgcgcgtggtcccctggtgaccgccggcaggaacttacaaaccgttgggcggccaattctccgggtaggaaaagcgctagggcgggccttggttctcccaatcgcaccaagttataggtttcccaggcattggaggttccccggacagggcgcagaagcgttggtttccaaggcacgaggccacagcgcaatgcctttggcaaagtgtttgaacccgccccaggaacgaaaaccacggggcgcggacagggcgttcttggggccaacggggcccctgtgggggccccttccagtttcgcggatttcccccggactctcaatgagacccaatctgcaaggggcagtttctcgggctggcagcggcgtccccccggccacgcagagtgagcctgcgggcccatttccctggggttggcgccccggcgaccaggccagaggggcgtcgccacgacgccccttctccaccgctgcagaccatctcacccgcagcgtgctaatcaccccccaccgagtcgccccagacagtcgtcggcagtctccatggatcgagcgccgcgcgccctcgtctgtcccaggcccctgccgtggcacggaacggagacgcgccgaaccaaaccacggcgctccccgagcgtagaacaaccccccggggtaatcaccgagcgcgaacactacaggccacgaatccgtacctcgcacacacgacggccccatcggcgggatggtctttaccttctgcaacacaccacagcagcagacagcagagcagcgcggcagacaacacgccacaagcacatgcgggccgtgacaaagtcaagcagcgtacgacgaacaagtcacccgtaagatcacggaagcgcgaaacgaaatcctcagatcagccacgaagcacaaaagggctactatcacgcacgctagtagtcaacggcctgtgactcggagctcan

SEQ ID NO: 551351 - DNA, 919 bp, Homo sapiens
gaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatccctgggcgacagtctgagactctgtctcaaaaaaaaaaaaaaaaaaaagaaattttcagttaaacagccctccttggggtgcttaaagcattctcagcttctccttcaggcgggataattatatattaattcccgtgaaaaggggtttcaggtcaaaccctttaagaacaattcgtgaagcttgcaaccgggccttgggttgttggaaataggacgggttaaacggagactctacagcattttaagacttttttttataaatagacttatttcccttggtaaggtatgggccatttaagtggagtaagggcgggccagaggtgtgcttacaacctttgattcccctttctcccgggactggatctggcggtacagaggctaggtggtcctggggggtgccttatcagggctggatacttctgattctggttctctccacgggggcgcaacagacaggaccaagaaacccacggatccggcgtaaaggcaatgttacactgtgcgggtccaaaggaaccaaaccgtgtatggtaaagagcaccggggcaagagcactcatggaaaaagacgggggataatcattgaggaaaacacggcacacataggacccaagcaaggtggatagcaaagagatggaataacaaacagcgaagccagggaagagaggcgaaacaaaatcagaacgcataagaaggatggccaataaagag

SEQ ID NO: 551352 - DNA, 91 bp, Homo sapiens
ggcacgaggtcatgtcacaagcaaatgtgtcgaggagcaaaggcagtccgagccatgaagaccaacagtaatgatatgtaaatgcgatgat

SEQ ID NO: 551353 - DNA, 128 bp, Homo sapiens
acaggctccacatggctgtgtgcaatctacagacttgtctctgcatcccagaccactccagccgtcattaccaggggctcagagacagcttgggctgttgcttcaggagagtggaaaaccaagccttg

SEQ ID NO: 551354 - DNA, 169 bp, Homo sapiens
actccagttacttagaaaccactgataccgtcaagagccagaaaaagtgtccattgtaatacaagagtcagcagagtatcttaagatgtctttctttaatacaaagttcagaggtagagttagactaccaaatattcgttggttcactcagcaaacatgtatttatctt

SEQ ID NO: 551355 - DNA, 447 bp, Homo sapiens
cttgaggatccccgctggcccacaagtggcagaaagcacaacccccaaacgctggccttgaagtgcatgcagctgtgccagagcaggtggctacagggactgatgctctccagtgctgctggcacagctccctccccaagacatggcccccaaaaatcggacacgtgctctcacgtggcactgcacaaccacgtacacagcccagcacacctcccttactgacacggtctccctgtgggaccctgtcagcatgtccatgggacttggtcctgatgttggaccgtaagactccagggaaccctcgtcccttccgcagtcccccaaggaaggtcacatcatccacccacttcgtgggcagcgctgcccacgaagtggctgcccgaagtgttctgagcccacagatgtagacacgatggcatgattgtcatcaataatctcttccaaggt

SEQ ID NO: 551356 - DNA, 363 bp, Homo sapiens
  misc_feature (63)..(63): n is a, c, g, or t
  misc_feature (125)..(125): n is a, c, g, or t
  misc_feature (183)..(183): n is a, c, g, or t
caatggctgcagccagcattgttacagaaaaagggcccagttttttttccacgaaaaacgccntacacaacattgcacacccaacgttcaaagttggatgaattgggctatgatgtcttgcctcntcagccatattcacttgccctttcaccaactggcattttcacttctttaagcactcgncaacttttgcagggaaaacggctcccacaaccagcaggatgcagaaaatgcttttcaagagtttgttgaataccgaagtatggattttttatgctacgggaataaacaaacatttctcattggcaaaatatgttgattgtaatgggtcctattttgattaataaagatatgtttgagcct

SEQ ID NO: 551357 - DNA, 185 bp, Homo sapiens
tgctggttggttggttggttggcatgtaggtgtgtgggtgtataggtgtgtgtggagtgtgtgtgtgttatttttccccatgagtccttttattaatcctagtggctttttcacttacaactagtacctaacccatgtaattttcctacatcaagaaaacaatcacaaagtagtggtttaaatat

SEQ ID NO: 551358 - DNA, 297 bp, Homo sapiens
tcgagctcggtcccgattgactacgcggctttgtagaatagaaaggggggaggtggggaaaagattgagaaatcgggtggttgccgtgtctgtgtagaaagaggtagacatgggagacttttcattttgttctgtactaagaaaaattcttctgccttgggatcctgttgatcggtgaccttacccccaaccctgtgctctctgacacatgtgctgtatccactcagggttgaatggattaagggcggtgcaagttgtgctttgttaaacagatgcttgagccgcgtagtcagatcg

SEQ ID NO: 551359 - DNA, 438 bp, Homo sapiens
agcgatccttagaggctgaatgtagtttgtctggacagcacggcatgcctcgatgacacagatcgcgcagctccgcacagtgcggcagccccttatcaggcggctttggggaggaagaggacggtgagactgggcaagcagaccccagaccccacttcccatacagtgcggagaccaatgtgaaggctgaaacccctaccgctcaattccctgatgtggaggcctccaaacccagcctccgcctggtagctgcctcagcctggggcttcctcagagcagcagctcacacagggaccagagcagctgcagcttggaaactctgccctagatctcctgtgaactctagggatggattccttgtcattttcacgccctccttgtaggtgagagtggggctggggcacagatgaagccagaactggagaatcccaccaggca

SEQ ID NO: 551360 - DNA, 155 bp, Homo sapiens
aaaaccccccccccccaaggggggcccccgggggagagggttggggcccccccccccccttttggcccccgggtttttttttcccaaaaaaaaaagggggggccctttttttgtttccccccaaacccctttttaaaaaccctttttttttttta

SEQ ID NO: 551361 - DNA, 514 bp, Homo sapiens
ccagttacaacagcctggcagagttaaaggtaaatgagggctgagtggtagagtggggtctcagctgcacagagttcgagggcagcatctctcttgtcctccaaggcctggttgaaccactgtattgatggctacatcactaagtctaggtcctcggcagtgatcgaatagccaagctggggaggtggaggcaaggtcagctgttcccctcgccgagaaggcagcagctgaactttccgcttacgctgcccagagctgccaggtgtagactgagaattcgagtttagtttcttccttggggttgtatctgcagccttttctccctgggactccttgtctgctgccaatggagttgaagaactggaatgatgacacagctcttcttctcttattttctttgctggcctctccggtgtctgggagcgggatgaggctgggctagagaagggtgatgaactggggccatttctcttccagagctgtgagatgcctcgagtggagctgttgtaactgg

SEQ ID NO: 551362 - DNA, 133 bp, Homo sapiens
tcacgtctgtcagaccaccgactaacaccgttactttgacgggacgctgctgttccgtgcctactcactactcaacacgaactcggtcgtctcactgcacactgactcgcctggggactcctcgtacgacgtc

SEQ ID NO: 551363 - DNA, 233 bp, Homo sapiens
  misc_feature (44)..(44): n is a, c, g, or t
ccgtgtaagcggtctggtagagcggtctgtcatggtgagcaggnagggagagctcagtgtggggagaaggaagaggatgtggggcagaccctgccttggctgccctgtgggcagtggtgccacttgtgaggatgtggatgcaggagggaggtggagggaggagggcgtggatgcaggaggaggaaggaggaggccgtggatgcaggaggagagaccgctcttaccagaccgct

SEQ ID NO: 551364 - DNA, 938 bp, Homo sapiens
catggtggtgcatgtccataatctcacttactggggaggctgagacaggagaatctcccgaacccaggagacagagattacagtgagccgagatcgtgccattgcactccagcctgggtgaccaaaaaaaaaaaaaaaggttacagttagggcccttttaaaaaaaaaaaggaaaagagaaaaagaaacccttacaccaacctctccgagttttccaggggtgtttgatattattatatctcctggacgagttcctttggggctccttctaaaatacactttcaatccacacgtggccattagaacccaggtgataacttccctcacaattatattattggatacttcacaatttcttaatccattcctgtgtgccattatttttagcgcattttaaaaccctcttatttatccattcccaatctcgtgggtccaggtgtattctcggggaaaaattcccaagagaagtggcactctttagagtttataggggcggaaattaccttaaagttttaatctcattctccccattaaacgggggttaataaggacacaaagaactataacccttacgggtctgggaactttctttaccacaaattttccaaggcaacacagaaaagaagaggaggaaatattgggcaaagcccaggtttcttccatcctaaaagggacctaaacgttacccctcctttagagaggaaggtggattttcacagttcccacaatttggttttaacaaacctactttctatttctccctacccacaaatttcctaaaaaaccccttggtatttaccctcacaatctggcaaatgtttccttggacaaggaaatacgggagggaccgggcgcccactggtagccaccacttggaggccaggcggaaacctggaggcacgagattgaacgttggcaaccgtgaacccgtccttttg

SEQ ID NO: 551365 - DNA, 185 bp, Homo sapiens
gggggggggggggttttccccccccccccccttttggggggggggggggttccgggtgggggcccctccccccggggccccccccctggggggggggggggggggggcttttttttttttggggggcccccccgggggttttttttttttttttttttttttggggggggtccccccccccccca

SEQ ID NO: 551366 - DNA, 551 bp, Homo sapiens
ccgcacattttacaagagcagacaggcaggcgcagtggctcacgactgtaatcccaacactttggaaggctgaggcaagtggatcacgaggtcaggagttagagacaagcctggccaagaaggtgaaaccctatctctaataaaaataaaaaaattagccaggcatggtggtgccacgcctgtaataccaggttacttgggaggctgaggcaggagaattgcttgaacctgggaggtggggaggttgcagtgagagccaagatcgcgccactgcactccagcctgggcaacaagagcaaaactccatctcaaaaaaagaaagaaaagatgaaacaaatttgggggccgtgaagttctctctcctacttctctctgttcctgttttatgtcctcaatgtttaggaggatgtctcttgaaaatcactcttaattttcatcagaaattatagataaagatgactttttctgggagtgaaaatttcactcctagtttctcatgtgtagaagtgtttttggttagtttgttaattaacccttatggaaagttattt

SEQ ID NO: 551367 - DNA, 892 bp, Homo sapiens
cagatgaagaagcctgatgtcagagacagtggtgtccagggggcgggcacagtggctcaaacctgtaatcccggcacttgggaggctgaggctggcagatcacctgaggtcatgagttcgagaccagcctgggccaacatggcgaaaccactgtctgtactaaaagatacgaaaattagctggggcatggctggcgctactatgccgtgttaatgccaagctactcaggtaggtcggtgaggcatgaacacatgtgcttggaacccaggtggcggtagggttgcgagtaagccgagatcaccccacgtgtcactccagttcctaggtgacagagctaaacagctccatctctataaaattgacaaaagaaaagatgacaggaagaaacagaaacagtaagagttccttaatccaaagtccacacagcagagtcagacagagctaggtctcatacctgaatctctttgatcctaaatccagtagttgtttctacattaacataagtgaaactggggctgggcactagtgactcacacctgtaatcctaacactttgaaaggtcaaagcaggaggatcacttgaacctaggagttacgagatcagctggacaacgcagtgagaccctgtctctattttttgtaacgttttaactaacaaaaatgatggaatggggattgaatgcaggtcgttggattcctaaccaactatggtaattggatactgcatatatactaaagtaagtccatcctcccttatccagtgcatgcctggaaccccaatagtacaaactctattttcctaaggttcctatatttacttacctgtattaagttactatttaattaggccggacgagataaaacaaggtgtgtgtactgacaattttccttac

SEQ ID NO: 551368 - DNA, 436 bp, Homo sapiens
  misc_feature (422)..(422): n is a, c, g, or t
aggattctctctctctctctcctatcatcccttacccagccaacctccccttcccgaacctgctaaagaccctaaggatctcccaaaattctcccattgttggccacctcatccaccatcaaagcctctgagagggtttttacagggccgtgttagagccttcacccatggaacagtacaagacatgatgctactccgagaataccgacagctccagggaacagcagtccctactacccagcctctccccccaaccatcgcccctattcagcaagaagcagccagaggacaacggcgcccctcttctattacctattaaaaggctgggaatgttagggaacaagttgcaccagaacccttccccaccccaatggcaggtgttccctttaccctggattattttgcaggtggatttctggggnctttattttggggg

SEQ ID NO: 551369 - DNA, 825 bp, Homo sapiens
tagctactaatcgacggcctactctattgacctctatcgctatccacaacctaggcaactacactaacgaccacccgtatgcctgcttaaatataaccagccctctattctatttcttatagcataatgtaatattttacttggcttcttttaggatgcggtaagaggtttaaaaaggagtattctgtagggttcgtaagcagtgaaatgttcatatggtccagctattctgtgtcatatatatctctaggtggtattcatttcccaacgtcagtgtctaacttctgacacttgaaaactaaataaattgagtctgataacagggcatttcaccagttatagatcggaacactacaccttattactacaatgatcttggagccgcattttaaacagctttattccaaatttactctcttcgttccgacagtcagcttaacagtatgccccacaacagaaaacatgtagggctcctaatacacaacacacacaaacagcatatacacacacacacacacacaacagtacaacgtcaactaacgaagggaaaactggtataaatattcgagggcattagtttgtaaccagcactcgccatactaggtttacccagctgttgacagtcaactagaacactcttcctgaataacaacagttaatggccgtgcacacaagcaagggccttacactagagcgaacgaagtaatgacataggggagatacacacccagggacaaggtgacgcagtaagaagtgatcagcagttaaacggagttacacaagaggcccaagggggagaccacgagaaagatggacacaaaaccg

SEQ ID NO: 551370 - DNA, 1922 bp, Homo sapiens
  misc_feature (711)..(711): n is a, c, g, or t
  misc_feature (1249)..(1249): n is a, c, g, or t
tgttctcgctcaatgatatatattaatcgtctttggtgtagatctatttgctacttgctcgtcttattctgtgttggtgcataccacctcttcgtgggggggagacgattctcttctgctgtggtgttttgtggggggaccctcactctgctgatctagtcacatttgtgtcgttcatctgtgtttctaattaagatgggcctgttcgaggagtgtttcttcctcctgccttctctataatgggggggtctcctctacggcctccatttgtttatttttggtgacagcctcgtattttcccgctgttctgcgtggagcgacacctcacaggtgtgtgtgcaccaccatatcgagggggggcggggtttggtttgctccgctccacagcgaggtggttttcctccacacccttcagtaactattggtgttttgttgttgaccagaacacacgcgggggggggcgttctacatgtttgttataagctcgctgtgtgtgcaccccagcaggtggttccttctttgtagttggtccgcccctcgatttattttagaaggtggtgtgtgaggacacagacacgcaccccgccctttctgtgggcgtttacctaacatggaataatgcccctcacaaggaggaggggcgggtgtgtggttgttccccccctcgttctgtttttcgcccttcttgtttttgcgacaaccgtggggggnccgcagacccaacagacgcaccccgacctcgttgtcgttcgcttctctcttcgtccctcgtggtgggggatatttgcggaggggagaaaaaaaaaaaaatatgtggggggagttattagtgggagaagagaactcctcagctgtctcgccaccatcattagtattggggtgcccacacagcgctggggtgagagggccccccaccacgagaggagcccccctcgtttggggggccgccccacgcaaccacctcgacgagaagatgtggtgctctttgaggcgaaggatagcgtgtcgtgtcgccacctcgtcgagtagcacacagcatatacttttgtgctattttcttcgctcccacactttctgacacgcacactttgtgtttccccccctctctctctctcacacataggggtggccgccccccactgtagaacacagagagagagttttctcacccctgtgtcgctctcgcttctctccgcacacgcccatcctctctctgtgtttttctctctctctctgtgtcgccctctcnctcacagagagtatttgtggagtgtctcccacatattgtctctctctctgtgtgtctcacacacacacagtcacactctttgtgtggacacacagatgtgtgtgtttgtgtgttgttgtgtgtctcacaaggagtgtctcacacatatgttttgtcgacacacacactctcttctcatgtgtgtgtggtgtgtgtgttatactacacagtgggcgcacacacatgggggtgttaatatctctctctcttgtgtccgctctctgctgtgtgtgtgtgtccgcacacagagatatcctctctctctctcctcacaagatatatctcttttgtgtgtgggagaagagagaggggtttgtggggacatgtgcacagagggtgtgtggtgaaccgagactaacccccagctgtcccacagcggagaagagtgggggcctctcgcccctcaaggagatctgcacaccacagagagtgaagcaaagaggggcgcccgaaattggagccacaaaaagaggggtaaggggcgcacccccctccccccgtgttttttggggagagaggggataccacacgagagattgttccacaccccggggcgtcccttctttggtgtttctatatttgtcacggtatacttgtgaattaaaaaaaaaatccttttttgggaaaaaaaaaa

SEQ ID NO: 551371 - DNA, 491 bp, Homo sapiens
ttgaggccctcaacatcagggaagagaatccaggtatttttgcagggttgaaggaaaagtgcggacaaattcataaagctttacaaggcatttctggataaaaaggggggggggagtccctttctccagcctttcacctacaactggaagagagcactgggtctcgcgagcaagatgtcagactgcttcaggaaattgtagaacaatgcatgaacagaaagatggcattaactcaggcgcgctacttggagaaagaagagaaggggctccctcctcccagcattcgggttgggggcacgggggaacaaacagaggaagaactggagagagctgcgtccaccatcaaggaggtagcccaggccggccggctttaggcagagacccgggaccaagggctccctggcaaacaaaaaggcgggggggctaaagaatcccggtggccaaggagtgggccggaaggagaggaagaacatgggggaactttggaaagg

SEQ ID NO: 551372 - DNA, 416 bp, Homo sapiens
  misc_feature (103)..(103): n is a, c, g, or t
agttaaacagaattaagagtgtatgtttacaaacgttgtgaggtgacttaagaatacatttgacaggcgacatcgttcttcaaacacagcagcattcaagacngacagcgtgcattcaagcaggcaccgttgcaacatcccatgcacgccagggcagcacattgctcgtcattgcaacagccctcagttagacgccatttgactcaaagcgccagcacgcaacacatggcaccagccattcaatggcggcagtcggtcaggcatgcaaacaattctcggagaagcatacgacagtttgcaacgtggcactagattgggaagcacagcacagtcacgagccaccacacctctcccctcctctcctctccccctcctcttctctctttcccttctctttcctcctccctctctcttcg

SEQ ID NO: 551373 - DNA, 116 bp, Homo sapiens
tggcgtaggataccggtggtttttaccgtacgttatcgggtacacggttacgtattatgtacgactgttttgacgtttggactacttactacattacgcgactggttacgacacta

SEQ ID NO: 551374 - DNA, 110 bp, Homo sapiens
  misc_feature (3)..(3): n is a, c, g, or t
tantacttcatcaccagtgcatacctcttatgtcaacacagacagcagccaggcaagcagaacaaatgcacttcaagtattttacttttaagtgctcggtggtatcagct

SEQ ID NO: 551375 - DNA, 166 bp, Homo sapiens
caaagggggggtccccccaaaaaaaggggtcccttgcccccggggggttccccccccccccgttttaaaggggccttttgggtttccccttttttttcccccggggcccccccccccttaagtttttaaccccccccccccccccaaagggttttttttattttta

SEQ ID NO: 551376 - DNA, 373 bp, Homo sapiens
  misc_feature (66)..(67): n is a, c, g, or t
  misc_feature (202)..(203): n is a, c, g, or t
  misc_feature (205)..(205): n is a, c, g, or t
tcacttggtttcgggtgtgtcgcaaaaatgttgcctggaattttaaaaatttcttggggggccccnngggggggcccctacgcagggacaccccccgtttccagccctttgaattggggcctgacattaaacccctttttttttaagggcccagttgtgcttggggggcccctcctcccccgggtgtttggcaattacaaanntnttttttcgggggggttttcttttataagggggtttcctttaaacccccggggggggaccccctttttttccaaaaaaaccccccccaaaaggggggggggtctttttgttcccgttttttcccagcccaggggggttttcccccctaataaagggcggggggtcggca

SEQ ID NO: 551377 - DNA, 310 bp, Homo sapiens
cgtattggccgcgtccgtgatcgccagcgcctgttccatgttgttgatgttgaaggccggtacgccgtaatcgttctcagccgcatggtcgagcaattgacgcaacgtgatccgagccatgtgtctttctctccgtttgggcctgcgacgaggccgctgacttctcttcttgccgacgaaattatttggtgcgaagcacctcgacgccgggcaggggcttgccttccatccattcaagaaatgcgccaccggcggtcgagacataggtgaattgaccggccacatgggcctggttgagcgccgcgacggt

SEQ ID NO: 551378 - DNA, 740 bp, Homo sapiens
acttggcactgagtatataacatgaaagtgatagccagggtttctgccctcaatgagctaacatcagaatggtagtgtggaagaggggagggtttggtgtaggtgcaagggcagataaacacatctgaacacatacaataaattcaaatggtgttaagctcctaatgtaacagttgcttggaaattagttaattgtgaggttacttatgattatgcaaaatataaaccatgacttagtgtcttcagttgtgtcagagataactacacttaagtgttttaatcaaccttattgatgtataatttacatgtgataaaacacacccatattgtacagtttgatgagttttgaaaaatgtatatagtcaccaaaatgtatactaccaccataatcaagatgggactctttattgcaaaagatttgcctccgcccttgccgccgattttcctcacctccagacaaccacaaaatcctttctggcactaaaaattagttttgtcttttcactgatttcatataggtggaattacacagtattcacagttttgtatctggcatctttcactcagtatattttgaaattcacgcatgttccatgtatcagtagtttttattgctaagaattagtttattttatgtatatataccacaaattgtttcagtttgcctgttgatggacatttgggttgttttcactttggggccattataaataaagctgtttatgaacattgatttacaa

SEQ ID NO: 551379 - DNA, 111 bp, Homo sapiens
ctagatataagaaccgagcgaggtctacgagcgattgagcatcatcaaaatttcgccctcgccttttctctgattacaagctccctttcgattttaaacggtaggtacaga

SEQ ID NO: 551380 - DNA, 804 bp, Homo sapiens
  misc_feature (16)..(16): n is a, c, g, or t
gatggtctctcttgtntttcttagctaatgtaagtaaaattcacttggtaatttatgtgtcacatagaattgaagtttttctcttgctaatattattcctattttcaaatttggggttcctgttagcctgattttcggatagctgccacaggagttgtccttgatctggataaatccataaaaatgtgaagaaattaaagctaactggttttccatataaaatttttaagaacacttcatttattaaggtctgtatatctatatattctcatatttatagatctccatattgttgagaaaaggaatgaaatacctctaaaatatgggcctcatatttttagaaaagtgtttgaaatcttttataaacttcatatttgtgtttgctcctttatattctgtattacttaaatatgctcagaaaagcagtggtaaacagctatttaggaatgaggctgttactcctgacttccatgtgagactgcacagaatcatattgaaaatatgtcattttatccactaaggtttttgtttcctactttttaaattgtgtgttaagaaagggaaaaaaatcacaagtttgtctaactcagtagaaaaattcgacaaagcatttggagaacaacttggcaagggtacagagaaacggatgtactggttttcagtatgtggggaggggggttgagcagcattatggcatttcttagtgggggtgtttctattgaaacggttggaagttaaaatgtctgcatttgggtaaatacccgggttttatggtcgttaggggcttagaaaggtggggcctgg

SEQ ID NO: 551381 - DNA, 954 bp, Homo sapiens
gctcgactgaatcatgcagaatttgaagatcaagatgatgaagccagagttcagtatgagggttttcgacctgggatatgcgtctgaagaaacatcgctggtataagaaaatcctcaagtcccgagatccaatcatattttctgtagggtggaggaggtttcagaccatcccgctctgttatatcgaagaccacaatggaagacaaaggcttctaaaaccctatcactccacagggaactggtttcttggcaatacagtctgtcagtggcataatgcctgattttcggatagctgccacaggagttgtccttgatctggataaatccataaaaatgtgaagaaattaaagctaactggttttccatataaaatttttaagaacacttcatttattaaggtctgtatatctatatattctcatatttatagatctccatattgttgagaaaaggaatgaaatacctctaaaatatgggcctcatatttttagaaaagtgtttgaaatcttttataaacttcatatttgtgtttgctcctttatattctgtattacttaaatatgctcagaaaagcagtggtaaacagctatttaggaatgaggctgttactcctgacttccatgtgagactgcacagaatcatattgaaaatatgtcattttatccactaaggtttttgtttcctactttttaaattgtgtgttaagaaagggaaaaaaatcacaagtttgtctaactcagtagaaaaattcgacaaagcatttggagaacaacttggcaagggtacagagaaacggatgtactggttttcagtatgtggggaggggggttgagcagcattatggcatttcttagtgggggtgtttctattgaaacggttggaagttaaaatgtctgcatttgggtaaatacccgggttttatggtcgttaggggcttagaaaggtggggcctgg

SEQ ID NO: 551382 - DNA, 148 bp, Homo sapiens
  misc_feature (4)..(4): n is a, c, g, or t
  misc_feature (88)..(88): n is a, c, g, or t
  misc_feature (130)..(130): n is a, c, g, or t
  misc_feature (146)..(146): n is a, c, g, or t
accntaactgggacacctctgaaacagagaagaggaaagtttatagcattaaacacccacatcgagaacttagatctaaagttaacancctaccatcatacctagaggaactagagaaaaaaagagcaanccaacctcaaaagtancc

SEQ ID NO: 551383 - DNA, 3430 bp, Homo sapiens
tttttcatgaacaatgactatatttttattttagcaagaaattcgtagctgatcgctgggactgaggaggcaagaagtgagtgattgggaaaatggattgattgccatggttcatacttgtctctttttctctctctttctctctcagcttgcacctacaaaaaccaggagtgccgtttgaccatacattatgagaatggattttctattaccactgaaccacaggagggtgcctttcccaagaccatcatacagtctccttatgaaaagctcaaaatgtcttcagatgatggaatcaggatgctttgagaaaagaagggctgcaatgccaccagagaacgtgatgtcagacaccatctgtagtgagcagcgcaccagatgtagcgtgctacagtcagctttagctctcaagagtcgtatgtaactgtcccagactcctctgtcagtttcagcaactacaagggataccctgcgaaagtaccatgagaaatatcagagtaaaactttctagaacagtacaaggttaaagaggtgaggtgacgggaaatacacagcatagctttgaaataatgacaaccaaggacatgaccattagaacagcatgtgcagatcttaatcatcccagttcctaggcaacttgttcaccaggtacgcaagggccgaatagttgagaaatggacattcttacctactcctcctagccccctatccccagtaacagtgatcccttttcttattgtgatttatttcctaattcttgctgagttgactttcccttgtaggaaaagaaaaatatttcaaatagaaacccaccttttatttaagtatgaagcagctgttactttttaaaaaatgaattatctttcaatggtgtagaatgattccaaagtgtctccattagcatatactgagcaggaattaaataaagcatcagatactgatctgagctgtaagctggtagaatctgagccaaagtagactgcttaaattgataagctttgctaaagagttgtatgcacaaaggatgattaattctgggactatactcacaccaaggtctgctgtcttatagccaagaattacagctttatttatagagagtgaattatgggtattttttcagaaaatattgtcatctgatatacacataaaacaactcacattgttggagttaactaattatccccatttcatggttttcagtggcaacttactgacccttgtttttgcctgtgcttgtatgcatgcattttcaagcaagtaataaagcagcctcatttaattctggataatgctgggttttacatatagactgaatgctataatcaaatctattgacagtatctgcagttctttcagaattccagggaaataatataacgacctgatatctttctacaggaatattttcagacattatatagcacattactgatttaatgcttttacttttatctttcaaaacaaattcactaaaaataacacctatgattttgaagtcacttttctcaaaccttgaaaatgagctctaggatctctataaacatttctaacacttttcctgtagtttacatagacagacatctgttgttagacctgtgtgtttttaaagaatcatatgttaacaaatacccatgcaaagagcttcaaaaagtgaaaccgtgttaaaggaacacaatttttctcactcagacatatttgtttattgaattgcaaagttttattttaaatcagcatttccccaaagaatatatcatatgacgctagttccaaggggcttgactgagtggtgttttgctggggggagacaggggtttgttaatacactttactaaatactgagctgaaaaatgttaaatagatttcacgattgcctccttgaagattttaaagttcattgtggttcttcaaggcgaaatccggtgaaccattcctcacacttacctacaggactcttttctaatggagcatcttgtgaagctagtgggtttttttgttgttgttatttgttttttttttttaatgctttagaaaacacagctttaggatattgactttttgtttatttctattttcaaatgctgaaaagtcaagtcccagtttgaataccatagaaaagctttgatgcatttgtaaattatattgcactctttcactatatattttcaaaatcactggaatgttgttatacaagagaattataattgtgtattgtaaataacatattaaaatacatatattaatgccaatagttaaattcaacaatatgtaatctaaggtgctcggttctacatgaagtatgagttaactgctcataattaagttgccaagattctattatatatttatagacaaattaaaatgatcataattacaaaatatgatttctttatcacttaagctttgggctgattaatatctgtgtggggggtcaatggaaactacattctctacatttataaacatttaatttaattatttatattttaggaaaatatatttgaataaaattaatgcattttctagagtaaattaaaatgttattagcaagaaatagaaaatttgactaagataattgtgtatatgaatcatttttcccccaagttaaaatgtatcataatagagaggctctaatgaatcaatttccaatactcatttctttcttattttgaattcaagttacaatgactttacactgtagattttaatcttgtctgatgtgtgctggtgtgtatgacacaaactcataagtctggatcatgcttgggtacagtcaatgaatcaaccgagtcactttgaggaatttgtttttgtccaatttgctctgtgctcaatcccatgaattattaaatttacaatgtttgtccccaaatgaaaaccaatataaatgaatgatgttttaatctgtactttatgggaagttgcctatttgtcagtagatgtggttaagtgagtcctctggtgcagtgacatccttttaagccatctcatagggatttaaagaaggccaataggaatatagatattggtttttctttctctgacttgaactaagtaggagaaaccaaaccataaacctattacaaactacccaggcagaggcatttacttaattcatcaactagtgcaattaaaaccctgaaaacacatgatccttgttgactctgcttggttgaagcaggaaagaatggtcttgatggtcagaaagttttaaaattaatgggcagggcctttctggaccctgttttccaaacacgttagatattccgtcttgaggggattggagtaggctacagtgagggggtaatttttggatgtatctggacttttaaaaaatgtgcctatatttatagcaccatgaatattatgtaaaatttatatatgaattaaataaatattcacctctgatttccagtgcaaaaaaaaaaaa

SEQ ID NO: 551384 - DNA, 307 bp, Homo sapiens
tgatgacaatgaggctactggaaataagattgacttacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcaggtaagttcaaccttttatggtactctttggggaaatatttactgtttgttctcagcaagttcattttatgtttttattaaactttatttgtggtaaa

SEQ ID NO: 551385 - DNA, 2557 bp, Homo sapiens
  misc_feature (24)..(24): n is a, c, g, or t
  misc_feature (46)..(46): n is a, c, g, or t
  misc_feature (50)..(50): n is a, c, g, or t
ctgctccgcggctccccttgcttnggggtttgaactggctgctggntttnttcccctcccctgtctcggtctctccttcttcttttaggttgctccaccccggtcaggatcaggcgagggggaaccagcctgagtgcagctgccaactcccgccgagtgcgtctgcgaactcccggagcggagtcccgcgtgccgccacctccccgcgggacgcactctcctcgctcccccgggccccgcgtcctccccccggccacccttccccacgttgtccccccttttccaatcacatggcattttaagaatgccggaaagatggcggtagcggcggcggcggcggcggctgggccggctggcgcgggaggcggccgggcgcagcggagcgggctgctggaagttttggtgcgggatcgctggcacaaagttctggtgaacttgagcgaggacgccctggttctgagcagcgaggagggcgctgcggcgtacaacggcatcgggaccgccaccaatggctcgttctgcaggggcgccggggctgggcacccgggcgcgggcggcgcgcagcccccggactcgcccgccggggtccgcaccgctttcaccgacctgcccgagcaggtgcccgagtccatctcgaaccagaagcgtggcgtgaaggtgctgaagcaggagctgggcgggctggggatcagcatcaaggggggcaaggagaacaagatgcccatcctcatcagcaagatcttcaaggggctggcggcggaccagacccaagccctgtacgtgggcgacgccatcctgtccgtgaacggagccgacctgcgggacgccacccacgacgaggcggtgcaggcgttgaagcgcgcgggcaaggaagtgctgctggaagtgaagtacatgcgagaagccacgccctatgtgaagaaaggatccccagtatccgagattgggtgggaaacacctccgcctgaatcccctcggttagggggcagcacctcagaccccccgtcatcgcagtccttctccttccacagagaccggaaaagcatccccctcaaaatgtgctacgtcactcggagtatggccttggccgaccctgagaacaggcagcttgaaatccactctccagatgctaagcacacggtgatcctaaggagcaaggactcagccacggcccaggcatggttcagtgccatccattccaacgttaatgacctgctgacccgagtgattgctgaggtcagagagcagctggggaaaacaggcattgctgggagccgagagattaggcatcttggctggcttgcagaaaaggtgccaggggagagcaagaaacagtggaaaccagccctggttgtgctgactgagaaagaccttttaatctatgacagcatgccacggaggaaggaagcctggttcagcccagttcacacataccctcttcttgccaccagtcctcatccgtgaacattatcttcagattctgagacattcccgcaacagaaaccaaagaaagattagaccacagtcactggattccagttactaagaagcaaagttggacccaagcatcttgaaatgattctcagaaacaaaagttgaaataaggtagtttctgcaactctcaggcaacatgaaaataaaatttaccctcgtacatagccttgttctcacagtttctgggcattatgaacaatggggactgctttttcattcattcattcattcatcagtcaacatttataaatcatctactatgtgccaggagttataattgggacaagggataaagaggtgaaaaaaattcaaacttgtgaacctagcattatctggaacaaagtgtgttgatgtgcaggaacacataaggaaccatttgcagtaaagacaacaaaaaatgccaaactctgcctggacagtggtggaggactccttgcagtagaagtcatgttgaattgaagcctgagggaaaactcaccagaggaacaagggaagggagcccagagaggggcacgagcattccagacttagggaagatccaagcacagagctcgtgcactgctgcatggcccagttagagcaccacatacggccctggggaatgaggggaaatgaatcagatactcactaagtacccagcacttgacacaagttaccacttacaacgtgtgtatccattctgcaaggccggtattagtgtgcccattttgcagattaggtacctgaggctcaaaagagttcaggaatcaccccaggtggtgtagcttctgagagatggaggtgggattccagttccgggactgtgtgtcacttgcatacctgtgccttggtaccacagggggttgacacagaggtgggagatggggaggaagacttttcactagcgtatccttttctaccttttgaaattggaaccatggggaacagcaggagtctttggggatgataagagtcatggatgtgatctgggtagatatttttatatttggtgtcaaataacaaatgtccaaggagtgactgctgaatccaattttgcagtgatcctgattccattgtaaagaaa

SEQ ID NO: 551386 - DNA, 172 bp, Homo sapiens
  misc_feature (30)..(30): n is a, c, g, or t
  misc_feature (52)..(52): n is a, c, g, or t
  misc_feature (92)..(92): n is a, c, g, or t
  misc_feature (124)..(124): n is a, c, g, or t
  misc_feature (155)..(155): n is a, c, g, or t
cgtttaacctgtggctggtggccacctttnttgatttgggcttacgagtttnatagtagccagtcttagaaaattgggggagtaaaattttnaagtaaaaaaaaaaaaaaaaatgacaaggganccaaatgctccttctccccttagtacatttncattacttaatgaagtt

SEQ ID NO: 551387 - DNA, 544 bp, Homo sapiens
tggctaacagagtgagactcttctcaaaaaaaataaaaaccagtgaccacggaccacgggccactgtcacatctgagccaggttcactgccgctcctctgccgactgactgcctgacagtggctgcgcttctccaggtgtctcctgcctgctgtgtggacggtcccgtcagggttgggatgcgcctgctgtcccctctcctgtctcgcagtcttgggttccccggagttgcaggaatcagggcatttgcccagtggggccttgctgctggatcccctggtcgggactgtgtgcctgccacgtgtcccgtggccacctggccatgtggccggccaaggccctgtgagatgtggcaggcaggcacctcgggggcctgggtctcctggaaatgtttctgtcactctgggcgcaggtggcgccagctgggttgtcctcataaaggccccatccgggatactaggaaggccatcctcaacctgtccgcacacgtcacctccatgtggcctggccacagctccttcaggcatcagtctgcaggcggccgc

SEQ ID NO: 551388 - DNA, 1808 bp, Homo sapiens
  misc_feature (24)..(24): n is a, c, g, or t
  misc_feature (46)..(46): n is a, c, g, or t
  misc_feature (50)..(50): n is a, c, g, or t
ctgctccgcggctccccttgcttnggggtttgaactggctgctggntttnttcccctcccctgtctcggtctctccttcttcttttaggttgctccaccccggtcaggatcaggcgagggggaaccagcctgagtgcagctgccaactcccgccgagtgcgtctgcgaactcccggagcggagtcccgcgtgccgccacctccccgcgggacgcactctcctcgctcccccgggccccgcgtcctccccccggccacccttccccacgttgtccccccttttccaatcacatggcattttaagaatgccggaaagatggcggtagcggcggcggcggcggcggctgggccggctggcgcgggaggcggccgggcgcagcggagcgggctgctggaagttttggtgcgggatcgctggcacaaagttctggtgaacttgagcgaggacgccctggttctgagcagcgaggagggcgctgcggcgtacaacggcatcgggaccgccaccaatggctcgttctgcaggggcgccggggctgggcacccgggcgcgggcggcgcgcagcccccggactcgcccgccggggtccgcaccgctttcaccgacctgcccgagcaggtgcccgagtccatctcgaaccagaagcgtggcgtgaaggtgctgaagcaggagctgggcgggctggggatcagcatcaaggggggcaaggagaacaagatgcccatcctcatcagcaagatcttcaaggggctggcggcggaccagacccaagccctgtacgtgggcgacgccatcctgtccgtgaacggagccgacctgcgggacgccacccacgacgaggcggtgcaggcgttgaagcgcgcgggcaaggaagtgctgctggaagtgaagtacatgcgagaagccacgccctatgtgaagaaaggatccccagtatccgagattgggtgggaaacacctccgcctgaatcccctcggttagggggcagcacctcagaccccccgtcatcgcagtccttctccttccacagagaccggaaaagcatccccctcaaaatgtgctacgtcactcggagtatggccttggccgaccctgagaacagccataggaatcacagatttgaggaactgaaggcgaccataatgaccatgtggtttgaattctcctggattccccgaagttgctgcaagccagcaagacttcatcctcctgactagtttcatctgtgttttctccagagtcacttggaggggaaaggcagcttgaaatccactctccagatgctaagcacacggtgatcctaaggagcaaggactcagccacggcccaggcatggttcagtgccatccattccaacgttaatgacctgctgacccgagtgattgctgaggtcagagagcagctggggaaaacaggcattgctgggagccgagagattaggcatcttggctggcttgcagaaaaggtgccaggggagagcaagaaacagtggaaaccagccctggttgtgctgactgagaaagaccttttaatctatgacagcatgccacggaggaaggaagcctggttcagcccagttcacacataccctcttcttgccaccagtcctcatccgtgaacattatcttcagattctgagacattcccgcaacagaaaccaaagaaagattagaccacagtcactggattccagttactaagaagcaaagttggacccaagcatcttgaaatgattctcagaaacaaaagttgaaataaggtagtttctgcaactctcaggcaacatgaaaataaaatttaccctcgt

SEQ ID NO: 551389 - DNA, 114 bp, Homo sapiens
gctcagtatatgaaatcccaacataactgtggcatacttgtgcaggtgttatcttctccgcttagaatgattcctctggccgggcgcagtgggctcatgcctataatcccagca

SEQ ID NO: 551390 - DNA, 339 bp, Homo sapiens
cttaataacaaccctaaaaacacccacatatgcttttcgatggaaccggagagggggacgctaaagttcttatggaaaactacacactcaatagctaggaaaacacagggaaagaatagttctgagcagagcctattcttagccaatattaaaacatactatgaagcctctgatacttaaacagcatggcgctggtatgtaaatagaccaatgcagttaggtggctctttccaagactctgctgaaaaaagtagtaaaaagctaaatgcaatcaatcagcaattgaaagctaagtgagagagccagagggcctccttggaggtaaaagagatttgcatt

SEQ ID NO: 551391 - DNA, 394 bp, Homo sapiens
ggcctattgggggggaaaaaaccccctttaaaaaacaccccctttttttggggggggggggcccccccccctccggcgagaaaaaaaaccccccttttttttccccacctttttttttttttttttgggggagctttttttttaaaaaaaaaaaccccccccttttttaaaacccccctttttttttccccccggaaaaaactcccccccgggggtaaaaggggggtcccccccttttttttaaaaaaaaaccccccaaaaaaaggggcggggttcccctttttggggttttcccggggcggggtgcgcttttccccccgggaaaaaggccgggccccccttgttaagaatcccttttaaagaactttaggggaatccacccgcggattctcaa

SEQ ID NO: 551392 - DNA, 160 bp, Homo sapiens
agacacttggtcaagcatggaaacagggtaaaactagttatggcagtagtatgcacagcagtgttagccatttaatattgtatgttatatagcacgtgatgatgatcccatctgacctgtgagcatgccatttgaactctttgcgaggatgagctgccgt

SEQ ID NO: 551393 - DNA, 308 bp, Homo sapiens
cgtcggatgtgttcatttattatgatttattgctagctaggtctgccactctctggtgctagcggtgggagttggtgacgaagacttagtgaatctagatcatctcggaaggatcgaaagggtgctcgtagaggcatgcagctattttaacgtgtggactatgaacttgcgatggtggtcgcagtgcctatgatgttgagcacgaatgaaggagcacactctctgttcgatcaccgaacagtgtggctagagtatacggataagatatttagagaaaggccgcgggctgtgactgtgaagcgatctcg

SEQ ID NO: 551394 - DNA, 123 bp, Homo sapiens
agagaccaataagcgaccctcgcaagggtgaaactgcaggtagaccacgcaacgcaaaaatctaaagggtacttagccaaagacgtacaggcaagtatgtgactatataggtggtgcagcggc

SEQ ID NO: 551395 - DNA, 355 bp, Homo sapiens
tggtacgaggttgggacagtgtcagtgtgctccagctttggtgatagtgtaaggttctgtttcaataattaaaaaaaaaaaaaaaaaaaaggtcagggtgttgggattgcaggtgtgagccattgggccttgcttgtattttttattagccacaaatccagcaacaagctgaggatttagctcataaaacaggcttggtgttttggtgatctcacataaccaagatgttaccccgtggggaaccacatccccttggatgccctccagccttggtttgggcggaggttgcagtgggccgggacagtgccagtgcgctccagcctcggtgacagcgcaaggctccgtctcaataatt

SEQ ID NO: 551396 - DNA, 842 bp, Homo sapiens
cctgggaggctgaggtaggagaattgcttgaacctgggagctggaggttccagtgagccgagatcgcaccactgcactccagcctaggcaacagagtgagaccccatctcaaaaaaaagaaaagatggaatctatctcaatcagagaacaggtgaactagccctcctaaccgggaccatgcacaagacaagaaattctagcgctttttttccccttccagggtgcaatgtgaggacttaagccgacactggtattctggcctccaaatgattacacagttttggccccggctcatctatctggaggagtacgggttctttccactacggtattgccacatgttctagtagaaagggatgctttcaaacggggtccagcaccttaggaatctggtctactcagataggatctggaagatctacagggtttttacacttcgagcttcacaatgccattctgagaaggatctgtcgccaaagaagcctttaattagccccaccttgtctgcagaagctagagttcattatcacaaccttacttctccatttcagtattagcgtcacaaatctttaacaatctagggcatggccaactaaattaacttggattctggttacccttctcctgatgacaaattccatcaagcttaattaggaaaatgtcgcatctgggtattatcactgtgtgggcatctcatcggcagcatctgactggcggctttgaaccggggtaaattgtgatttcatcgaaccttaccaaaacgccggtggtcccacaagagagttcctgacaggtggacttcctgagaatcagcccggctgaaaaaggtagaaaccagaaag

SEQ ID NO: 551397 - DNA, 562 bp, Homo sapiens
ggggagagtcaatgctgcgccttcgactgaaacatccaggtactcacattgggactaaccaaggaaacaacttgacccagggagaatgaagaaaagaaaggcaaaatgacagcccacctgggagtaccacagagccagtggaacctccctcacccagggaagcagtgagtgaatgtgtgaccctggaaacccatgctttttccatggatctttgcaatccttgggttgggagatcttctcatgaacccactttaccagggccttcagtctgatggagctatgtggaatcttggcacagcagccactcaggcacacatggagacctgggagccttaggtacctgggctttcctgcagaagtagctgcaactctggcaaagtgggaggttagaccctcatacatattcctagggaagaggctgaattcagggagctgagcagcaacagcctgcaggctccacttccacagaacctcacaggataagagccactggcttggaattctagccagccaccagcaacactgttgagactccctgagatgaagctcctgagggaaggag

SEQ ID NO: 551398 - DNA, 1563 bp, Homo sapiens
  misc_feature (230)..(231): n is a, c, g, or t
  misc_feature (234)..(236): n is a, c, g, or t
  misc_feature (241)..(241): n is a, c, g, or t
  misc_feature (253)..(253): n is a, c, g, or t
  misc_feature (261)..(261): n is a, c, g, or t
  misc_feature (265)..(266): n is a, c, g, or t
  misc_feature (271)..(271): n is a, c, g, or t
  misc_feature (552)..(552): n is a, c, g, or t
  misc_feature (554)..(554): n is a, c, g, or t
  misc_feature (577)..(577): n is a, c, g, or t
  misc_feature (594)..(594): n is a, c, g, or t
  misc_feature (740)..(740): n is a, c, g, or t
  misc_feature (742)..(743): n is a, c, g, or t
  misc_feature (747)..(747): n is a, c, g, or t
  misc_feature (758)..(758): n is a, c, g, or t
  misc_feature (776)..(776): n is a, c, g, or t
  misc_feature (783)..(783): n is a, c, g, or t
  misc_feature (785)..(787): n is a, c, g, or t
  misc_feature (799)..(800): n is a, c, g, or t
  misc_feature (810)..(810): n is a, c, g, or t
gcatcagcttcgggaacagattgttcccgtggccgagtctgtcaccgtacacttcaacctagcctgcggagtgactcgtgccgtgacccctacaccgtatgactccgggacgcacgtatggagatgacagggtacgaatgtttgaaccagatcatcttcactggtgagtcagtgatgaggcattggaagtggtcatttcaagatgtgattcatctagatggagccatgannatnnntgtgnctactgctgganagaagtgngacnntcagngagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgacaggcactactggccagtcctacaaccagtattctcagagataccatcagagaananacactaatgtgaatagcccaatnagatgcttcatgccttnagatgtacaggctgacagagaagattcccgagagtaaatcatctttccaatccagaggaacaagcatgtctctctgccaagatccatctaaactggagtgatgttagcagacccagcttagagttcttctttctttcttaagcccntnngctntggaggaagtnctccagcttcagctcaantcacagntnnntccaagcatcannctgggagttnctgagggtaaactcataaatgagggctgaaacattgactgtgctagtttcgaagtatcaaaaccgatcaggtaattattacatgaagtgattctaaagatatggtcatgagaatcaataggaaaaggatatgcaaggcaaaataagaagacaatgtatacgaaatgatatgacaagaatttaggtaggaaagataacaaagattattgattcacttagtgtatgacctgacagtactgttgaaggaaacaaggatgcacctggttcatggaataatttggagatatcagggtaccaactatgtgaacataaatcatgatatatgacaaaaatattaagtagacgctgagaaactaaaataaacagatattatacgagcaatgtgtagtacaaataagtaagagtagaaaagagaaaattaagcgataaatacacaaatgaaccgccaaccgagaaacacgtacaagcagcgccacagagagaccaaaaaaggagagggaaaaatagaaagcagacagacacaagaagaagaagaatcgaagaaatgcaagagcactcaccacaccacatcgttgatgtgtttgttctctggtgatacttagactaagtaaactacaagatgaaaaaaaaactacatcaacagtaacagaactatcgcaagaaacagatacaaataacaaatagaagataacagaaataagaagctagaattacaagatgaaaacagagagaaaccaacagactaaaatctgtg

SEQ ID NO: 551399 - DNA, 124 bp, Homo sapiens
  misc_feature (7)..(7): n is a, c, g, or t
ggctagnttctccaaaagatgcaatattcagactgacgtgacccccgtgacctaaatatcaccaaagacacggatgcatagtacaccccggccttgttacataccaatgggccgtagatacacc

SEQ ID NO: 551400 - DNA, 132 bp, Homo sapiens
ggcacgaggtgtactgctccttggccaagagaggccatttcaatcgaattatctcatggcctaacagggactttctgcagtgcctctgaagaacttacgcagattcagccgattaatgctaatgtaacacgt

SEQ ID NO: 551401 - DNA, 148 bp, Homo sapiens
gtagtccagtacacatctttctgaatcagctttaccccactaatacgagattacatctttatcactggttccccaaaatggcgagtaaaaagatcaactcttcaatttgtctacaaacaaatcatggcatgccggctttcaacaagag

SEQ ID NO: 551402 - DNA, 311 bp, Homo sapiens
agcgagcaccccatctcagaaaaatttaaacttggcttggcgcagtggcttcatgcctgtaatccagcactttgggaggctgagggggatggatcatttgaggtcaggagtttgagaccagcctggccaacatggtgaaaccccatctctactaaaaatacaaaaattagccgggcatggtggtgggcacctgtaatcctagctactttggaggctgaggcgggagaatcgcttgaacccaggaggcggtggttgtagtagctaggatcatacattgcagtcagcctgacagcaaagctagactcatctca

SEQ ID NO: 551403 - DNA, 649 bp, Homo sapiens
tgggccccaggacagtgtcagatgtgaacctgctttgatggctgtgttgttcagtgtactcagtgggtgtctcacatggcccgaggacccactgtgatgcactccgccctgctaggtggcacagaacacggctggtgtgtcatcacatgcccagtgtctttatttgaaaggctggctcatatagaacccattttggccatggtctgggccatctctctgcctctgccctatcttgtgctgcctggaggtgtgcccagtgcccaagaggattctattacccctggaagagctccccaggcattcagcctatggcccttgacattttggctgcaggttaccgtcagacaaaacatctctgagacaagaaaatgattacaaaacaaaaccgcaatttgtcttagacactctaatcaatgctaacacagttcagtttcttgagggaactagttttgtcataatactacacccctctatagtctttaaaaacaacactcaacaaatcttctgcacatacgttcatatcatatctattctacatccagttatttgtctcccacttatgacccctttatgttataggtacgatataagatggcggcatcaactggtgattcgccatcacatgggtgcagcatagagtaagacactc

SEQ ID NO: 551404 - DNA, 258 bp, Homo sapiens
  misc_feature (102)..(102): n is a, c, g, or t
  misc_feature (104)..(104): n is a, c, g, or t
ctcaatgagatttatacaaagacagatagcaagtcaatcattgagtttgaagagtggacagatgtttgccaaggaagatttgaaacggaagaagcttgtacntnatgggagttggtttctgaagaatgcacgcagaaggttgaaagaggttcaagcagtttttctcactgacattttagtgttccttcaagaaaaagaccagaagtacatctttgcatcattggaccagaagtcaacagtgatttttttaaagaagct

SEQ ID NO: 551405 - DNA, 918 bp, Homo sapiens
tccccatgcaccgaaccctttattacctttttgacgcgggtcccgctataacggaagagcttgtaattccaaactttaagttggggcaaagggctatggtgcccacataatacctcctgggccgtgaatgccgtgatgaaaaattaacagccccccctcaggcgcaggaccaaggtagcagggtcagactctttctgggattgttgtagtcaaaaagagttgcggccatctcccagctgctatgcctgcaaaaatagagcctctagtagagacgggggaaatggcttcttaatctggggatctgggccttcacatttcagatagggtgtcactgggccctccacctccagagtgatggtcttgccggacagggtctccgcgaagatctgcataaccacctctcaaacgcaggagcccaggtgcgaggatcgaccccttctggattgttgtccgtcagaaagatgtcgcggccatctcccagtgtttgcctgaaaagataagcctctgtagatcgaagagggatgcctctttatcctgaatctggcgcttcacatttccgatggtgtcagtgcgctccacttccagagtgagaggcttagccgaaccaggtctccacaaagatctagataccacccttctaagaccgagaccccgagtccaggctcccctttctgatatttgagccgaacgagtcagcgctcccccagcagttctctgaaaataagccctctcgagcagagagaacgcttctaactggacctagggcccctgacccagtccgatggcccccaagggagctcccgacagtacaaatccgtttgccgtacgacacagtcccgcaccccatccccaggaaagacccaatctccgctttgtggacaaacacaacacattcccctaaagtgccttgactagcac

SEQ ID NO: 551406 - DNA, 246 bp, Homo sapiens
gtatggtgtgagtcagccatcacaacaaatcccattagtaggaaagacgaagaagtgaaaaacacaccatccttctgcttaaggcagtttcagatatgacacgctatttctgcttacaacctgatatggtttgaatatttagcccctccaaatctcatgttgaaatgtaatctccattgttagaggtgggcctagtggaggtattggatcatgaggacagatccctcgtgaatggcttagcgccat

SEQ ID NO: 551407 - DNA, 794 bp, Homo sapiens
agacgggcgtgagcctcagtggcctgggatggctcctgggccccgctgggctgtgtgtgctgtgtgtgctgggatgcctgttgggctgagtctgggatctggggactgtctgccctgatgatgcggtggacgaggatggtgtctgggctgctggtgttcgatgccctggtgtctgtggctggctgttgaacttgttctgccaactgactggcatgcttccttgtgagcttgttcaatgctggaaggattggactggagtgatgcatgctggcatgctgtgcagtgagtgatgcctgccccctgttgtcctgcatgcgaccctggaccagtctggcctgcctgcacgcttggccccgtgggatcctgaaagattgaatgtgtgcttgtccgtggcttccacacttaagcttctgttggggcaaagctgcatggacgtgcgtgtgaaacaaacttaagcccttcaagactgtggaataagtacggcccaaggaatgcaagaaacgacgggagtcgattgaccgtgtatttacacaagttaaatggttgacgccgttgggccaatgtacattggccagaagttgaaaaaatgtacaaaagctcacccagttgccggttgacgatagataaaactcgtgccctggttgaaaatgaacggccactcccccacctgcccattgcgctggaactctctgcgatggtacattaaactatttaattgcagcgagagctgggcgacagccttacctgagaggacttaaaaggcagaagggaaacgagatgcttcccgaagacgt

SEQ ID NO: 551408 - DNA, 82 bp, Homo sapiens
gcaccaaggaaggagggtgctggggggacaaccccccaccatttctaacggtatgggcccaaacttccaattccaacttccc

SEQ ID NO: 551409 - DNA, 861 bp, Homo sapiens
ttgattttacgggctataagtttggtttattaatttgatggagtttcgctctggtggtccaggctgaaatgcaatgatgcgatctgtggctcactgcaacctccgcctcccggttgttcaagtgattcttctgtctcagcctccccagtagcaggaattacaggcatgtgccaccacaacgggctaattggtatttcagtagagacggggttctccagtgtggtggccaggcgggtctcgaaattcctgacctcaggtgatccgccgcctcggcctcccaaagtgtggggataacaggcgtagagccaccaaacccagccagtgtccttttaaaaggcccttaaaaaagggggatagaggtaactacaggctgtgacccagttgctattgggttctccttcctagtggctgcaagggcttggtggatccagggtgctttgagagagccatgaggaatccatagaaggtcagtctctgaacatggctgagggcctctttgacaagtgctggggatgggacagctgtacttggtgtcgatacccagaggttttccagacacgtggtgacacagcgacgcctccagccctccagagtgcgtgccccgccaaatgcaaggtccgttagatgatgctgcccactggacacgacgtcggacaacccctagtgtggggagtcacgtgcctgaaacaaggtcctcataaatggcacccacattgccagcaatctacatctaacacgggtcttggagggaagcgggaattggaaaaactcagattccagatttcatagacaaccggtggtctaataccccaggaatcagactatgctgacgattctatcgtgaatcccttgccagcgcag

SEQ ID NO: 551410 - DNA, 329 bp, Homo sapiens
tgcttgaaaagaatctgctctctgcagttgctggaatcagtgtctgtacagacccctctgatagaagtatacgtcgcgtgttcattaaacatcctggtgacctgccactccctgagggaggtgttagaaatttgctgacaacggactaatctgttcctcctgtagcgttaccagttttggagacgtgttcttaggggcataggacatgaggttcgtctgtttgttttgggaaactgaatttcctaacgcgatggactcgctctttatctccagcattgcccgctgccttggtgtctgctttgtttatcacacagtgatgctaactttca

SEQ ID NO: 551411 - DNA, 286 bp, Homo sapiens
gcgcaccgggagtgatgactggagatggcttctttttttttacagcctcatgaacccaacctctgctatcttcacacttctcttatgcagcttcctcactgtctctcagcgcgtggatagaattgcacagagagttcggctctagtacatggattaggattgggtttcaagggaatattatggctgcgtttgatcttcgtgtcttgcatcactaaaactttcgtgcatcattcgtcatgttcacgtggcagtaggattttcaaatttccccttccacaacttttgg

SEQ ID NO: 551412 - DNA, 131 bp, Homo sapiens
ccacttatgccgtggggaaggaagtgtgagtgaaggttgagaagtgtggtttctgcgtggagcgaagggccgctgtggtgtccggatgctgggacggtgctcagtgagatctcctttcccctgtcgtttcc

SEQ ID NO: 551413 - DNA, 1154 bp, Homo sapiens
ctgtagatgagtgggtggcgactctgatgagaaaccggagagctgtcccgaaagttgcacggtcgatctaatacatatgtagaaatgaacatttgagagtgtatagtcagtgaagtgcgccgagtccaagagttattattggagaattagttatgtagtgcgtggattagttcgatcgaaattaaagtgatgtgacaatgatggatagattggggagattaaattcttcacaaagcgataggtattgcgagttggtataataacaagtaatctgtggtccctgtaaatatcatcggtttcagcagtcggtcacggatgtccagcttatcaatatgcgcgaatcagttcatggtgtgtaggaagtgaatcacagggtgatgtgtgtagggcattatgtttagcacaaatccttatagaacagtaaccttcgtcttaggtcatcacaagggggactgtatgtatggtgattcgagcatttgataggaaggcaaagggaaagtatacgaggagtacgacgttataaatccacgttgaaattcatgacaaggacaaggcgaggatcattttattgaaggttgatattagcatactgggcccactgagtcgattaaactttagtggaactaaataagttgttaactgtggtaactccatcggaaattattaagcacgaagatgtaatcccaaacctcactataattctgtactacttccaattgatcagctcaggcatatctgcaaaggagtgccttcgtacggtgtaccatgtagagacactaagttcaagattcgccgtgaccaatcactggtacttgttagaaacatcccagcagccgggccacttttgtttgcgtgggtgacttactggaatttaaatgtcacagagatagttcgacgatgttgtcacctggagccacaacactcgcgacatgggaagtgtaaccaagcgtaatcctcaggagggtcaccgccctatttcgaacgcactcttgacatccgggaccttcgcaagcacactgatgtcggaactggtcggaaaaccatcgggtagagtgcctcgcctgcaccctcacgtggcaaatctggtgggacataaaagaagtcatgctgcacgggcgcctgttcatctggctcagatcctgtagccaatggac

SEQ ID NO: 551414 - DNA, 351 bp, Homo sapiens
acggcagtatgtcgtaaatggcagatttatgccgaggctcgtccagggaaatcatagacacgggttgtctttaccattctataagcgtatctgaacaaaccaggtggactcacggatttagaatctattgatcgagaattttacaattctctcatcggggttaaggaaaacgaatatggaggaatgtggttaggaaatgtacttctccgtgtgacaaagaaattctaggtgaaattaagagtcatgatctggaaacgctaatggtggcaatattcttgtaacagaagaacataaagaggaatacatcagcaatgggagcggtggcagcaatgatgcgggtaacaggggacg

SEQ ID NO: 551415 - DNA, 414 bp, Homo sapiens
tactgtgtgtatccccaacactaataatcatcaggaaaatgcaaatcacaacagaatgagatatcatcttagcccagttagaatgaccattactaaaaagataaaaaataatagatgctgttgaggatgtagagaacaggaaattttttttttttttttttttggaggcgaattctcactctgtggcccatgcggaattgcagggcattaatctcagcccactgcaaccttctgtttccccatttcaagcaatttcctctgttttcagcctcctccagttagctgggatttccaggcattgtcgccacaaccccgtgcttaattttggttatttttagttaaagcacgtgtttcctccatgttgggctcaggcttggctcatcaaacctccgcgaccctcaggttgactccgcc

SEQ ID NO: 551416 - DNA, 1002 bp, Homo sapiens
ttctagatcgcgagcggcccctttatattgtcttcatgttacactggtgcatttatttacaaagaggttagaaaaacacacagaatcttggccccccttgtgcacgggggagtcaccatcgtcataataactacagtaatttaaaaaagaaaaaaaatactagatgggaacagctgagggtcatcaggcttcccccattccctctcacagggagtgggggctcatgagataggaaaccatcttccttcccctcttctacctccgaatcctccaataagtggtccagggtactcgaacgttgaaagagtccgttctttccacgggtggttacacaaccgcctatttgtgacccttcaaaaccccacaaattcaggtgctcccttccgcttcccaggggcactcgtgcgagggacccaccgtgagctcagaaccacagaagtcctcgtgaccaggggtgccaaggggcgatatctataacgggctccagggcacctgcgagggggccacttgtgcgcaatgcaacagggggccaataccgtgggcacaggcaacggacggacttgccacgggcctccctcaccggcacatgaccacgtggatcacgcgcgtgcgatggtggcaacacacacacacactcaggctccataacacctacaacgacgggggaaacttcaaacccgacattacccccttttggccatcacccgtgcgcacactacaacgggtaccacgaaatgcagcgaacagctgcaccgccccccacacacagcgggcggaccacgtgtcttcgtagtgcccccgcaaagagtgacctctccccaacgctgcttaagataatctcgtgaaaacccgtggagcgctcacacatcaccagggagctgtcccttccccccgattactccctcctactggtatactatgtcgatgtgtggagcagcagccctttttgtcccacacgccgcagcgacattaggttaagagcgaacttgtggtcacacacaa

SEQ ID NO: 551417 - DNA, 177 bp, Homo sapiens
ctaaactgactttcccctgtctaacgctttggtttccccgtatggcatgttttctgagcgttcctactttaaagcatggagcatgcagagtatttgggaagtgataggacatcgacctgacgataacgagccgtgttatcagaggcaatcatctgtcgcgacgagagttacttcgga

SEQ ID NO: 551418 - DNA, 1459 bp, Homo sapiens
  misc_feature (153)..(153): n is a, c, g, or t
  misc_feature (575)..(575): n is a, c, g, or t
cttcctttcgtcgggggatggtcacttgttctggggcgtggtgcgactccttctccgccacggccttgggggtggtttatttttggtgggggccgcctgtgtgtgccccgtggtgatgctcgcccactgtggtcgccctttgtatgtgccgcnccctgtttgtgtggtcgccgcggggggggatgacgaccagagcccgcccccccgttgtcgtccccgacgcaggggagagtggtgcgtcgttgattgggggggacgacttatattataatgtgcgcggttgcttgaggagagcctttgtcccctcgtcctcgctcgtgttagcacaacgaaggtggaggtgaatctcttgtgggggagagaaagggccttttccttttgggaggggcggcacaacccgtggtggtgggggctcgtcaataaaaggggggggcgctagtgttgctacccagaggaggccgcgcctattgtggggggcgcccgtgggtgcgcccacgacaatggtgttcgacaaccccaccacggtcctggcggcgcacaagagatttgtgaggagtggagaccacaatgatggnctccaccagcttgggtgtgcggcgccctcccccactggtgcgcgtggcccccccgccttgggtgtctctcggcccaccaggggtgtgaaatatgcccccagcgccccacggagcgtctgtgggggtcgctccacagagtgtgaggcgtcattatgttgggcgccgcacccgtgggcggcacacacgcacacgctggggcgcacttggcgagagtgtgatatcacgtcggctgttatatatagcgcgccctctgtgtggggtgcttctctctctctcgagtttcgcgtgccacctcggcgcggctgagagttctctctcgagatagagagccctctgtgcgcctcgcgctctgagagagagagacccacaggtgtaggtctctctgcgcacatgtgtgcggtgagaaaagtaatttgggcccgagatctctccaccggcctcacagggttcttgtgctctcacagggtggcacagggtccaccgcccgggaaaggtggggatttgcacatctccccacaaagtattcccctcccttttctgagaatcccttcacgagaacacatccaaggtgttgttgagacttctacccctttatagcccacagagaagagagagatgaaagcacacgcttaagtgccccctgagccccaaaattggagagaataatatattgggccctaatgcttactccgggggagatgggaaagaagaggtctcccacagggagatccacagggccatccctcttggatccccctttaagtgagcccctatctgaggagcccccgcgtttttggcctcccttcccagctctcccagctaatgaggtcccgcccccaccgaaaaagaggagattaaattaacccccttggagccatcccatt

SEQ ID NO: 551419 - DNA, 140 bp, Homo sapiens
  misc_feature (7)..(7): n is a, c, g, or t
  misc_feature (61)..(61): n is a, c, g, or t
aagctgntcccattgggtgtgaggagttcagttatatgtttgggattttttaggtagtggngttactattagtatgctgggttaattggtggtgctaaaactattctgtatcccaactgcgatagatactacacaaatct

SEQ ID NO: 551420 - DNA, 253 bp, Homo sapiens
gcgtggctcagtgatcctccttcttcaccctcccccaccatgctcggtaatttttaaaattttagcagaaatgaggtcttgctgttttccaggctcgtctcaaactcccaatctcatgcaatcctctctgcctcagccttcccattagctgggattacaggcatgcgccaccaggcccagctaatttttgtgctgttagtagagacggggttccaccaatcttgggccaggctgggtccttgaaattccttga

SEQ ID NO: 551421 - DNA, 151 bp, Homo sapiens
ttcttaggatttccaggcaacgctctacagctctaaaatgctaccctcaagttacttggcatgaacatttcatagccctagaaggatgttggctcatttctgtgtcatcctggtttattctttattgtattattccgccagtcattttaac

SEQ ID NO: 551422 - DNA, 158 bp, Homo sapiens
cgggaggagggaagatgatggcagggaaagagcatcgtataggctaggggattgacacgtggactgattccgtgtaaataaaaataaattaacaggtagtagttccggtcagttctgttggaagcagcccactccctcacttttactccttcctccaa

SEQ ID NO: 551423 - DNA, 137 bp, Homo sapiens
gcctagaggatgcctctccctactcaacagtatttatatccatgtggttagttactcagttatgtgagaagaatcggagctaaaagcagagatgttggaggtgacggtaggaaggtgagtaggatacagtagggaga

SEQ ID NO: 551424 - DNA, 257 bp, Homo sapiens
agcccaggcttaataatagaatgtcatagattatttggccttataccaaaacatttattttttgatgttctgaagaatgggatgatgaacaacaaggtgtcagtagacattgtacataatcagtttgctacttcctgactagtaggtaactgccattgtacatggcctttcccgtttgaatatgcatgtaaagaaaaagcctcttgtcccttttcttcttacaattgcacatatcccattgtaaaaggcttgccctc

SEQ ID NO: 551425 - DNA, 258 bp, Homo sapiens
tctcttgagacagggtttcaccttgttgcccatgctggagtgcagtgtgtgtgatcatgacttactgcactcttaacctcccgggttcaagagatctcccacctcagcctcccaagtagctgaaactacaagcacgtgcctgtaatcttagcactttgggattataggtgtgcgccactgtgcccagccctgctatttccatgttttatttcagggagggcttgcattacaattggttgtcttctagaggcatgctgt

SEQ ID NO: 551426 - DNA, 297 bp, Homo sapiens
tccactagtgtacgctgagcaagaggtgttgaggttgatcggggtttatcgactacagaacaggctcctctagagacatatgaagctccgccaggtcctttgagtcttaagctgagactcgtagtgttctgacaagcagttttgttgatataactgttgaggatcaggtctaagcatagtgtgctatctaaacacagattggctcttagctattgcgcgttcgaatatgctaaagccactatcgtagtctatatcgtgcaacgtgagtttttacaactcaagcgagaccaagtttta

SEQ ID NO: 551427 - DNA, 156 bp, Homo sapiens
atcactgcctcaggctcctaaggtgctgggattgcagtgtgtgagccaccacgtctggccatactgcagcactttaaaggactggtgtctttttcttggacagctgagttctcatcaaacggtcggggctgtggatacacttggagagggctggac

SEQ ID NO: 551428 - DNA, 371 bp, Homo sapiens
atgtgtttctacaccaaagattccaatgacagacctgaatgctcagaatgtaaaaatatttgtgcaaaactgcattaattgttcttaccatctaataggggtaaatcttaagatctcaaccaccatggattattctatttctaaccattgaaaaaaaaaaacgtggcaccttgagagcagcaggaccaccaaatgttttgccaattccagctaaagaaagctgacactggaatatgccaaagttactctccacagtaggcatccctctgaaaagtctggacacatctgtagggcttcacactcaccacagtgtctatactcttgaatgcgcgggtcatatatgatatatttaagaatgtcttttcctcgtg

SEQ ID NO: 551429 - DNA, 1015 bp, Homo sapiens
aacttcatctataagaaacaccgtgggctgggcgcagtggctcacgcctgtaatcccagcactttgggaggctgaggcaggtggatcacctgaggtcgggagttcgaggccagcctgaccaacatggagaaaccccatctctactgaaaaaaaaaaaaaatacgaaaaagatttaccggtgtgtggtgcccgcctgtaattcccagccacttggggaggctgaggcgggagttatcgctggaccctgggaggtggaggttgcggtgagctgagatcatgccatgtgcactccagccggggcaacaagagtgaacctccttctcaaaaaaaaaaaaaaaagggcggggttgggggggcccccccttgttttccccagcctttggggagcccgaggcgggggaccccggggctcagggaagactcaacgaccccctccgtgcgtttacccgcggggtgaaccctctacttctcttatcacttatatttcccacaaaattttcgcgcccgggcggttgggtgcgcaggcggccgccttgttaaccccacgccatttggggacaggcttgggcgcgaggaaaatgggtattgaccctgggcagggtggggccttggcctgtggacgccggaatatgggccccattgtcctcccgaagcctggggtggccacgacggcgagaccccttctcaagaagaggggaggacagcgaacccccccgggaaatttagtggcgtgccagtgggcccccttcgcgttagagctttaaggctgtgtccccccttgaaaccccgggggacggtgtctggaattaggacccctccgggaattgggcaatgtggtttcccagttttcccttaacccccctttattttacccttttggccttccggcacagtgctggtcccctttggacaagagccccgggggactctcgcaagcataaggcctcacgcggaggacttggccacgggagcctttggcagagtaccacccgcatccctcgggatgtggtcaccc

SEQ ID NO: 551430 - DNA, 300 bp, Homo sapiens
ctaaggacgggactctggggtgtgtcgcccccaggagacgcggggctcgtaggcaggtgccgttggcgacgtcgctgggacgacatggcaccacctggtgaacgggactgtcggggcttgacgggacctggggacccccggggagcccggtgtgggagacccaggcaggggacgtacgctgggcttgaagccgctggcatctgacgcagcacttgggaacgacgacgccggatgccctgggggtcattccactcccaacactgggtgaccaggcgccatacggcaaggggtttgcaccct

SEQ ID NO: 551431 - DNA, 289 bp, Homo sapiens
ctacaggccccagtgagatgaacctggtatttcagttggaaatgcagaaatcacccgtcttttgcgtcgctcacgctgggagctgtagactggagctgttcctattcggccatcttccgctttaagttttttataatctttttgggaaggaaaggccatgtgaaaacatggcgagaagacagtcatttgcaacccaaggagagagacttcaccagacactgaccctgctggccccttgattttggacttccagtgttcagaactataagaaataaattcctgttatgta

SEQ ID NO: 551432 - DNA, 366 bp, Homo sapiens
caggaacatcagcctcgcagcactatctgggagacaccgaccggaggatcacctgaggacaagcgtttgagaccagcctggacaacatgctgaagccctatctctactaaaaatacaaaaactagcccggcttggaggagcttgccagtccctgaagttaaaacaataaactgagtttattggaaatgaaaactttttcctttgtttctggctaaataactggtttctagagcttgataccccagacactgactgaaattgagtgaatgagtatattggtcacaaatggtagtttgtgagtccttgagcctggtgtgtagcgactgatttgatgactgttctccagttccctgtcctgaaggtgtt

SEQ ID NO: 551433 - DNA, 118 bp, Homo sapiens
gatataatgctactccctaggtcaccacttgtctccttattctcaaatctttcttctgtttctcattctttcattctgtctctttcattcataatcatttcatacgtgctaggcgcga

SEQ ID NO: 551434 - DNA, 955 bp, Homo sapiens
cgtggcgcccgagtgctactgaagatgggggatgctgtaggagggttgctccagtggcgtgcggtatgcccgagcatgtgagtgccattccttggggcattgctggcactgcaggccctcagggcctgctgcatgtggaacgaagcgaactcgttgaccaagagtatgtatagtggtactctgggttcctagatgcgaggtgtcccatgatttatcaccagcaaacagtttccctcgatgcccatggtgatccatggcttgtcaggccagcaatgcgaccctaattgttaagggggtagcagccgtccgtccatatgggcggagtatcataggacctaagaccaatgtatgaactcttaaggggtaacagttattcggtgctttcgttctatgcctttgggatggtgcaccttttgtgtgtgctaccgcagaattgttcgtctctgtagtggacaaaagactgacggattgcatgatgtgaatctggttgaagatgtcgcagtgctcagagggatttgccaactttggggccatgctcgtgctggatcaaatgacatccaaggaaggaatggtggttatgggggccacatgacacatgggcgctctgtgtccaggacttcaactaagcaggtttcgcggagacaacggtgtgctcgtgagaaggtcctgggctgcactaagaggtctcttcataaatgacgcaaggagtcctcagcattgggcgtcaaggagctcccagtggggcgacgtggaagaaagctcgtcggggactggggctgctgtgcaccttggaagcgccaggaaggacacggattctagaaagaagtcactgtccgagcccagaaggaacaaatccgggttgccttcaggaagcccgggacgctcatccaggtgccgggaacgggcacagcaacaggggggaacagggcacaacagcaggggaacacaaaaacga

SEQ ID NO: 551435 - DNA, 106 bp, Homo sapiens
ttgtgtgttgatctagaggatcccagtgggaacaatcacttgaacaatcactgacaatcacttgaacaatcacttgaacaatcacttaatgtgattgttccctgtt

SEQ ID NO: 551436 - DNA, 153 bp, Homo sapiens
tgagtacgtcgtggagtcactggcgactacaccaccatgagaagactggggctcatttgcagggggagcaaaagggtcatcatctctgacactctgctgatgccccatgtccgaatgggtgtgacatgagaaggttgacacggctcaggtcat

SEQ ID NO: 551437 - DNA, 432 bp, Homo sapiens
cacacacacacagcagcacacacacacacacattttatttcctattcctgtgtgaaaatttttcctaacataactcacagaacaagttcattatggacttctttacccagctactgtctgtctccccaggcagagtcaacccacaaggttgattttgctcaccctggtgttcccaaggcctggtacaaagtagatcctcagaaaatatttgttaaatgaataattaaatgacttctcactgtaagcaattggcaccacttaggctagcactcaagcaccttctatcctcttgaccataccacaaagttaaccagttacacgatcagaacacctcttcttcatttgttccttcttatgatgttcagtagagagaggctcagaagagcactgcagggtgaggctggagctaggagtttggaacacaggtgcagg

SEQ ID NO: 551438 - DNA, 246 bp, Homo sapiens
tagaggatccctcagcagcatggaggttggtccatgaatagaacgggcaaacccttcccaggtctgtgaatcagccatgtctaaccccttctcgccaacccgaaacatgacgagtcccataggctgactttcctgcacctccatcttactctgcagtcactcctccccctgaggccttctcgagaggggtttcaagtccgatagctggcccagcacagccccctccagggccccagccggcccctt

SEQ ID NO: 551439 - DNA, 527 bp, Homo sapiens
  misc_feature (7)..(7): n is a, c, g, or t
  misc_feature (28)..(28): n is a, c, g, or t
  misc_feature (72)..(72): n is a, c, g, or t
  misc_feature (108)..(108): n is a, c, g, or t
  misc_feature (114)..(114): n is a, c, g, or t
  misc_feature (124)..(124): n is a, c, g, or t
  misc_feature (221)..(221): n is a, c, g, or t
  misc_feature (233)..(233): n is a, c, g, or t
  misc_feature (326)..(326): n is a, c, g, or t
  misc_feature (419)..(419): n is a, c, g, or t
  misc_feature (504)..(504): n is a, c, g, or t
agggttnaatgtgcccatgaaggtaagnagcccaattgattgcaagaaccctgcaattgccaccactggtgnaaattgtaagcatggaaattggaaaccctgctcccnacctgnaccctggccnacagggtacaaagtgcacacaggaatgcagcagctcgacttctgctggtacccccaacccccacccaaggcataaagcacccctgcgcgctggccanaggtgccagaanacgtgagtgagcacagatcctgctgccaccgccccaaagaagcactttgtctggcaccacccatcagagggttgtggctaatggaccaggaanaccttggaccctctgatgcagcaggttcccaatctcacggggccagataacaaagctggggtcctggtaccaactccccagacttagagtccnccaggagtgctgagctgagccgtggcccctaaaatcttccagaaatgaacccagtcaactgaacctaccttataccgcaatgaanacccccaagggcagcaaaaaaaa

SEQ ID NO: 551440 - DNA, 359 bp, Homo sapiens
ggatcgaccttttggcccagcaactccatttttaagggtttctcctagagaatatttacccaagttagctgggtgctgtggctcatacctgtaatcccagcactttgggaagccaaggagggcagatcacttgaagtcaggagttccagaccagcctggccaacatggtgaaactctgtctctactaaaaatacaaaaattagccaggtgtggtggcacatgcctgtaatcccagctactcaggaagctaaggtgcaagaaccaggagacagaggttgcagtgagccaagatcacgccactatactccagcctgggtgacagagcaagattctgtctcaataagacaaaaagtcgacgc

SEQ ID NO: 551441 - DNA, 121 bp, Homo sapiens
gtggaggttggcggcccgggagctcgaaggctagcaaaccgagcgatcatagtcgtacgaaacaaatttcttattgtggcaaatacgacgatgaggagtttgagtatctgccatagtaatg

SEQ ID NO: 551442 - DNA, 206 bp, Homo sapiens
ttttttttttattttattgggcttgacccaggattaaaaaactggaacggtgaaggtgaaagcagtcggttggagcgagcaccccccaaagttcaaaatggggccggggactttgattgcacattgttgtttttttaaaagtcatcccaaaaaggggaggggttgttaaaggaagtcccttgccatcctaaaagccaccccacttc

SEQ ID NO: 551443 - DNA, 737 bp, Homo sapiens
  misc_feature (303)..(303): n is a, c, g, or t
ggaacctgtctttacccagaggctagcatgagcaaatggaaccagtgtatcgtacgtgcgggcaggcgagccggggtgtcgtgggcgcgctttgcaagggaacgtgttctgcgctcagcagggaggggagcccaccgtagagagtcacagacgaattcagcctcaggaccccgagatggaaggatggggatcacagtcgatccggaagaacgatgagcagctcacgtggtggttttaaacaaagggagacctgtccagttgaagaacgtcatggaaaagacttaaagcagaacataaaggctngcaatagcagatgaagaagcaattcggcagccgatggaagaatcatatatcgaaaaccagtcgagcatccctcagatgaagaaatatgcaggtttaacagcgaagctcaagaatgaagaagccaaatgagagatgaagtgagatcaggactcggtcaagaagaatctcacaaaaagtgattagaaatagtagcctccttgctttgtgacaagcgaagatgacaacatgagtaagtgtaaactctttgtgaatttagtcatagttgtgaacagtgatatggaggtgtgcattagggatcacaatttgggtcctatttataaagatactaacaaggttcttaatagaaagtttcaggacataggagaaaaaaaatttaataagatagatctattcatacaagtacccgtctgagttaagatgcgaatctattgaaa

SEQ ID NO: 551444 - DNA, 906 bp, Homo sapiens
  misc_feature (426)..(426): n is a, c, g, or t
  misc_feature (430)..(430): n is a, c, g, or t
  misc_feature (447)..(449): n is a, c, g, or t
  misc_feature (469)..(469): n is a, c, g, or t
  misc_feature (527)..(527): n is a, c, g, or t
  misc_feature (535)..(535): n is a, c, g, or t
  misc_feature (543)..(544): n is a, c, g, or t
  misc_feature (550)..(550): n is a, c, g, or t
  misc_feature (566)..(566): n is a, c, g, or t
  misc_feature (569)..(569): n is a, c, g, or t
  misc_feature (575)..(575): n is a, c, g, or t
  misc_feature (615)..(615): n is a, c, g, or t
  misc_feature (631)..(631): n is a, c, g, or t
  misc_feature (633)..(634): n is a, c, g, or t
  misc_feature (654)..(654): n is a, c, g, or t
  misc_feature (667)..(667): n is a, c, g, or t
cccctagcaagcccctgcacgtcatcaagggtcacagtaaatcgatccagtgtctgacggtgcataaaaacggcggcaagtcctacatttactctgggagccacgacggacacattaattactgggattctagagacgggggagaacgactccttcgctgggaaaggccacacgaaccaggtgtccaggatgaccgtggatgagtcggggcagctcatcagctgcagcatggacgacaccgtgcggtacaccagtcctcatgctgcgggactactagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccngaanttgtggcagtgcacccnnngcggggacacggttggcaanttgggggtgtggacggcaacgtccgcctgtattccatcctgggcaccacgctgaaggntgagggcnagctcctnnaggccnagggccccgtgaccgnacngttggnccttactcccacgacggcgccttcctcgcggtgtgcgacnccagcaggtggtcacngnngttccgcgttgctgacggcntactcggagaacnatgtttttatggacaccatgcaaatcgtctgctggcctggtccccagacaatgaacactttgcctccggtggcatggacatgatggtgtatgtttggaccctgtagtgacccggaaaccagagtcaagatccaagatgcacaccggctgcaccatgtcagacagcctggcctggctggacgagcacacgctggtcacgacctcccatgatgcctctgtcaaggagtggacaatcactac

SEQ ID NO: 551445 - DNA, 966 bp, Homo sapiens
attacagcttccttatgtacgactgagtgggtcaaggtggtgcctaattatcctaatttgtatctttcagtgtttaagttagcaccgtagtgtttatatctactgtcaaatttccatcagggcccagctgcgattcgtgcgtatattgccctgtgcttaatgatgttgctcgtatgttgctcggctttgtaatgacgtactggtgtgacagtacgtggttcaatcatcttgaggatgtaatgtcttggggtagctctttccatcctcatacttgaatgtgttttgtactagttcatagtgtttggaacagtatatgcctatcactgagactgcatcagagctcttggctattgttgtatgtttcattgccagagaaggcttagtggttgttgactgtagtatgagtcagctttgctgtagcataagattcgattttcccatacttacttcacttgttatacatcactgattatttggcgttaaactggactcatttcaagcagtttgctgtttgttcggaatcgtgtatgagaaacctaatactgtaatttgatttgagccatgaataacacattttaatagttagcttgtattatagttagttaagctcgtttttgctggaatagaaaccttactaaagacctaggtaagctctagattaggcccagtctcaggtgtatgtttgtactctgtagtaactggattcactactcgtgataagaactagagtataacgttgcggaagatgatacttgatttatggcgtgtgtctgttgagggaagagggtcatgtagtcttagaaacttacaatcttttggttattgtgttcacagtcatagtattcaagcatcattcatagtttggtttggagaacttttctggtattacgtttatggcaaatgtataaaagaaacaagttattggttatatttttatatttgtaaagtacagtcttggttaaagtt

SEQ ID NO: 551446 - DNA, 439 bp, Homo sapiens
tcccccgcgcgcacagattgtacctaccttctacccgacctgccctgcctctcagttggtatcttcactagagaattaaagcacggaagatcacctaatgttctctaaatgtacacttggtagcccatagatcgcaaaagtatcacaaagctaatatgtatagtcaaagatccaacatgataactatggagacggcttacgcacttagacaaatctgaggtaggtgataactgtcctgaattcagctgaacacaaagatatgaccatctttaagaatcccagtggagtccataaacccaaagggcatatttaagattatacctgataagacaatataagggaaatgtgatgaacacgaacttaaacatctgcaattaacttacttaacgtggcaccttagttcaaaatgaacaaaacaagtcgactatttaacataatg

SEQ ID NO: 551447 - DNA, 1390 bp, Homo sapiens
  misc_feature (5)..(5): n is a, c, g, or t
  misc_feature (10)..(10): n is a, c, g, or t
  misc_feature (1112)..(1112): n is a, c, g, or t
  misc_feature (1137)..(1138): n is a, c, g, or t
  misc_feature (1166)..(1166): n is a, c, g, or t
gagcngctgngggtctttccctcactcgtcctccgcgcgtcgccgctcttcggttctgctctgtccgccgccatggcccaagctgacatcgcgctgatcggattggccgtcatgggccagaacttaattctgaacatgaatgaccacggctttgtggtctgtgcttttaataggactgtctccaaagttgacgatttcttggccaatgaggcaaagggaaccaaagtggtgggtgcccagtccctgaaagagatggtctccaagctgaagaagccccggcggatcatcctcctggtgaaggctgggcaagctgtggatgatttcatcgagaaattggtaccattgttggatactggtgacatcatcattgacggaggaaattctgaatatagggacaccacaagacggtgccgagacctcaaggccaagggaattttatttgtggggagcggagtcagtggtggagaggaaggggcccggtatggcccatcgctcatgccaggagggaacaaagaagcgtggcccacatcaagaccatcttccaaggcattgctgcaaaagtgggaactggagaaccctgctgtgactgggtgggagatgagggagcaggccacttcgtgaagatggtgcacaacgggatagagtatggggacatgcagctgatctgtgaggcataccacctgatgaaagacgtgctgggcatggcgcaggacgagatggcccaggcctttgaggattggaataagacagagctagactcattcctgattgaaatcacagccaatattctcaagttccaagataccgatggcaaacacctgctgccaaagatcagggacagcgcggggcagaagggcacagggaagtggaccggcaatctccgccctggaatacggcgtacccgtacacctcattggagaagctgtctttgctcggtgcttatcatcttctgagaggatgagagaattcaagctagcaagaaagctgagcggtccccagaagttccagttggatggtgataagaaatcattcctggaggacattcggaaggcactctacgcttccaagatcatctcttacgctcaaggctttatgctgctaaggcaggcagncaccgagtttggctggactctcaannatggtggcatcgccctgatgtggagagngggctgcatcattagaagtgtattcctaggaaagatacaggacgcatatgatcgaaagccggaacttcagagactcctactggacgacttctttaagtcagctgttgaacactgccaggactcctggcggcgaggcagtcagcactggggtccaggctggcattcccatgacctggtatcagcactggccctctccttctatgacgggtacagacctgagatgc

SEQ ID NO: 551448 - DNA, 1324 bp, Homo sapiens
  misc_feature (5)..(5): n is a, c, g, or t
  misc_feature (10)..(10): n is a, c, g, or t
  misc_feature (1046)..(1046): n is a, c, g, or t
  misc_feature (1071)..(1072): n is a, c, g, or t
  misc_feature (1100)..(1100): n is a, c, g, or t
gagcngctgngggtctttccctcactcgtcctccgcgcgtcgccgctcttcggttctgctctgtccgccgccatggcccaagctgacatcgcgctgatcggattggccgtcatgggccagaacttaattctgaacatgaatgaccacggctttgtggtctgtgcttttaataggactgtctccaaagttgacgatttcttggccaatgaggcaaagggaaccaaagtggtgggtgcccagtccctgaaagagatggtctccaagctgaagaagccccggcggatcatcctcctggtgaaggctgggcaagctgtggatgatttcatcgagaaattgagacggtgccgagacctcaaggccaagggaattttatttgtggggagcggagtcagtggtggagaggaaggggcccggtatggcccatcgctcatgccaggagggaacaaagaagcgtggcccacatcaagaccatcttccaaggcattgctgcaaaagtgggaactggagaaccctgctgtgactgggtgggagatgagggagcaggccacttcgtgaagatggtgcacaacgggatagagtatggggacatgcagctgatctgtgaggcataccacctgatgaaagacgtgctgggcatggcgcaggacgagatggcccaggcctttgaggattggaataagacagagctagactcattcctgattgaaatcacagccaatattctcaagttccaagataccgatggcaaacacctgctgccaaagatcagggacagcgcggggcagaagggcacagggaagtggaccggcaatctccgccctggaatacggcgtacccgtacacctcattggagaagctgtctttgctcggtgcttatcatcttctgagaggatgagagaattcaagctagcaagaaagctgagcggtccccagaagttccagttggatggtgataagaaatcattcctggaggacattcggaaggcactctacgcttccaagatcatctcttacgctcaaggctttatgctgctaaggcaggcagncaccgagtttggctggactctcaannatggtggcatcgccctgatgtggagagngggctgcatcattagaagtgtattcctaggaaagatacaggacgcatatgatcgaaagccggaacttcagagactcctactggacgacttctttaagtcagctgttgaacactgccaggactcctggcggcgaggcagtcagcactggggtccaggctggcattcccatgacctggtatcagcactggccctctccttctatgacgggtacagacctgagatgc

SEQ ID NO: 551449 - DNA, 263 bp, Homo sapiens
acgacgacgtcgttccgccggtctcacaaggctgatggatcctgaagaaaacaagctcagattgccctgcgttcggtggctgcccttgggatagtaaggtcacaggattcattttacttataatgttctcctgatcccacatcagaggactttggttttggctaaaagtaaactgcaatcaaccaccacgacgacgacgtcgtcgtcgtcgtggtttaccccggcgacaacagatgtggttaatgaaaccttgacagagaatg

SEQ ID NO: 551450 - DNA, 347 bp, Homo sapiens
acagtatccccgtcactgtccagctccttccacagatggatcttccatcacttggtctgtgaacactcgaccttccaacctctggtaccacttggtgatctcctcatcattcgggctgttactgagtccatagcacagcaccttaagccacttggggatgaactgcttctcaagacgtcccatcaggcttgagacagacatcatcccctctccctgtctactcaccccttagcaactgcatccctgtgctgctcgtggtggttaatggctcgctcaccaagacccatcccgcgcttgcggcactatcttaccgaccattaatgcttccctcgatgctcacaggtctc

SEQ ID NO: 551451 - DNA, 973 bp, Homo sapiens
ccgcttaaccccttccccccgatacctccttccaagtgtgctttcaaccccaattccctgcctaccaactgcggtacaaccacacgcacctgtactaccgccgtcgttcataaatccttcttgctacacagtactctacataccgaccacgctttaattgttctcacttcaccgctaacaacgctttgcccgccaaccttgtaccttccctcttcccacgtcacacggtttttctactccgttcacgaaaccgccactttccctgctaatgtgttcctcacaggggaatatagtataacacgcacctgcaatcccatccttacgaggacacgtgcatcttgggttgctccttttgcactctctctttttcttttccgcctcgtttcgcttgaccatttcgttatcctgggaaacgtttactccacacttgtataagccaaaacctatagggacaaattgcgtcacataccttgcaactactgttaaacagaccaagattccattcacagctctatcgcctgacttgtcagatacaattacttaccctgggacattatctaacgtaaagccgtatatacgtatcagaacctattatacagtaaattgtactatggtagccaagttataaatggtaaacagtttagaaaatcagaatgatttacttcatgtccacatcatgaataaacaattaccatgtatcaaatgggtgagcgcaattaatatctagtatagtatctacataaaagaactagacagtaaatgtagacgggcatatatgagctaagaagacatttttagagcataaaatatgaagagatggaattgaacagaaaatactatatatcatgtacaaacttgtgtgttacaaaatactacaaaacaacaatacaaatagtaaatttctgaaaggtgtatggaagattaaagttaatattagtttaaaaacacttagttcaaagtcttaaagacacta

SEQ ID NO: 551452 - DNA, 2085 bp, Homo sapiens
  misc_feature (1906)..(1906): n is a, c, g, or t
  misc_feature (2085)..(2085): n is a, c, g, or t
acctggtagtgtgtggtcgtttcgttcgcatgttcggatgcttggtctggctgttgtggtgtttgtaggagtgcggttgttacttgagtgtctctgcagctgtggggctggcttgtgttgtcgttccgctcggagtgtcgttccggctgccgtgattgttgtgtggctgctgtctcctccacctgtggtgctgtgcgtgcgtgggcggcgacggcctgacgttgtgtggtggtctcgtctcctcgtgtgtgcggtgtaacacgctggtttctgctgcgatccgtgcgagtcgcctgatgcgtgtgtgcctcagcgtgggcgaggttgggccgcatcggtgttgtgcgtgtctgtgggtgtggatgacgtggtggtggccacctggtgggttggaatcgccgggggtttgcctgtcggttgttgtgcgcgcgggggtcgttcgtccgtcggcgcgtgtgggtctgaccccagtcgcggtgttgtctgctctcggctgttgtttgtgtttgcttcgactgatggttgtgctgctggcagtctctcgtgggtgtgtggtttgtgctgctcggggggggcgcagcacacaatatagttggtgggcgtcttggtgtgtcacaatgtgtgttgatgtgttctggctggtctttgggtggaggttgggtgtgcagtggggtggcgcccctcatgggaggtgtgtgatgttccccccggggtgtcgccaccctcacgtgggtgtcccacgctggtggtgtcggtggtccgcccctcccgctggttaggttgttgtgcgccccacgttgtggcgcgtgtcgtctgcgggtttgagtagcgtggtgtggcgtctcccacagggctgggctccatgcggtatggtggtggagtttcgtgtggtggtgcctggccgtgtcgtgttggcggtgacgacgcgctcgccgtggttgtgtggtgggtgtctggtccgaccgtgggttgtaggtgggtgtggctactccatgcagtccttcgtctgggtatgtgtgtgtggggtgtggtgtcagctggggctgcctctgttgttgcggtactggcgtcgctcgcgtgggtgcgtccccccagtagcgccgcaaagaggtgctgagtactgtgggcagttgttgggagaagggagggatcagttgtggtcagcaggtgtgactccccctgcatgtaggagggtggaggtggttcttctccgccgtctgagttccccacgttgtgttggtgatgttggataggaaggttgtggctaacagctgttggtggtgttccgacacgagttttgacgctcccacggagtgtgttgagcagcgagcgacaccaggatggccggcagtggttggctcctctaggggctctcttgctcccgcacccgcccggacgtggcccccccgcgtgggtgagggcctgtcgtgtggcgggcatatagatgggatacccgtcggcgcgggcccctgtgtgagtcttctcatgtcgtgttctcagagtgtccgctgtgtggtcacagtgtccccgtctgcgtgcactgtgttgtcttgtctcctgcgcgcgtgtgtggtagatgtttggtgcgtcccgtttgtggcccacgtcacgcggaaccacacgtgtgaacacacgagccacacagtgtgttaagcctatgtgaggctggaggccacgtcacgccacgcgtgatgttgagcgaccacgttgggtgtcacgtcccttaagagaatgtgtggcacagtgtaagtgagtggggcacagagtgtctcgctgttctgtctgtgtgttgttgaagatcgtgtgtctcccccccgtgtctcgcgtgcgaacacatggtaaccccacccgaagatgccacacgtgtgtgtgtgggtgccgcttctgtggtcccatatcacggtgncttgtgtctcgtcgtgagggagaccgactgggcgcaccagatattcccccctgttttgccgaccttgtccccttcaccccagatattttgggattagttaaggaaaataagcctacactgaaatagattaatatatactcgagcattaactcgggcggattagaggagggcccctccgn

SEQ ID NO: 551453 - DNA, 800 bp, Homo sapiens
attcagaatattaagaaaatgaagtaactgattttctaaaaaaaaaaaaaaaaaaaattttctactttataactccacaggctttggtcccattggcagggtttcggcacacttgtttgggggtgtcagcaggcacggtagaccttttttttcaggtaacccatctatttgctgtcgacctcttcagagatggcgataataaggggctgggcctggaggtcgcgggctatctgtgacgattggtgcccggtgtccccttctccttttttttttcttcacatctacctttgaaagaaaggttttttccccccccctttccggtagaaaccaccacctctttttggagccttccgtgctatacaacaggggagacccccccaatttgttgcttcgtgcgcgggtacacaccagagtgtgtggggggaatataaagggactacaaataagacactttatttctctctaccacaagttcaaccaaagagcggggggggaggggggaaaacaacacgagtgcgcgtgggtggagaaccaaacagtgttgtctacagagagcgcgttcttccccttctataaacagacaacgtgtgggttatctcactttcgcacctattaccacttgtgagacaccccagcggggatctggacaaaaacttattcacaggcgggtaaatgaaggacaactcttatttttctcacgcccaagattttttttataagagaagtgtcgtacagccacatagtgttgttcgaacagcactaaaaaatgtggcgcgtatataaattaaggtggcgggaaa

SEQ ID NO: 551454 - DNA, 603 bp, Homo sapiens
  misc_feature (315)..(315): n is a, c, g, or t
  misc_feature (336)..(336): n is a, c, g, or t
  misc_feature (338)..(338): n is a, c, g, or t
  misc_feature (384)..(384): n is a, c, g, or t
  misc_feature (393)..(393): n is a, c, g, or t
  misc_feature (395)..(395): n is a, c, g, or t
  misc_feature (415)..(415): n is a, c, g, or t
  misc_feature (446)..(446): n is a, c, g, or t
  misc_feature (493)..(493): n is a, c, g, or t
  misc_feature (498)..(498): n is a, c, g, or t
  misc_feature (507)..(507): n is a, c, g, or t
  misc_feature (523)..(523): n is a, c, g, or t
  misc_feature (542)..(542): n is a, c, g, or t
  misc_feature (573)..(573): n is a, c, g, or t
  misc_feature (575)..(575): n is a, c, g, or t
  misc_feature (600)..(600): n is a, c, g, or t
aatcctaccctgtgggagttgcaatacagttgtagtggaatgctttcttgtacaaacataagttttacttttcccttctcctggactctccagtcaactgacggttgggttacttctttccaaatagtacctggtagtgccccaaagccagaggtggatgccatcctttcttgagtgtcaactgacacattggcctgggaaaagattctaaactacaactaattaactagaggagagatgtccttcttagacttggaatcaacagctggttactagtaaaagaataacagtagtcattggtaacctgacaatcgnatttcacaaaaacaattctgngnaaaaaagaagcctggcacagtggttatgcccgtaatccagcacttngggaggccnangagggcggatcacctgaggncaggagttcgagaccaggctgccaacatggngaaaccccgctgtctaaaaatccaaaattacccggcatgggtaatgncccgntaattacangcgggtgcctgtaatnccagttctcgggaactgangcaggcgaatcgcttggcctgggaagtggangntgcaatgagccaaaacacgctttgnact

SEQ ID NO: 551455 - DNA, 305 bp, Homo sapiens
ttatatgcaaggcaagtagccccaggtgacactcgtttttttgtttgtttgtttttgagacggagtcatgctctgttgcccagcctgaagtccaatgccgtcgtctcggctcactgcaacctctgcctcctgggttcaagtgattctcctgcctcagcctccagaggagctgggactacaggtatgtgccaccacacctggctaatgttcttatttttagcagagacgggatttcactatgttggcccggctggtctcgaactccagacctcatgatctgcctgccttggccttgccatatgcaa

SEQ ID NO: 551456 - DNA, 529 bp, Homo sapiens
ggtgaagcagaaccagctatcttacaggagaaacagcaagaaacagcaagctgcagggctgcgttgcatcgtgcggctctcagcactggctgaatactaacattgtctacgaagttaaaaacatcaacaacaacaaaaaacccgctctgcccaaacccatccactgggatggatgcagcttgtgggggtggggccagtcttctgaatttttaaaaacttgcctcggtgattgtctttgctcaggatgctgtaacaaatcatcacaggctgcggggctgaaaccacggggatctagtcctcactgttctggaggctggaatctgccatcagcgtccgaggacggggcggggagggccctcttcctggctgtgggtgacgccttcactctgtgcactcccaggggtctcccttggcctctttggtgagggcactgatcccatcggggggaccccagcctcctgccctaactggcccccgaagggcattcaccctcccccgaaggccactcctcacttaccctgcccgaagg

SEQ ID NO: 551457 - DNA, 366 bp, Homo sapiens
  misc_feature (12)..(12): n is a, c, g, or t
  misc_feature (327)..(327): n is a, c, g, or t
  misc_feature (334)..(334): n is a, c, g, or t
ggtttcaccatnttggccaggctggtctcaaactcctgacctcaagtgagctgcccacctcggcctcccaaagtgctgggattaaaggcgtgacactcacaccggcctggttggttatcttgtaaaggtggctaggctgtttccaccagatgcctgtagactcaatatcagtttcaacttgtgcagcatgataatagattgcagcttaggcgtttcttaaaggccttacattttctgtttcatggcatttaaaagacactatgaattaatgttctggttaatttttgtccaggcagcaggtataattgtgatggggcccacatctanccataangagacggcagcttcctacagctctgctcccag

SEQ ID NO: 551458 - DNA, 304 bp, Homo sapiens
ggtgaatctagaaggatcccccagaggacaagggagggggacacaggcagtaccaggggcacagcagcccaccagccccttgcggcctgtaccttgtatctccctttcgccagggcctggtgcttgaacctgaggcactgcagacccccacactcatgacacactgggatcctgtaacccaaaccctatagctaaacaagtgtaatccaatcaataatcaatcttatggtttggtaaacaaatgagagtttctgacaaacaacttggtatcagcccaccctctttccctcctgggtgcctctgg

SEQ ID NO: 551459 - DNA, 449 bp, Homo sapiens
cgtctctcaagaataccccaaaaattaagtttttctttttccaaggtgcccacgccacccctatgtcacgcctgaagtagttattgagaaagtcgtccctttccccttttctataaccaaatagacaggaatggaagattctcctcggggcctgaaagcttgcgggatgaataactcctcctcctcaggcccagtcccaaggtacaaacttgcaccagcagcaagatagcagaggcaggaagagagctggctggaagacacgtaccccctgaagatcaagagggaggtcgccctggtactacatagcagtcacgttaggctgggacaattcctgtttacagaggactataaaacccctgccccatcctcacttggggctgatgccattttaggcctcagcctgtctgcatgcaggcgctcattaaaacagcatgttgctccaaaaaaaa

SEQ ID NO: 551460 - DNA, 120 bp, Homo sapiens
taacttctccacgaagctcttctctgaatgctaaagagacaccagcactcctcgtccagcagggccagaatgcccggggggcctgctggcttctcaatgaggtccgatgcggggctgcag

SEQ ID NO: 551461 - DNA, 389 bp, Homo sapiens
gcttcactaccacgctcaccatgcagttcttgtacgaatagtcattactagattaagatctagtgtgttagttaatagtatgaagtgcctgttttgggataatagataggtgatttagattaatttagggggaaaaaagttatcttggccggaaatgttgagggccccatctcttcccccacaaccccacagaagttactgggttaccgtgttttatcctgaaagtttccaattccactagtcgttgtgtgttcacgtgtgagaataactttggctttttcctttggaggtgccaatttcttactagtactatttctttaatgttacatgtttaccctggaatgtttttttaactcatttattgtatatgtgtgtgactgtgaacattc

SEQ ID NO: 551462 - DNA, 109 bp, Homo sapiens
ttagattcaccatttacttattatagccagtgatgccttcacttttcctggggcagcgatcaagttcagtacctcattctccaagaaatccttccccccaaggtctctg

SEQ ID NO: 551463 - DNA, 192 bp, Homo sapiens
cctgactgacacgatggacaacccgtctctactagctcatacaaaattagccgggtgtggtggcgcatgcctgtacatcccagctttccgggaggttgaggcaggagaggtgcttgaacagcaggcagaggtgcggtgagccgatatcacaccattgcactctagcctgggcaacgagcaacactccgtctc

SEQ ID NO: 551464 - DNA, 346 bp, Homo sapiens
gggtgatactagggtggggggatgacttgaggtaaggagtttgaaagcagccgggtcaatcatggtaagatcccatctctactaaaaatatgaaaattagccgggcatggtggtgggtgcctgtaatcccagctactgaggaagctgaggcaagagaatcacttgaacccgggaggtggaggttgcagtgagccgagattgcaccactgcactccagcctgggtgacagagtgagactcgacctcaaaaaaaaaacaataaaatattaagtaaaatatatgatggaaattaatttaatctgcttttctgcattgggagagaccaggccagtggttgggcagaagat

SEQ ID NO: 551465 - DNA, 109 bp, Homo sapiens
acatactaaccaacaaaataaacatataccaatgatggcacgatgtaacacagagaaagcacataccaaggccaccacacaacaacagatcaatgggccatcgagacgg

SEQ ID NO: 551466 - DNA, 313 bp, Homo sapiens
tcatatactagcagtgcggaggtatggttaagagatttaggcgcgtcagtggttgtcgcttacctagtacttgggaggctagaggtgggaggatcgcggagccaggagttcaagaccagtttaggcaacatagtggaacctgtgtctacaaaaaataaaaaaatttagctgggcattttggcatatgcctatagtcccagctacttgggaggctgaggagggaggatcacttgagcccaggaggtcaagtttgcagtgaactacgattgcaccattgcattccagtctgggcgacaaagtgagatcctgtctc

SEQ ID NO: 551467 - DNA, 1131 bp, Homo sapiens
gggggccccggcagccgggcaggccggcctgacctcgacctcctgcctgtgctgggccctgaccggtgatgtccatgccctggtcagtcgcaggaccctggccgccagcctctccctccacctctccctgcccccagctgccatggctgcgggctgcgctcggtggctgtgcggctggggccctcaggcggccatggcggcaggcgccggggccgggtccgcgccgcgctggctgagggcgctgagcgatgccgctgagcgcggcgcaagctgcgcgcgacttggaggagcacctgctaacagcgcggcgggcgtctcgcttggtcgagcccgccgctgcgagctctacctggacctggctggatccagtggatcccagctctggatggcccccaattccatcaccctgctggggctcgccgtcaaacgtggtcaccacgctcgtgctcaatctcctactgtcccacgggccacccgaagaggcaaccatactgggacatgaccttccactgtgcacctgggaactgcgctcgactttcaacccaggtcacctggattgctactcgactggggacaaccaacagccccagcaaggaaacaaagctcttggtacgcagctatcagtgggaacgctcatttgacccactggggtgtggactcatctttcccagccaggcacattactctggggacagctgaggaaagcattccaaattggcccgcctcgcctgtaaggcaacaccttactaccctgcacatggatgacacgccacccgtgcactctttccattacggggcaatggtcaggacgatacaaactatgcgagctacatctgggcagagaaccttaaaagggagtcagaccaggggccactgcatcgcacgcactacgggacacaaccgctggccactcgctcgcacgggaaacaatacacacaacagcagctgtgacgcaggcaaccaggcacaacggcgagataggagcgcaggcacgtcggggacgggcaccacacccaatgctgggcgcaccacacacggagagatcccatacattcgccaagcaagactaaacagggggcagcgagcccctccacgacacatcggcccacaccagacgcggacgccacgcca

SEQ ID NO: 551468 - DNA, 525 bp, Homo sapiens
gttgattgtcggcagcggagatgaataagtgccttgatatgaggtagagctcaggtttcagccgtacgtgttctggtctccgacttagcctcctggccccctaacatacgtggaggcagtcccacgtagagtgagggtgtgcccgagctgctggagagtaggacatccctcaccgatactctatgtctcacatcgtgttcctgggttatgtgcggtttgagagagtgccaggaggtcttgtggtggggaggagtgttccttattctctgcggactcaccctaatccacaggaagctcccacccacctggaagccccttccacacaagcagcagtagcaccacttggctagacggaccagctggaaagatcatgatggtggcccagccttgggatgtcatgtgggactgtgtcctagggcgatccagttgtgcagccttctgaccatcagccaagggaagcaggcctctgatggagcaggctctggctctgtaaggagaggtgcagctgcagcagtgttctaccgg

SEQ ID NO: 551469 - DNA, 191 bp, Homo sapiens
  misc_feature (68)..(68): n is a, c, g, or t
  misc_feature (172)..(172): n is a, c, g, or t
  misc_feature (187)..(187): n is a, c, g, or t
ctttactaagagatgctccgaggcatttgtcagggagccctccaagcacagtgtgggcgagcttcagnatatgatggctgagtgctccaaataccatggccagctgaccaaagaagcagcgatgggccagggctttgaccgacacttgtttgctcctacggtatctggcagnaggcagaagggggtnaacc

SEQ ID NO: 551470 - DNA, 234 bp, Homo sapiens
atgactcctccgctggtccgcgcggtgcgcgcgccgtggggtgcctcgggttgcgcgtcgcggccgggcggtgcgtcgattgggcccgtgttcgtacgcgtcgccggtgggcgtcgcgcgcgagagcgagccggggggtgtctgcgcgcgtgatcacggcgtgatccggactggtggcggttcgctgggggctcctctacgaggtcaccctgcgggcttgagggcttggacctg

SEQ ID NO: 551471 - DNA, 98 bp, Homo sapiens
aattcaagcttctaacgatgtacggggacatggatatcaagtctgctttggacatcctctgctaagtgttacagatggaaataaaaccattaatttga

SEQ ID NO: 551472 - DNA, 321 bp, Homo sapiens
agaaataccgtgtaagacccaatgcctcacgctgcaagggttcccctgatccctctctcccttcctgagacagtcatatctatctgagaatacattgagcttcacgtatggacacagaggcaaggtatcagacggtgacaacgggggcagaaggagacagcctatccggggacccgcgagcagtcgagcggcagggctgctaactaggaagcggcgggggccagacacagtggctcacacctgttaatcccagtgccttgggaggccaaggcaggaggatcatttgaggccaggagcctgataccagcctgggcaacatag

SEQ ID NO: 551473 - DNA, 278 bp, Homo sapiens
gctaaactccacctcccagttcaaacaattctcctgcctcagcctcctgagtagctgggactacaggtgtgcgccaccacacccagctaatttttgtatttttagcagagacaggctttcaccatgttggccaggctgttctcgaactcctgacctcaagtgatccacccacctcggtctcccaaagtgctgggattacaggtgtgggccagcactcctggcaaggctgtttttttgttccgttctgttttccttttttttgagaccgtgtctcactc

SEQ ID NO: 551474 - DNA, 100 bp, Homo sapiens
ttctcttggtactcttaatgtgtatttctaattattccatgagctcttaattgtgcattttcctctcaattgccttcattggtttcaatatcgtctcaga

SEQ ID NO: 551475 - DNA, 163 bp, Homo sapiens
ctgatgatcatttgactcatagaagtcattatagtctgacattagatctgggtgttagaagcagagcagatgtttgccagatgtcattctgatgtgtcagtgactgatacagcctcatcagatgtatcagtatctagatgttagcaggcattttactcataca

SEQ ID NO: 551476 - DNA, 380 bp, Homo sapiens
  misc_feature (24)..(24): n is a, c, g, or t
  misc_feature (173)..(173): n is a, c, g, or t
gcccaagttcagggtgatcaccangatcaaaaccattggtaggacgtatatggtgggttcagagagtcacccccgatgtcaacaccattggatttgacaggtccaacaagggaaggacaagtccgcgagagagacgctggtcagacacctggctgacctggccgactatcgtnctggccatagaaggatgcgctcaccaacatcacaaaccagtccttcattcgcttcatgatgtgcataggcatgaacaaaggaggggttctggttggggtcatcggagcccggaaaccacactacgacatctgggggtaatacagtcaatgtagccagcaaggatggagtccacggggggtcatgcgcaacatacatgtgcgtagaag

SEQ ID NO: 551477 - DNA, 532 bp, Homo sapiens
gactaaggctgtatgtaaactgatgtagaggcatgtagatagaagcattgagaacaagatctctctatacaaagaactagtagtataaaatacaatagagaaggtagtcattacaacttacataattaacaacaggaaaatgggcacaagcacttcataataggaaatgcaactggccaagaaacatgaaaagatgttcctcctcattcaatcatcaaagcaacagcaaagcaacattttgcctacccagcattggccaacacatttttcatggcatcagggttggcagcactcataggcaacacaggccatcttactaatgcatggagttgtaatagatgaaatcatatatctggtcgtagtattcaaaactgcacactgtgcaccacctgatccaataaattactcgttcttacatcctacagaaatacccacaacaagtagcaaaatacctgtacaggaatgttaattacacttctatctataatgaacctaattatcaatccataggggattacataaattacagaat

SEQ ID NO: 551478 - DNA, 431 bp, Homo sapiens
ggatgttatcatcagtgtgccacgggtagtacatacaagtgatgtgatgccgtcatgaggccaagttagagcggatcgatacctcgacagtgtagccgctgacacacagcatacatacatcagtcgtgtccaggacgttgactatagcaactagtggcacatggtggtgcgggctgagcatcctgaccttggtagaggtctgtggtactgcggtacggaggtctggctcatgctgatctgacatgctcgatttaagtcattatcagaagcgtacactggctagtccgggttaatgacagtatcattataagcattaatgtcagcgtcacgatgaaagttgcattggggcaggtacagcgttgcaagtgatatagtgcttctcggtctctgattgctctaatcaatgctgctaatgcagtacagccgttgcg

SEQ ID NO: 551479 - DNA, 1327 bp, Homo sapiens
  misc_feature (20)..(20): n is a, c, g, or t
  misc_feature (50)..(50): n is a, c, g, or t
  misc_feature (182)..(182): n is a, c, g, or t
  misc_feature (185)..(185): n is a, c, g, or t
  misc_feature (411)..(411): n is a, c, g, or t
  misc_feature (429)..(429): n is a, c, g, or t
  misc_feature (443)..(443): n is a, c, g, or t
  misc_feature (915)..(915): n is a, c, g, or t
  misc_feature (943)..(943): n is a, c, g, or t
gattctcctgcctccacctncctagtagctgggattacaggcatgcgcanacagcccaagctaatgttgtatttctagtagagacgggggtttctccctgtcggtcaggctggtcttcaactcctgacctcaggtgatccacccgccttggcctcccaaagtgctgggattacaggcgtganganccgcgcccggaccatgctgtatccttatctgttgtctgttgttgtttgtttgtttttgagcccagaaataacttctcacctatatgttccaatgatttttcacatgagtgctaagaaagctcattggtggaaaagcagccttttcaagaaatggtgttggagaaacttgatttccacatgcagaagaatgaaggtggaccctatgtcacaccaggtgcaaaaattnacacaaactggatcaaanacctcaccccaagngctaaaagtatcatacgcctaaaagaaaacattggccacgctttcatgacatcagattgggcaatgttctctgggatatgacaccaaaagcataggcaacaaaagaaaattagattccttggattacatctaaatgacagacacttttgtgcagcaaaaaacactgtgaactgagtgaaaagataacccatggattaggaacaatatttgcaaagcatatatctgaaaagaggctgatatccatcatatataaagaacagctacaactaaacaacaagaaacccaaagcatcccatcaacaatggtcagaagacttgagtagacgtgttcctaaagaagatatagcaatggccaataagcatctaaaatgatgttcaaagtcactcatcatagggaagcacaaatcaaaccaagaatgtcataccacacattaggatggatatgataaacaaaaaagcattggtgagactanagggaagtaggaatgctcgaatatgatnggagggaatgtaaaaccatgaaggaacggggaaaatagtatggcatctactggaaaatttagaaacagaatgatcagatgttcccgcagtttcatttgtgggtacctaccaaaaagaattagaagccaggagtggaagacagatttgtgtacacccatattcatagcagcattagtcacaacagccaaaatgtggaagcaacccaagggttcgtggacagatgaatgaaaaagcacactagagttcctttatacaatggaagactattcagccttaaaaaggcaggcacttctggccagtgcggtggctcacgcctgtaattgcggcgtcttggaagaccgaggtgggcggatcacctgaggtcaggaattcaagaccagcctg

SEQ ID NO: 551480 - DNA, 1269 bp, Homo sapiens
  misc_feature (20)..(20): n is a, c, g, or t
  misc_feature (50)..(50): n is a, c, g, or t
  misc_feature (182)..(182): n is a, c, g, or t
  misc_feature (185)..(185): n is a, c, g, or t
  misc_feature (411)..(411): n is a, c, g, or t
  misc_feature (429)..(429): n is a, c, g, or t
  misc_feature (443)..(443): n is a, c, g, or t
  misc_feature (915)..(915): n is a, c, g, or t
  misc_feature (943)..(943): n is a, c, g, or t
gattctcctgcctccacctncctagtagctgggattacaggcatgcgcanacagcccaagctaatgttgtatttctagtagagacgggggtttctccctgtcggtcaggctggtcttcaactcctgacctcaggtgatccacccgccttggcctcccaaagtgctgggattacaggcgtganganccgcgcccggaccatgctgtatccttatctgttgtctgttgttgtttgtttgtttttgagcccagaaataacttctcacctatatgttccaatgatttttcacatgagtgctaagaaagctcattggtggaaaagcagccttttcaagaaatggtgttggagaaacttgatttccacatgcagaagaatgaaggtggaccctatgtcacaccaggtgcaaaaattnacacaaactggatcaaanacctcaccccaagngctaaaagtatcatacgcctaaaagaaaacattggccacgctttcatgacatcagattgggcaatgttctctgggatatgacaccaaaagcataggcaacaaaagaaaattagattccttggattacatctaaatgacagacacttttgtgcagcaaaaaacactgtgaactgagtgaaaagataacccatggattaggaacaatatttgcaaagcatatatctgaaaagaggctgatatccatcatatataaagaacagctacaactaaacaacaagaaacccaaagcatcccatcaacaatggtcagaagacttgagtagacgtgttcctaaagaagatatagcaatggccaataagcatctaaaatgatgttcaaagtcactcatcatagggaagcacaaatcaaaccaagaatgtcataccacacattaggatggatatgataaacaaaaaagcattggtgagactanagggaagtaggaatgctcgaatatgatnggagggaatgtaaaaccatgaaggaacggggaaaatagtatggcatctactggaaaatttagaaacagaatgatcagatgttcccgcagtttcatttgtgggtacctaccaaaaagaattagaagccaggagtggaagacagatttgtgtacacccatattcatagcagcattagtcacaacagccaaaatgtggaagcaacccaagggttcgtggacagatgaatgaaaaagcacctcgggctcccagagtcctgggattacaggctggagggcagttgtgcgatcttgattcacttcaacctctgctctccgggctcaagccat

SEQ ID NO: 551481 - DNA, 165 bp, Homo sapiens
ggcacagggagaagggataaccctaaacccagaacccaggctggacatgcggacggtcctctcccctccagcctttgggctgggcttttctagcctatttacgtggagggtgagcactctcttccctttcccagaatcctccgcaaagaagagccatgttttcac

SEQ ID NO: 551482 - DNA, 382 bp, Homo sapiens
gttactcttgggcaggacgggcagtgctggaagtcttcttcagtcccctcatcttctcgcctccttgggaggggtctgatgagcagagccggtcaagtgagacagcattgaatggggcctggtgccggttgggtccagaagccctttggggagaggctggtccttgctgtaatagcgacccggtgacgctggcgcaactcggaaagaagctgcctcatgctgatggtcatctgtgtagctcaggcgccacagaaatatgcagctgtccccagacaacagagatgagatgtttaccaatcattactaaatttcatgccagtgacaatctctgagtggacaaaaatggtggacaagcaatcgcctgaggagaagtcaaaatgga

SEQ ID NO: 551483 - DNA, 138 bp, Homo sapiens
  misc_feature (15)..(15): n is a, c, g, or t
aaacccagactcggncacagtagaaatatgacagaatatctaaccacagtattcatcccactaaatcccattcttcatgtctctgagttgtagcattcaagtgcagagactgaatctcttttatcatagcagagcaaa

SEQ ID NO: 551484 - DNA, 454 bp, Homo sapiens
acacacagtgagagggagggctctggggcggaaaagcatccttagggtcttcttggaatgaaattcctccttccccccatctctgagtggaggaagcccaccaattctgccctttgcaggtgtgagggtggaaggtaagaggttggtgtggagttggggctgccatagtgtctgcagcctgctgcggctacagcggtggaggaagactctgtcactccaggcatatgtttccccatctctgtctggggctacagacatagggtggcagaagtgtcaccctgtgggtttctccctcggggcctcttcccctagacctccccctcacttacataaagctcccttgaagcaagaaagaggtcccagggctgcaaaattggaagcacagcctcgggaatggggagggaaagacggtgctatatccggttcctgctctctgctcatgtgggagcaaggg

SEQ ID NO: 551485 - DNA, 194 bp, Homo sapiens
cagttctaagtcttattttggttctgggcacatttcagttctgctccaagtccgctttgctcccattcagcgatgacagacatatatttgaactcatttggtctgaggttaaaggtctccactaacccgtagtctctttccgatcgtagcgtagaagactgacttggttgcatcctgggactcctctagtcgcc

SEQ ID NO: 551486 - DNA, 1102 bp, Homo sapiens
  misc_feature (20)..(20): n is a, c, g, or t
  misc_feature (50)..(50): n is a, c, g, or t
  misc_feature (182)..(182): n is a, c, g, or t
  misc_feature (185)..(185): n is a, c, g, or t
  misc_feature (411)..(411): n is a, c, g, or t
  misc_feature (429)..(429): n is a, c, g, or t
  misc_feature (443)..(443): n is a, c, g, or t
  misc_feature (1102)..(1102): n is a, c, g, or t
gattctcctgcctccacctncctagtagctgggattacaggcatgcgcanacagcccaagctaatgttgtatttctagtagagacgggggtttctccctgtcggtcaggctggtcttcaactcctgacctcaggtgatccacccgccttggcctcccaaagtgctgggattacaggcgtganganccgcgcccggaccatgctgtatccttatctgttgtctgttgttgtttgtttgtttttgagcccagaaataacttctcacctatatgttccaatgatttttcacatgagtgctaagaaagctcattggtggaaaagcagccttttcaagaaatggtgttggagaaacttgatttccacatgcagaagaatgaaggtggaccctatgtcacaccaggtgcaaaaattnacacaaactggatcaaanacctcaccccaagngctaaaagtatcatacgcctaaaagaaaacattggccacgctttcatgacatcagattgggcaatgttctctgggatatgacaccaaaagcataggcaacaaaagaaaattagattccttggattacatctaaatgacagacacttttgtgcagcaaaaaacactgtgaactgagtgaaaagataacccatggattaggaacaatatttgcaaagcatatatctgaaaagaggctgatatccatcatatataaagaacagctacaactaaacaacaagaaacccaaagcatcccatcaacaatggtcagaagacttgagtagacgtgttcctaaagaagatatagcaatggccaataagcatctaaaatgatgttcaaagtcactcatcatagggaagcacaaatcaaaccaagaatgtcataccacacattagggtgactgttattttttaaaatctagaaaattaaaaattgttggcaaggatgtggagaaattgaaacccttgtgcactgttggtgaaaattaaaatggtagggccactatggaaaacattaaggcagtttctcaaaaaattaaaaatagaattaccacatgacctagcgattcttctgcatgtatgcaccaaagaaatagaaggaggatcttgaagaatagctgn

SEQ ID NO: 551487 - DNA, 500 bp, Homo sapiens
  misc_feature (366)..(366): n is a, c, g, or t
  misc_feature (377)..(377): n is a, c, g, or t
  misc_feature (399)..(399): n is a, c, g, or t
  misc_feature (407)..(407): n is a, c, g, or t
  misc_feature (419)..(419): n is a, c, g, or t
  misc_feature (456)..(456): n is a, c, g, or t
  misc_feature (461)..(461): n is a, c, g, or t
tcctgtctaataacccctctgagaggcagacagaggagtaagacacacagaactaagagtgccagcttgctccttcctgtctttattcctgattcagtattacccacagctagaaattgacaactcagtaacttcagatgtccctcatagtagcagatgggaatgtaccccctctctaaaggcaaaagcagatcaagagaaaagagagcccagatgtctcttagctgagggcaggcctacctagttttttctcccagattctctcttgtggggaggggtgggtgaggataagaatagccagtagttcagtagttctcagccttctctgtgcatcaggaatcatctggagggagctttcttaaaaantacggcatgtntgggcatccacatccaggaggntttagganttcactttgttntggggggtgggtatttttccatggaacggtttttttngggtnggttttaatttgttaccaaccaggggtaggaggattcca

SEQ ID NO: 551488 - DNA, 227 bp, Homo sapiens
aaattccatgccaggtagaatacatttaaaaattggttaagatattttattggtattttatcacaatagaaaaagttcagaagaaaaatatataaatccaaagaagggaaattttaaagcatcgaggtggaagtttcagatggaaataagtggtacttgacgtgggactaggcatgaacatggatgtacacaaccgaggccaactcaagcagctgtagcagcaatgc

SEQ ID NO: 551489 - DNA, 362 bp, Homo sapiens
atcctatacagcttgggagagggcagagaagcaatgaactcaaaacattttcttaaaggacaccaggctgggcgcagtagctcacgcctatatcccagcactttgggaggccgaggagggcagatcacttgaggtcagtcgttcaagaccagcctggccaacatggagaaaccccatctctactaaaaatacaaaaattagctgggtgtggtggcgcatgcctgtaatcctagctactcaggaggctgaggcaggagaatcgcctgaacccaggaggcggaggttgcagtgagctgagatcgcaccattgtactccagcctgggtaagaagagcgaaactccatctcaaaaaaaaaacaaaa

SEQ ID NO: 551490 - DNA, 288 bp, Homo sapiens
ctatggcgaagttttaagtgtggggtcctaatcccttccttctatgaagaagaacggtcatgagggatacatgtgcacagagaaaaggccgtgtgaagaccaaatgaaaaagtggctgtctacaagtcaaggagagaggcctcgggagaagctaaacctgctgacactctgaccttggaatcctagactccagaactgtgagaaaataaatttctgttgtttaagccacatggtctgtgtattagattatggcagttctagcagactaatatacagttgctccttgaa

SEQ ID NO: 551491 - DNA, 159 bp, Homo sapiens
ttgaatctagagttatcccccctatagcgccttagcctacagcgccttttgggatgagtcgcagctaagggaagcgctgactcctcggtgcagcattggggttgatgagcgtatttgccccctttgggagtgggaagcgagtaccgcaggccgcggggg

SEQ ID NO: 551492 - DNA, 361 bp, Homo sapiens
tgtctagaggatcctataggcgctaggtggttcttctgagcactcagagggctgctcctgattcagacactccttagtgagaaaatgaccaagaattgcattgaaagggtttaaatggcagacactgtcaaggaagatgaaaagatgacccacagaatgggagaaaatatttgcaagtcatctatcaaataagagtgtagcatccagaacatgtaaagagctctttcaactcaacaataaaatgacaaataactcacctgaaaaaaatggatgaaggattcggatatgtatattttatctctaaagaaagtatacaggccaggcgtggtggctcacgcctgtaatcccagcactttgggag

SEQ ID NO: 551493 - DNA, 298 bp, Homo sapiens
tgggtaaaattttttttttgttgaaacggattttttatgttgcccaggctggtttcaggctcctgggctcaaatggtcctcctccctcagcttccaaaggcacaggccaagttgtagctttgtcccttcccatcatgccccacaaaaggttttaacccttttaaagaaattgactttcaaaaattggttatgttggggggcaagttttttaaactggaaattgtaaattcctcctgaaatgttttttcaaccagttcccatgaactaaaactccaaaaaaggatggttttgggggtca

SEQ ID NO: 551494 - DNA, 126 bp, Homo sapiens
aatccattacattgaagaggcaggcgacatgcgagtgctggagaggaaccccgttacgccaccatttcacatgtgaagatgcagtgcgacatgcgagtgctgaggaggaacgcttgacgccactat

SEQ ID NO: 551495 - DNA, 401 bp, Homo sapiens
  misc_feature (20)..(20): n is a, c, g, or t
  misc_feature (33)..(33): n is a, c, g, or t
  misc_feature (52)..(52): n is a, c, g, or t
  misc_feature (315)..(315): n is a, c, g, or t
  misc_feature (332)..(332): n is a, c, g, or t
  misc_feature (337)..(337): n is a, c, g, or t
  misc_feature (339)..(339): n is a, c, g, or t
  misc_feature (342)..(342): n is a, c, g, or t
cgtgactgtgtgactcctgngcgtccaacaggngttgtcagtggtactgccnggtgcaaccttggtctctctgactccagcccccccacagtgtgaccgtccgtggtacctgccgggttccaaccttggtctgtctgactccagcccccccacagtgtgaccgtccgtggtacctgccgggttccaaccttggtctctctgactccagcccccccacagtgtgaccgtccgtggtacctgccgggttccaaccttggtctctctgactccagcccccccacagtgtgaccgtccgtggtacctgccgggttccanccttggtctgtctgacnccagncnccncacagtgtgacctgtcgaggtatcttgccgggttccaacccttggtctctctgaccacg

SEQ ID NO: 551496 - DNA, 150 bp, Homo sapiens
ctaggtggaaagctgacgtgacggacgagggacgtgttggtgaatggggaccggctggtggatcacgcagtctgcacttcgccttccatggatgagaactacctgtacctggctcatgggtgtattacgtgtggcggggaccttgctgac

SEQ ID NO: 551497 - DNA, 389 bp, Homo sapiens
gagtagctgggattacaggcgcccgccacactacccagctaatttttgcatttttacgtagagaaggggtttcaccatgttggacaggctggtcttgaactcctatgctcaggtgatctacccgcctcggcctccaaagtgctgggattacaggagtgagccactatgcccggccttcattggattctttctagggaaagtcatcttgtagagcagagcatgcagagtgctatttcttttttatgtttctcttgaggcagaagactggtgtttacctaccatttcatgggtcgtagggccggcggtgaccattatgtggtgtgtgtacagcgtcgtacaggcttggccttgaatgatctcttatggttagaaaagacaattaaaaacaa

SEQ ID NO: 551498 - DNA, 1394 bp, Homo sapiens
  misc_feature (591)..(591): n is a, c, g, or t
  misc_feature (798)..(798): n is a, c, g, or t
tgcaccaatttgttcacaacaggtgggcccacgtggcgttgtatgctcgtctgtccgggtgcgtgtgtgaaacgcctttgtggggacacacaaccgccgttgtcccaacgtgtgcgccgaacgccggtactttttcctgcgtgggacgtcggcggtgtctttccacggcttcccctgtgctcacaatggagggggggtctttaaatgatccatcacgccgttcccccctgtttttttcacgcgggcccatcggttgttccagagacaaggctgttgtgccccgaaaccccccgcgagtgggacacactggggtggcccccacccggccgaaaggttgcgtctgttcgccctgtggtgcacagaaccttgggcgccgttgttctcgggcaattcaatttgggacacttggtttgtttccgggggggttttggcggccctggacccctggggggccccgtgtccccccccacacacacaggccccacgcccccctctgcctgtgggtgtccccagaggtcccgcaagagaagggacacacttggagagggactcgcctcggccccctgttgccctaaactcgcccctgtgggncttgtgagagagaagggagagtctgtgagaagaggggcaccccttgggggcccgcacactcccacccctcggggagaccccccacgcggtgtggccccccgcgagagtccacactcggggttagaaaggttgtttgcccaccactcggggccacgcgaccacccgccgactgtggtctctgccacacactcgttgcccgctcctcgngaaccacactcgcgggtttcacagagaccacagctggtccccgaagagtgatataccgcgcggtttctcggcaccctccggtttgggggaccttgtgtgtgagaggcacaccacagggtgaaagagaggcacagggcccccctggaccccgaagcgcccttttgtcctggccctgttgtgtgaattgtgggagattgaagattgtggggcacacacagggggtctcccctgcgcctaagagctctgtgttgacctgtccccctcgggggaacagggggaaacccacaagcgattgaaatttgcgctctgtgaaagagagttcctctccctctgaggaactctggacacacaggagaagagaaggctctgaacccagaaaggagagtgcatccactcggaaggaaccggttgagaaccatggaacccggactcccaagatgaccgattcttaagaccccgggagccgagaaacccaaggccccggtttttgggttttaagggccccaagaagaacaccagacaccacagccccgaggcccccggtgcctggcctggcctagacctttggaattgagattaaaccatttggagttgga

SEQ ID NO: 551499 - DNA, 173 bp, Homo sapiens
  misc_feature (124)..(124): n is a, c, g, or t
  misc_feature (135)..(135): n is a, c, g, or t
gcactgtccccgtgctgtcatagaaaatcaagcaatggagtgcccctggatggtaagggatgagctacgtatttaagttatcggatctacttttcccttttactttagccaaggccatttccanaaagcatccangacatctgctgatgcgaggacggaggcctgagtagcgg

SEQ ID NO: 551500 - DNA, 1445 bp, Homo sapiens
gtctctcggccttagcgccatattttttggaaacctctgcgccatgagaagccaatgtggaggaagaagcgacatgcgcacggctgaacgcgcacacacgaacgaaacgatgaggcaagagcgtccaaagataaaaccctgatagccatgtcgcaacccgagaaaggaccacaaggagcagaaacactggcactggccagaagctggaggactgcacggctaccaaagatatgggcagcacatgccatgcatcactgatcataatacgcattgaaattcaaatatgaactcataagacacatttaacatcatgacccttccttgatatcagcacgaattaaaccttcctgagaatcccaagccattgcctcaattacacacacgactattgacgacatgatctggatacctacttgcacctgcgacactagtgaacatttcctgggaacatatacaacaagtgaatacacttcccgcatgggcaccgacgcatgaacacccaggcacaaataataaaatgaacaaaaaaaaagcacaacaagcaaaaagaaaatacaacaaccacctaaacatcgagcgacgcacacaccacagccacccaaacaacgacaaagaacccaactaacacccacaaccaaacaacacgcaagccgcgacacccacccacaaacatgacacagcaataccaacagacgtacgaacacaagacagaacattaataccaacacaatagccacacgcgccgccggagtaccacagacaacaaaaggagtgacgatatgccctattaccttcaaccaacaatcaaataatgatcacttccacgccagagtacacagcacaagcgcgtcgtatggatcgaaacatacaattcgcgcacggatgggaggcgacagagtagcatagtctcgaaggcagcactgtcatcacgcacgaatacgacagacgaccgacgaaatcgacgactagcgcactatacactggtaggagaccaccacaactaccacatcgccagagacacagacatagacacgcgacaagccgcaagccacagaaacacgcagagacacaaacaaaacacacacaaaatgcagacaccaaagaaagcacaagcaaccgcgagcacaaccaaacaaagtcagacgtctagtgactaagggagcagtaacgtgagagtgatctggacggcatgcgacggtcagctaacacggagtgtgagatgtaaacgacaagaagagagaagacgcggaccgagtgagctaagtgctgaagaggcaacgaggtggagtagtgagatagcgagagacttgactcggctaagcaaaacacgagatcgataaattaatgaaatagtatcgcaacataacgtagttctcgcagacacagctggtacctagcgcgctatcggatgaggaagggagaatagacgaagatgtgggagggaa

SEQ ID NO: 551501 - DNA, 121 bp, Homo sapiens
tagagtaccccgcgggttcacttgatgagtttcattatcaattgcttctgaccaagcttcttttgctcacgcctcaatgcagcctcctccagacctgcgcagtatctcaggatcttcctca

SEQ ID NO: 551502 - DNA, 107 bp, Homo sapiens
ggcgtcactttaaccttctggaaccggccaccactgccaagcctcactattgaatccacgccgttcaagtgtcgcagatggggaatggatggtgcttcttacttgtc

SEQ ID NO: 551503 - DNA, 776 bp, Homo sapiens
gggggggcacaaactttcaaaggcgggcagaggcacacaagcttctaggacaagagccagaaaagaaccaccggaaggaaccctctcactgtgtgtaaacatgacttccaagctggccgtggctctcttggcagccttcctgatttctgcagctctgtgtgaaggtgcagttttgccaaggagtgctaaggaacttagatgtcagtgcataaagacatactccaaacctttccaccccaaatttatcaaagaactgagagtgattgagagtggaccacactgcgccaacacagaaattattgtaaagctttctgatggaagagagctctgtctggaccccaaggaaaactggctgcagagggttgtggagaagtttttgaagagggctgagaattcataaaaaaattcattctctgtggtatccaagaatcagtgaagatgccagtgaaacttcaagcaaatctacttcaacacttcatgtattgggtggggctgttgaaagggtgccaaatgcatacaagattcctggttaaatttgaatttcaagaaacaatgaaaagtttttcattgaccctgaaatatccagacatacttttttggtaagggttttttatttgaatctacaaaaaacaccaaattttttttaaaaataaaggatttcctaatattggccgggggaatattccaaatacaaaatgagggccagggcccgtaaaatttcccactttaatttttggaattgatggggttggctaaaaaggaaatttaaaccaccc

SEQ ID NO: 551504 - DNA, 835 bp, Homo sapiens
cgcagtggctcatgcctgtaatcccagcactttgggaggcccgaggcggcgtggatcacctgaggtcagaaattcaaagaccggcctggcaacgtggtgaaaccccgtctctacaaaatacaaaaaagttagcccggcatgatggcgggaggttgaagcagcgagaatcgcttgaacctgggaagctggaggtttcagtgagatgacaatgcaccattgcactccagcctgggcaacagagcaagaccttgtctcaacaaacaaataacaaaacgacaacgacacagaacacaagaaaccctgggccaggtgcggctaggctcatgcctgtaatcccagcactttgagaggcggaggcggcgttggatcacctgagcgtcaggacttcgagaccaacctgggcaacatggtgaaacccccgcctctactgaaaatacacaaacattagctgggcgtgcgtgagccgtgcacctgtcaatcccagcttcacttgggagcactgacggcagcgacgaattgcttgaacccaggaggtgcgaggtagccagtgagccgagcttgccgatgggcactcctaggccctggaccaccaggagccggaaactctggtctcccaggacaacgccgacgcaaacgccagagtcagaggaccaaagccaccttgggcgcgctctcaagcacagcgcgagaccaaacacgggccaaagcccagcactactgtactgtcgcgaacttatgcttagaacccctattacgaagcggtgacgactagctcaaggggctatacgtgggctaccatagccccacaagaccccacgggaagccactagcggaa

SEQ ID NO: 551505 - DNA, 289 bp, Homo sapiens
  misc_feature (71)..(71): n is a, c, g, or t
gcgcaggcagactctgaacctcatctccctcctggccttgcgtgttctggcggaacaaaacatcatgcctngtgccaccaacgtcaccttttactaccagccggccccttacgtaagtgatggcaacttcagcaactactacgttgcccatcctccagtgacctacagccagcgttaccctaacctcggctggcctgtaactaaccttgagacctgagggcttcacagtgggggccccactagggctaggggtctcacggtagggggggcctcctcctggatgtagggg

SEQ ID NO: 551506 - DNA, 581 bp, Homo sapiens
  misc_feature (581)..(581): n is a, c, g, or t
agacagagtcttgccctgtcgcccatgttggagtgcagtggcgcaatctcggctcactgcaacctccacctcctggattcaagcaattctcctgtctcagcctccctagtagctgggattacagtcacacgcccagctaatttttgtatctttagtagagacggggtttcaccatattagtcaggctggtctcaaactcctgacctcaggtgatccacatgcctcagcctcccaaagtgctgggattacaggtgtgagccatcacaacccacctcaaaatatcatggcatgagccaccgtgcctggccatttttctttttctctagcagttattgataagcactggccttgagataagcaatattgaaaacagttgcagctcattcaccaccaaatgctaacctactgattcctgttccacaagccgtaactacagctttgactggacaagagagctatttcagtagctatcaacaagttagtggtctcctgataagagaccactgaccatggactggttctgcttgtttacagaggctgctcacttgacttgccttgtgtcccttgttcacccttttgcn

SEQ ID NO: 551507 - DNA, 1189 bp, Homo sapiens
ctatctgtaacaatatccgacttgacacgggagggggtgaggtgtgtgtgtgtgtttctatccaacttcagaaggtttggagtcttacaatggaacaaaactttgtcctagaaatgtatccattagttcaattttacttccagtaatcccacccgagattaggtctaacgactgaatgtttttctcctttaaacctgtgtctctgtttacgtatgttttcttttacacgtctggatagtgggtttcttgtacactccgatggtctccgatcctctgtccgtaccttgtctaagacagagtaccggcagtcttccttggttgtgacgactgtggaactaaagtctgaagatggaggacttgaaactctatttacagacaacaaagtcggtggatgaaacgccacgaagtaatctcgtcatgatcctttgattacgtctgtagtttttcctggactagtgaaaaatcccgattttccttcttttagattgtgtctgaaagtaagttaagggaagggagggaagaagaaaggaatggacagtcagatacttcgtaaaaaaactggtgacctattagaagtccctctagtaggagacttaatctactgaacctacaaccctgaagtttagatgtgtctactccccttcccagtcctttagtcgggagactaggattacgggggtgcgtatggggtgagtgtagagacctccttcttccctactctgatatggggtcttttggacggataattacccttgtttccacacccgggtcactcttgcactaccgataccgtcgaccactcttttcctcccttgtcttttcaccttgagtggcagaggtacagaaggagtataggatcctacccgtctttgtttgtacctacactcgagacccgaagtaagggaccccgtaggaagggatagagaggggaggagtccactcaagacagactcaatcgtcacagggaggagtggaaagtctcactagagtggagaaatgtgtgacacgaggaaagggagagtaagaggaggaagtggaaagtactagggaggaaggagagtggggtagtgaaaagggagtaggaggtagtgtgtctggtttgtgtgtgggtctcgggagcccgattctcaaccatatattttcggaatgttatttcgacgaaggggagaacgttttttttttttttttt

SEQ ID NO: 551508 - DNA, 824 bp, Homo sapiens
tcgtctggacccgttatagtctggaacatgactacgtggtgaagacatcttaacctggaccccttcctagtatgaccgggtcacgtccctcgtgtcgtccttctagtttactctccaacagagcaaacaccccaaccccctccttctcactccgactagactgaagctccctcctagatacttcgtaaaaaaactggtgacctattagaagtccctctagtaggagacttaatctactgaacctacaaccctgaagtttagatgtgtctactccccttcccagtcctttagtcgggagactaggattacgggggtgcgtatggggtgagtgtagagacctccttcttccctactctgatatggggtcttttggacggataattacccttgtttccacacccgggtcactcttgcactaccgataccgtcgaccactcttttcctcccttgtcttttcaccttgagtggcagaggtacagaaggagtataggatcctacccgtctttgtttgtacctacactcgagacccgaagtaagggaccccgtaggaagggatagagaggggaggagtccactcaagacagactcaatcgtcacagggaggagtggaaagtctcactagagtggagaaatgtgtgacacgaggaaagggagagtaagaggaggaagtggaaagtactagggaggaaggagagtggggtagtgaaaagggagtaggaggtagtgtgtctggtttgtgtgtgggtctcgggagcccgattctcaaccatatattttcggaatgttatttcgacgaaggggagaacgttttttttttttttttt

SEQ ID NO: 551509 - DNA, 1133 bp, Homo sapiens
  misc_feature (255)..(255): n is a, c, g, or t
  misc_feature (411)..(411): n is a, c, g, or t
  misc_feature (485)..(485): n is a, c, g, or t
  misc_feature (591)..(591): n is a, c, g, or t
gagaacgaactcgctgaacgacctgcgtggccagtggctgggcccctcggggtcatacactttacggagtacctgagacaagaacagagaccactgtcgtattttataagcctgatgcggccatcgccaggaggactccactacacttgaaccttcctagtgtcaagaagtactcgcctgagttgcgttgagtgtggtcgtatatcactgacgccggtcaccgttgatgcgagcgagacacgcaggtttgccaancccagaccctcacgtgggtaagctctaacatgacgtatatgaggccctccaatgaggtcaatcgacactcgttgaaaagtcgtcagtcgagacacaatacgattgggtgacccaaggtatatcactatgggtcccgcacgtcgcgaatcgaaaacngctgacaccgaaaggggtgtgaaacgcattgaaaaactagcgctattgctaacagacgcattgcccaatctctnttctatctgtacaataactatacacaccctgtacggtcccccaagggcagaccttgcgcgaacttatcactggcccactttaagtcaaatctaaaaaagttggttntcacgtgctgagaggacggacggaaagcctccagcgcgggcatgggacaggacagccagtggcatccccagagccagtcagagtctcacgccgaaagctaatgaaggcactggctcatggcacacgggaactatctaaggcggcagtccgttgcatggggacccacagggcgacgccggggggagccatggtcgtgtgcaagaaggcttgcaagggccaacgcaagacccttaggaactgggacagaaacactaaccagaacaaattcactcaatggaaagccctgggcacctttccacggtgccatgggttccggccatagggtcggcggattgcgcaaataactaatttggcagggggcgtccccctaagccacaacgcaaagttggtcaaaaggtggtccggaggattcttacaccgggtagagaattccgggggcaccccaggcgtgggactttgcactaccctgggcaattaccttcccaattcccacaggtggttcccccaatgggaaccggagcgccggtttcgggggggggaat

SEQ ID NO: 551510 - DNA, 118 bp, Homo sapiens
gggtggaatcaggatttatgttgctgcacggtttctgaaacactatttgatactgcgacgttagagtgtctgccacttagattaccatttgttgactattaagagggtagaagggggt

SEQ ID NO: 551511 - DNA, 84 bp, Homo sapiens
aaaggcactttattgcattaccattcacaattaacagtcaagaacaaataataataacaaataaagtgcctttgttagatggtg

SEQ ID NO: 551512 - DNA, 335 bp, Homo sapiens
  misc_feature (137)..(137): n is a, c, g, or t
aacagcttcattacaacagcttctgtccaggttccaggcaaggagttagcatttcctttacttaagtgcaaaacatctttctttgccctgtttggctagacatttcctcatctgccctttgcagttctgatttgatnagcatacattcttctgctctttctgcacgcctctccacagctttttgacgaggtcttgatatttctcatcttatttttgcagtccagcttcttcacttgagtcttcactaagtttagtctttagccatgagccctgttccacctggtaattctactcgactgaacaatcttcatcactccttatcatctttccttgac

SEQ ID NO: 551513 - DNA, 238 bp, Homo sapiens
acggataattctcccccaaactctgggcctcggcttttcctctggtagctgggtcctcgggtgtgaccaggagcagataacaaatagcacctagctgggtgacaacccatagaaggtatgcctataaaatgccaggggccattgagttgtcacggtgaggatgacactatgggcagggagtgatgattggtatgtgaccaacttgattgagaaatggctccagagtggggtacggacc

SEQ ID NO: 551514 - DNA, 213 bp, Homo sapiens
  misc_feature (43)..(43): n is a, c, g, or t
  misc_feature (79)..(79): n is a, c, g, or t
  misc_feature (92)..(92): n is a, c, g, or t
  misc_feature (139)..(139): n is a, c, g, or t
  misc_feature (177)..(177): n is a, c, g, or t
ggccggggcatttgatctcaaggctgccgtactggaggccatncctgccttccgcagagcaggtgctgacatcatcctnccctactacacanccgcagctgctgcagtggctgaaggaggaatgatggagacagtgccnggcccaagaactagaactttaaaacgttcccggggccncagacaagtgaaaaccaaagtaaatgctgcttttag

SEQ ID NO: 551515 - DNA, 869 bp, Homo sapiens
gaggtagtcaagctgcgcatctcctaagcggctcaggcctggaccccacggtgacaggctgctgagggtaagcgccatccctggcatggccagggcacacaggatgactgcccgatctgacagctcctcggtaggccatgatcccaggaaatggcatgctagtgccagagattaatggcggggcactcaagcagctctcctgagagcgccgtgtgagtatggtcgagcgtggagcgcaatgttgcttgtgacagtgtgggccctgtgtgctcccgacagggatggatcaggggactgtcccacctcagacccttgatacactcgtcagaccgtctgagccgtcggagtaaccgcccctgcgcacctaggacttcctgtggtgccctagtattgattgacaagactctgcgtgtgtgagaagtctacactcgtgtgggacacccagtgatcacggaagtcgcacatccgtgaggcactttatcgttggcgaaattgtccaagagttacacaaggacggggattaacgtttactatccgttgataccaagaaaaaggatcacattgcatacattaacacaagaagagaataaaacaacaacagagacaacacaacaaaacaaaagaaggtaaccaggggacaagggaacaccttgcgcgtctaaaataggcagagcgcatgagggacgcgagaacgagcgaggaagccccaggcgaacagaaacacccgggggaaaccgaaagggcaataggaacccgcggggaaactgcgagaagcgggcaccgaaggaaacgggaacagggagagagacaaaagacttgacggaatgtggcccaagacgcaacatcgggagggggccaaggcaagagaa

SEQ ID NO: 551516 - DNA, 127 bp, Homo sapiens
atgtacaaactgcggacgacgactggactggacttcactcagactgtggcaagctgtgaggtgttccaagaacggctggttctaacagctcgtccacactactggggctgtagaagaacttgcaaca

SEQ ID NO: 551517 - DNA, 101 bp, Homo sapiens
ggctcgtggtgggacctgccgctcataggccgctttgttttcgtagagcaccagcccgtattgtggggcacgaggctgaagcggttttcttccacttcttg

SEQ ID NO: 551518 - DNA, 124 bp, Homo sapiens
attagtgtatgtctctacatggccaacaagtccaacaccaattgtgtaataccagtggttctgcatataagttcaacgctctgaaatttacatttcaccctggcattgtatgatctaccgatga

SEQ ID NO: 551519 - DNA, 1162 bp, Homo sapiens
  misc_feature (638)..(638): n is a, c, g, or t
tggtcttggtacaaaattttattaaaggggtctttagaagagcaacattccaaaacctccagaaatatacagctgtgccaaggagaacccggttaagtgcgtggtgggagacgtggctgtggggcatgtggacagggcggcctcgtggctttcccaccctttcgtgtccgtgagaagtggggggtgggtgggcagaaatcctcactcttgtgggggtctctccacacaatgtgcctcacgtgtggttcacgcgcagggcgcttcatatagcggccaactctataccagttggggctcccaggtgcagagagtgactccttcaccttggtagtgcccagaaacaaccgcggtgtctgtgagccacaacagcgtgtggggccacagaagagtgtgctcacagcgatagatagttataaccaggggtctccgatgtggtggaaatacaatcgagggccatccaacaaatctctcgagggaatttaagaccctctgtggtcctgcggaagtttttccccagaaaaaccaacgaaacctctcgaaaggcctttgtgtgccccccaacttctctccatgtggattgaaaccggaagacaacaaccatatggccaggggccctctccggacaacagaacacgccncttcctatgggagaggtttggtaaacgcgcaaagaggactcctgggcctgggtggccaatggcgcaccaaagaagactctcatcatgtggcgcaccactctttttttcccgcgctctcaaaaggttttcttaacactgtgcccctcttggggaagagggccaaacacttcttttcttgggacctcaacaggacaagcatcaagttccccggaaatccgggcgggacctttcttccaccagaagacaaccattcttctcggtggcagcgtcgagggggggctaacagaatcaaatgagaattatcgcgggccgcgcgatacgggggtagtaactctccggcaaccttccaacttcccagaaaggataaagcgcactttcttcaagcccagaggttccccgaaagtttaagaaaaacactccttctccagatctcacgagtttctggcaagattggctcttcaagcgacaaaaatttccctcttctctggggattttggcactggggcccattttggcccgagaag

SEQ ID NO: 551520 - DNA, 994 bp, Homo sapiens
  misc_feature (292)..(292): n is a, c, g, or t
  misc_feature (349)..(349): n is a, c, g, or t
  misc_feature (895)..(895): n is a, c, g, or t
gggcaggcggaggattgtcctggctttcggaacccctagcgtcgcgagatggtgaatagtccctcccttgacagacaggatcactcaggtatcccagcatgccttccgcacgagcagcaggcacgtgacacaggggactagaagcgccacgcgacctacgcaatcggcacgccaaggctctgtcgacgcattgcactgggtgcgcataagaagtcgcatggcaccaggcgcgccggtcagagggatggcgagacacgttggaagacgacttcccatggggtcattcctcttncccacattgcttcgtgaagatttagcaccctgtgcgtgtcactggtgggacgtccgngttagcggatgcctgccgcgtagaaattggcggctcgcttgctagccgcaaagcacacttgaagaagaatacacgcagaggataggtgcctgagggggacattcacatcgatcgacgggagtcacctagaatccttatcacggcgttagatcctaattgcgtacttcactgatgatcgggcggtgcaaatggttgcaagagggacacataaacagtccaaacgaccaatgaccgagggaattctcgagacttgtccagtgccagggcgtcgacacgaaacggcccaacaaacgcgagttaactgtgcgaaaccaggtgcctgaagtggtccgcgtcacgcccattcgtaccagtacgcaggacttccacaggagcgcgaccgacggcgtgcccaccgaagggggaagcaagggtaccacgtctttgctagtttgcttcgcatgcgcagattacggcttggaccggaagccaagcattgccggtagaccggacacaattgtcgtgtccacttttgggctttacctatcagaatgagacccgccgaanggaactaggacgctcggctctttgcgtctcggaaacaccttgcgagcgtgaaattaagggggcttttgaagcatccgtggagacccgggggccatcacc

SEQ ID NO: 551521 - DNA, 96 bp, Homo sapiens
gtattgtaattaaaagcaaatcattcgtttaaaaaggcagttcgcaaaaaagttttggtcttttataattctcattaaaagaatatctggcaaatt

SEQ ID NO: 551522 - DNA, 243 bp, Homo sapiens
tagagtagggtaggccgaggacgctccgggccatgacatcacagagcactctgctctgatccatgagcactacacccgagaggcccccagcctcatgcacctgactgtggacacatgcctacagatcggtcgcatgagcctgacagcctacaccagcacttctatgggagtcacttgaagcaccatgggagtgaagatcacgcgtgtgacagtgagatgcgcgaactacgacactgtacgcat

SEQ ID NO: 551523 - DNA, 1227 bp, Homo sapiens
  misc_feature (15)..(15): n is a, c, g, or t
  misc_feature (178)..(178): n is a, c, g, or t
  misc_feature (193)..(193): n is a, c, g, or t
  misc_feature (208)..(208): n is a, c, g, or t
ggggcccagactgcntgcccgtcaggcacaggggcatctacctagacaggacagcagggtggaccccagtttggaagctgagcccccagccacgaacatggatctgaggaggggcccttgggtcgggccctggagacgacacacggcagcccacaggccacgacagacgctggatgcnctcctaccgccaganacctccccaaaggcnttggacctccttaggcgactcctggtgttcgccccggacaagcggttaagcgcgacccaggcactgcagcacccctacgtgcagaggttccactgccccagcgacgagtgggcacgagaggcagatgtgcggccccgggcacacgaaggggtccagctctctgtgcctgagtaccgcagccgcgtctatcagatgatcctggagtgtggaggcagcagcggcacctcgagagagaagggcccggagggtgtctccccaagccaggcacacctgcacaaacccagagccgaccctcagctgccttctaggacacctgtgcagggtcccagacccaggccccagagcagcccaggccatgaccctgccgagcacgagtccccccgtgcagccaagaacgttcccaggcagaactccgctcccctgctccaaactgctctcctagggaatggggaaaggccccctggggcgaaggaagcgccccccttgacactctcgctggtgaagccaagcgggaggggagctgcgccctccctgacctcccaggctgcggctcaggtggccaaccaggccctgatccggggtgactggaaccggggcggtggggtgagggtggccagcgtacaacaggtccctccccggcttcctccggaggcccggcccggccggaggatgttcagcacctctgccttgcagggtgcccaggggggtgccagggctttgcttggaggctactcccaagcctacgggactgtctgccactcggcactgggccacctgcccctgctggaggggcaccatgtgtgagccgccctactcccttcacctggccctctgttcctgccccagccccttccccagacccctctccagtctcctgcaccccttagccctccctgctttgcctggcccgttgaagttccagggagcttgcccgggtctcctcgggggagcagatgagggccctgcccccgccccactgacttcctccaataaagtcatgtctgcccccaaaaaaaaaa

SEQ ID NO: 551524 - DNA, 112 bp, Homo sapiens
cgtgcattatattgttctattgtttgttggatccgggtattctgaatctgggtattcacatttctaaatcacttgattactataggtttgatatatctcttgttagctttca

SEQ ID NO: 551525 - DNA, 193 bp, Homo sapiens
tcatcgagctcggtccctgcttagtcgggtgaataggctgctggtgggtgacagtgctcatcatgagcaggacctggagtggctgcagcaggcggacgtggtcgtggcagaagtgacacagccatccttgggtgtagcgctatgagactgggccgggcctgtgagcctttaacaacgcggatcctgctgcctg

SEQ ID NO: 551526 - DNA, 306 bp, Homo sapiens
accgcgcgtggatcggattcgaaaaaatgaaagggcgcttgcggcggcgcgccggcggcagcgtacccggtatcgtgggcgagcccgcggcatttttcggtgcggccgcccggttagagacacgcggcttcgacggcatcgttttcgggcacacgcaccacgcgggatccgcgcctctaccgctcggtggcatatatttaaatcctgggtcgtggatgttaggctcgaagtacgtgctgatcgcgaacggagcggccgagatgcgggatgtccgctcacgccgcgggagagataggcgtgccggat

SEQ ID NO: 551527 - DNA, 275 bp, Homo sapiens
gtggcgaagactgtgggttccaacaaaggtgccatcattgtgactcatgggtgggcggtgtttgtcataggcgacacgtgactcgtcatcaccttgtgtgatgcttgaagaagaaacagtacacatccattcatcattggctgtggtggaggttgacgcctgctgtcaccccatgaggagcgccacctggtccaagatgcagcagaacggctacgaaaatccaacctacaagttctttgagcagattcagaactagaaccccggcaaagtcttcg

SEQ ID NO: 551528 - DNA, 228 bp, Homo sapiens
ttttttttttttggctctagagggggtagagggggtgctatgagtgtaaatacggggccctgatttcataagatattttagagggatattcaattcatatggacgaatgaggacatgtaaacttgtgtatttgctaccactagagtttcatgagcgattggcctgtagtatacccccggtcgtgtagcggtgaaagtggtttggtttagacgtccggggtcgacgcgg

SEQ ID NO: 551529 - DNA, 891 bp, Homo sapiens
  misc_feature (18)..(19): n is a, c, g, or t
  misc_feature (26)..(26): n is a, c, g, or t
ctttggttacctgcccanncgcgtantggatatcgtcgacccaggcgctcggctagtgcgctcttggctcggcgcggtccgctgcaatccgtggaggaacgcgccgaccgagaccaccatcatgcctgggcacttacagtgaaggcttcggcatgcgtggatcaccaacctgattcgaccagttatttgacgacggaatcggaccccttcgaggtgctgaatggcagcagagaacaatgaaaaaacgaagccggacgggtggcggcgttgggggccctggggccaatgagcgcagctcaggcctgtggcccagaccaaactccaatcgctggacatggcaaacatgcttgcgcaatggagtcccagaaaagaccgcacagaacccgcatggcccccaggcgtaggcggtggcttgacacgaaatgaggagacgcaggccgcccgtgggcgcttacagaaagaagggaatactgacgagttggaacgaaggacctgatcaacaacttcagggtgaagggacaaatacctcgctagcaagaccagagaggcgaccacctcgtgaacgacgcttccgaacagcccacttgaaagcacacgggttgaccggacggcgacatgttacagttgatagacccgcactactttgacccgaaccttattacgagtgctcgtgtgttggtcttggaaaaacagtccgaggtgtggcccgatgcacgtggaaatggggccgcagcgacgcatggcagtttcgagtacctcggtgggcaaacgcgtgcacttcgaatagggccattggtggacacgtggctagcgtcgttcttgatgccacctttaccacgtgaccattcagcccatcacgcacacaccgttggtggtagcggatcaaccaca

SEQ ID NO: 551530 - DNA, 261 bp, Homo sapiens
gcacctaagaccatccacccctacagtgctattggcagaagtgtcataattgatactgtatctgttccttcaagtatagagcttttgggaggaagtattgactggggttggctgcctactggctgacataaactacattatgggaaatgcacaagtagtttggatatggtagtgtgtggttctcttttggaatttctttcaggtgatttaataatgatttaaaactactatagaaactgcagagcaaaggagggatgagca

SEQ ID NO: 551531 - DNA, 583 bp, Homo sapiens
aaaggcagagaagtatatggaaatatgttcaacatcactaatgattaggaaaatgcaaatgaaaccacaatgagatactctacttagaatgttcttactaaaaaagataaaaaacaacaaatgctgatgaggatgtggagaaaagaaaactttcactgttggtgaaagtataaattagaacaactactgtggaaaacagtatgtagatttctcaaaaacctaaaaatagaaccaccacatgatccagcaaaccaagtataaccacaggaaaagaaatcagtatatcaaagagatacttgcacttgcatatttatcacagcactattcatgataacaaagatatggaattaacctaagcatccatcagtggacacagggataaagaaaatgtttatgtacacagtggaatactatttggccataaaaaagagtaaaatgttattgctaacaacatggatggaacttgaggtcattatggtaagtgaaataagccaggcacagaaagacaaataccacatgttctcacttatatgtgggaggtgaaaaacttcacctcctggagaccaggtagagccgaggggga

SEQ ID NO: 551532 - DNA, 162 bp, Homo sapiens
ttttgaggatagcttaaactccttatgatttcatccccgtaccaaccaatcagcattctcgcttcccgagccccctgccgccaaactacctttaaaaaaccctagcctccaaattttcagggaggctgatttgagtaataataaaacccctgtctcctgttt

SEQ ID NO: 551533 - DNA, 467 bp, Homo sapiens
gcgtcgacccagcgctgcatttttaaaggaacatgaaagactccaggagtctacttgtaagagtctatgaatttattcacaaagtcgtgctattctaccatcacacaaacagtctgtcactcacagaaatgtttgatccatggccgggcccatggttgcgggaaattgttacatggaaaagccgatactggcttccctccctccacccacatctaacttcctggtcttccctgatgacatcctgcctttatggctttatacatccctgactgcctgcctaaaatgccattgctctcttttcttccaacatcctgtccctgagaacgcctagcatacttacagcaaatgtctacactgcctctggagcctttctcatacctttcccccactccaggcagatggaagtttcttccgtgtcttccaattgccaactggtcaccccattagcatgttgcagtgacacctcg

SEQ ID NO: 551534 - DNA, 1061 bp, Homo sapiens
ccattgaaagcagaaagcagtagtgacacagctttcccttcaaacgagccattgagaaacatttctcaaacaggaaatccttcttttactaatgtggacatatagattattcgctattatagtttgtagaactacctagttcagaatcttgactgccagttttcttggtttcttaggcttgaacttttcatacgacaattgcacacagttctagatgccttcttgaaacggaactgtaatgaagattcagcatctgactactactgtgtgtctatcctgaaataataatggagagtatactgtagattacatgtttacccatcaaatctgacttacacggttacatggaacggttttataggtacaggtacattgattgggaatggggtagggggaggagttgtgggggcacatacactgtgcattccagtctcaacgcatagactacatctaggggaactcggcactgtattattcaactttgatttgggttgtaacaactgtgtcaaatcctgttcatcgaactcccatcaactcttatcacaatttcatgctgactcttcattaccgtctgcatgattggaaatgtccaaaaccatgtacagttccagtatagacgaactgtcactggctctcgtggcccagattcctgtctggcatgtacatccgcatttctccaatacctgcatcacgtaatccatcagctaccataagttcactcctggtacatctccttatctataacaacgcggatcttctcgagaattacattcctgccaaactcacacctgcacagcctcaaaatcactcgcgcacatcagcactctggctcaacttgctccactaccccggcgaaaacgcccccaaaccgcaaccagggcatgcgggcccaccgctcaagcgccataagactaccacggcccgaacacacactcacatccacacagcaccaacccccccaccaccagcaccccacaccgaactaacagaccacatactaacacgcgccacacccacatcacgccaaccccacacacacatctacacacagcacatcaccc

SEQ ID NO: 551535 - DNA, 237 bp, Homo sapiens
cacccaatattaagatcacgctcgtcaatgagtgttgaaagagatatcagatttgaactgttagcacgactgtgtccaaatagcactggtgctgagatagaagcgctcacagaggctggatgtttgccatcagagcacgggaaaaattgctccgagaaggtttcttgaagctgtaataaggtattaagtttatgccaaatcagtgctactcctcgtacatattacgggggaccggct

SEQ ID NO: 551536 - DNA, 229 bp, Homo sapiens
  misc_feature (5)..(5): n is a, c, g, or t
cgtancagcagacttctcagcagagaccttacaagccaaaagagattagggtcctgtcttcgacctcgtttaaacagaacaactgtcagccaagaattttgttagtcccacaatagactacgttttgtaacatgaaggagaaataaagtcattttaaacaaatgccaggggaatttgtccctaccaaaccagcactacaagaaatgctattgaaacttctaaaactagg

SEQ ID NO: 551537 - DNA, 522 bp, Homo sapiens
  misc_feature (522)..(522): n is a, c, g, or t
gattgtgccacgtgcatttctagcctggggcaacaaagtgagactccagtctcaaaaaaaaaaaaaaaaaaaaaaaaaaaaaacctggtgtgcggcggcggccttgggccccccgcgaaaaaacgttttacaagaacacacattcgcggtgtgggcgcgcgcgcggggccccaagggaggggaaaggggaaaagtgggcacacaaaggcggtgatcccccatagagagaagacactccgggggccagagaaacaaaacggcgcgaggggagaatttcctacaccaaaatatacaaaaaaaccgccgcgggggggaacaaacaccgagcacagggttctctgtgacaacaaataccccagaaaaaggggagagatctcagagagagcgcccaaatcacagggggggacaactctaaatatacaacacacaggagagagagtccacaaaaagggagagacactccagaaaaatatactcacaactatatacacgccccccgggactccggggggggggaggggn

SEQ ID NO: 551538 - DNA, 931 bp, Homo sapiens
  misc_feature (227)..(227): n is a, c, g, or t
  misc_feature (672)..(672): n is a, c, g, or t
aaactcgcgtcggcgggcgcgaagaggtgaagctctcggaggctcctcccgcaggtccgcctgggaagggcatctctagcatcgagcagaagaccgtatcctccgaaaagaggttgtaggtgatgaatggacatatctgggagaatgtggagtccggtagacatgagaatcacgatctgtgaccgaagggtgcttagtgaatggtttggatcaaattgtttagatangtcgaaatgcatagtaagtcgcagtagtagtaaggtcgtgtctatcctgtaaaatgacagggtggagttatgttctgggtgccttggtggaagttgcagttgtggtgatgagcggagaaggaacgatagtatatattccactagaggaagtcgtttaccgaaagaggacatgtgtgatatatatgcctaggaatatgtagattgccaatccaaagagctcagatcctggcgtggggctcgtgggcatttaactgttatctggtagttttactatagagattctttaataatcgcctaggaagttggggctgagacgctggtctaataaccgggtttctgatcgaagggcgatagtcttgatgttgagagacggaaatgaaagtaactcatagaaagatagcatgcttgatcagtggcagttgcttggaggacaagctattcaccntggcgacatctgaccagtgggcgcgaagaagggtggatgccaggcgaaacgggtgagaaggtaaaggcggacaggtggtgacccctctttctttgaagaacactttttacagctccagtccttatcgactggattctatagggaaaaacccggtctgtgtttgggatccccgggttcgcttcacccctgcgggttggggacctccctccggatgggggccggggccccggggcgcaccggcgcaaaaatattaccttcc

SEQ ID NO: 551539 - DNA, 416 bp, Homo sapiens
  misc_feature (93)..(93): n is a, c, g, or t
  misc_feature (110)..(110): n is a, c, g, or t
  misc_feature (117)..(117): n is a, c, g, or t
  misc_feature (158)..(158): n is a, c, g, or t
  misc_feature (230)..(230): n is a, c, g, or t
  misc_feature (250)..(250): n is a, c, g, or t
  misc_feature (277)..(277): n is a, c, g, or t
  misc_feature (340)..(340): n is a, c, g, or t
  misc_feature (385)..(385): n is a, c, g, or t
tgaagattgaaagtcagaagttgaacttcaaggagaaggcccaggcaaggtgggatccctcgataatgtgggccacctacctgcaggacagtnctggtgaagactgttantactatncagcgaggctcctctgtgtccgggtccccctgctgggaagngagccggccatctctgaggcagcgctgaaagctggcgcccccacttcagccagtggccttcaatggccaacnccaccctgttcaggggggtngttgaccaaagggaggcccagaccttnggacagccagatccagggagacaaatttgagaccttacaaggttgacgtttccggggcaaatnccaggggccccgcaacgaccaaggggccgaatttttttttcccgncccccacatttttccttggggggggccccaa

SEQ ID NO: 551540 - DNA, 418 bp, Homo sapiens
  misc_feature (385)..(385): n is a, c, g, or t
  misc_feature (389)..(389): n is a, c, g, or t
attcgccgccgcgaccccagcggtagaaacctgggcttcacccaggtccagttggtcgaggcgtaccgtcgactgaagctggcattggacgcaccggcctaaaccaacggctggtgactggtcacacaatgaatccccccaccacccgccgcgattgcatcgatattgagctgcaccacctcgcgctccgggtagagcctggacagtagctcaaaggcttttgcgtcggccaacttgtcgccgaactcgggtgcgatcaccgccccattgatgacgacgtagttgatataacccggcgcgaaatccggattgttccgcctgaaccggctcttgcgtggattaagcggcggcgacacggtgtgcacctgcagcggccggccgtccncatnggtggcctgcttgaggatgtcgaggtgcg

SEQ ID NO: 551541 - DNA, 922 bp, Homo sapiens
agcgggccattgtctctcgctgcagccggcgctccacgtctagtcttcactgctctgcgtcctgtgctgatcaaggctcgccgctgtgaccctgttacctgcaagaacttggaggttcacacgctacacgccgccacggcccccctggacacgcctagaacactgggaccactgaccatttacgggactgtgacacacatcgaacttactcgtctcgacgcgacacttggcaactgccctgcgaccacctgccgcacgacgcgacacttctactactacgacgacactgtgacctgcgttacgacgacaccctacccacgacacaccctgcgatcgtatccattgcgctcacttcgctcgcatcgtctacacgaccacggaacctgcacttcacccttggcctagcgcacgcacacgggccagtcacgaacgtcacccttgtgaccactccttgacactgaatcgaaccctcgaccgaacttgcgctcacgaaccaaactaacccgaccccaccggtttcacttgcttgcttccttccaccttctcatcttggccgcccacacagcacttggcttccattgagaccccactgcacaggcccacccactcgcacacttacacgcacaactgcaatacttacccttactgcgcctctcgcataacccaccccgtccgcgactacccctttgacatccactcaagcccaacgtttccactcggccgcccacggcgacgccagtcaacactcgaggggccccccgcaactttggcacacgggcaccacctcgacctctctacccgcatgggccccccccccacatggccaacccaacccaccgtgcaccctcccagcatctacacaaaacaccgtcgtcggaactctcgggcacgcctgccccccgaccatgtgggcatctcgccc

SEQ ID NO: 551542 - DNA, 138 bp, Homo sapiens
cacgaggcctaacttcacggcttgttggtggtgtttgcactgctttttgtggagagggtcacctactagaagaaaaatgcccagtcttagaggtgggtcatcgcgcctcactggggggggtccctgtctgctaaggag

SEQ ID NO: 551543 - DNA, 263 bp, Homo sapiens
cctgccccaatccctaaaacacagacctattttaccaaggagacctgcgtgtccatttgccatgggagacatggtatagaaaaagctaagatcaattctggtgtgtgggtatgcttgttgctactaagcgatgtcaattgcttctggccctctcaggcattgagcgaactagtctgttgatctgtctgtctgtctatccatgtatctatctacgtctctctcattggaccatcttttgagtgatctatgtctatctaatctat

SEQ ID NO: 551544 - DNA, 978 bp, Homo sapiens
gcaggataccagggggagatcaccagtgtgtccacagcatgccagcagctagaagtgttctcgagagtgctccggacctctctagctacaattttagatggaggagaagaaaaccttgaaaaaaatctccctgagtttgccaagatggtgtgccacggggagcacacgtacctgtttgcccaggccatgatgtccgtgctggcccaggaggagcaggggggctccgctgtgcgcaggatcagcccaggaagtgcagcgctttgccccagggagaaagggcctgaagcccaggctcgaatcaaccaatgaccctggggaaaaccagtgtgccctccataccacgagggtctgacaggctctcggggccatgctgtccaaaggagcctgaaccctgctgacatcaccgtcctgttcaagatgttcacaagcatggaccctcctccggttgaacttatccgggtttccagccttcctggacctgtcatgcagtcactctttcaaccaagggctacggatcaaccaggaccacaagcacaaactacatccacatcttggcgtaacgcaggcacgcgtggttgagaccttggaaagaagaacaacgcgagtgagcatcacctcaagatgagctgaagtcaaacgtcaaaagctgtcgaagcgtcacaacttgtgtgcaccgagaaccaaggggctctgaactagtggcacgaattgagaactttatcaggtataggttccagtggtagcaatgggtgtgatgaaatgggtggatggactggatagaacaaggaattagtgagatggagatactgtaactgaggtgtgcaataagatgcacagatctgaccggacgaggtgtaaaaagaagaaaccactgcgtgaactgatacaaatggacatgcctggggaaaaacgagacaagtggaagaaaaaagaggaggtggattgaaacgaaaaaggtcacatcaactaaggggaaag

SEQ ID NO: 551545 - DNA, 1042 bp, Homo sapiens
ataaaaaacccccagagatggcgaacataggctaagacagcctggtgttaattggcgaggccttctctcgtaggccttctaccctcccgaagcgggctccgggttcgcttcacaggcgcccctctcctccgagatcaacgcctcgccctcggtaagaggcccaggactcagcccacggcccgcccccattggtagtcgccctgggagaccctgtctcacccaccaggacttctcgctcccaggccgggtcctctcaccgtcaaggcccgccccctgcaacggtcctcacccattagccgaaggcccggccctcacagattgccgcaggcaaggggcggagacagcccgggccgtcccaggctccgccccggaagcctcacttccggacgcgagcagcccccggtcgccccggcggcaaccgaggagactatggacccggtcaaggaggcgtgctagaggcaagcccctgaggagggcggcgggcttcttgatatcggggcaccatataagcacgccagaggccccaggcagctataagacagcccaggctgtggcttggtgccccgggagggtcaccaccgcaaagatagggggcggccaagataccggggatgggtgcaccacttgaagttgggacccaagaggggacccctgggaaacgtccatttggagaaccaatgcggaatttcttgccggcccaagtaaccatggtatagtttcccatttcaacgggcggaacccaccagccggggtgttcggcagggagccctgagccacggccaatcagtggtgggccgaacgcgggggggggaaaacatgggttgaccacaggaagaaaggtctcccttcacggcggcgccatgggaaaaggcgtgagggcccggcgccagaaggggtggcaagccccagtagggccccctggagggagcgcaggagaaccacagaccctgggaccggcctggggaccgcaaaacaacccgggaacggctcaacgaggcgtcaacaccctggacaagcgctggggggcaccacctgcgggctg

SEQ ID NO: 551546 - DNA, 284 bp, Homo sapiens
ccctggtgtggtcccttcttgcccgtgtggtacgctttgctggtgtactgtcttcttggcccgtgttgctgtatgccttttcgccctggagtgacatgctgctttctcgagtcttgtgtggtcactgtccccttttttgttgggttaaacgaccaccttctttgctgaggttgcagcagccttcttgcctttcttctgaggtatggcgagctcttctccactgctatcatcttcttcatcttctgacatctcctcatcttcactatcttcttctacctcctttg

SEQ ID NO: 551547 - DNA, 663 bp, Homo sapiens
gtatcgtctcttattgtcgacgacggtatgtgttcagtacagtgtgtcagtacgagcaaggtcgcatatatatattggtgaattaaaatctgtagctgagtctactatgttatgagtcagcatattgcacacaacatcatgagtctgcactgtaagtagtttcatatagaattcggttgagaggaaagattgattttgtgtagatgtttaatataactttacaactatatctcattgacaagataaagtctatggggatttttacctctaagttggatggaaagcacaagaagccagacattcattaatatggaacaaatgtggtattgatgttactgaatattgctatggattaaaatagaaaaagtctaggtgatttttctcttgtaaattttaataagcaggttcagccagctggtagaaaatagagacacatgagtgatttgcagttgtaataatttctgtgtgtatgtgtgtgtgtcgaggtgtttataaagaagagtgtgttgtacccatgagttcagcatttcgtgcatcttgctattttcattttcccgtgtggaagatgcatggttgcatcctttttccttctggaccaagactttaaggtcttgaaactttggtagaggaccgggtttaaagggttcaggggttgaaggagta

SEQ ID NO: 551548 - DNA, 206 bp, Homo sapiens
cgaggcgcctacttttggcgcgcctagcctcctctatggtatgacaccgttatttccgtgcgtgggacaccgagtggtttaaaaactgcggagggatttatattcaaaggcccgcgccccccgccgtttacgccacctcccgttctcccttttaaaaagggggaaagctttaaaaaaaaaagacaaaggttaacataacaataaca

SEQ ID NO: 551549 - DNA, 758 bp, Homo sapiens
  misc_feature (30)..(30): n is a, c, g, or t
  misc_feature (81)..(81): n is a, c, g, or t
  misc_feature (140)..(140): n is a, c, g, or t
  misc_feature (178)..(178): n is a, c, g, or t
  misc_feature (185)..(185): n is a, c, g, or t
  misc_feature (190)..(190): n is a, c, g, or t
  misc_feature (197)..(198): n is a, c, g, or t
  misc_feature (203)..(203): n is a, c, g, or t
  misc_feature (208)..(208): n is a, c, g, or t
  misc_feature (211)..(211): n is a, c, g, or t
  misc_feature (225)..(225): n is a, c, g, or t
  misc_feature (295)..(295): n is a, c, g, or t
  misc_feature (314)..(314): n is a, c, g, or t
  misc_feature (319)..(319): n is a, c, g, or t
  misc_feature (327)..(327): n is a, c, g, or t
  misc_feature (332)..(332): n is a, c, g, or t
  misc_feature (352)..(352): n is a, c, g, or t
  misc_feature (385)..(385): n is a, c, g, or t
  misc_feature (394)..(394): n is a, c, g, or t
  misc_feature (414)..(414): n is a, c, g, or t
  misc_feature (425)..(425): n is a, c, g, or t
  misc_feature (438)..(438): n is a, c, g, or t
  misc_feature (465)..(465): n is a, c, g, or t
  misc_feature (472)..(472): n is a, c, g, or t
  misc_feature (523)..(523): n is a, c, g, or t
  misc_feature (536)..(536): n is a, c, g, or t
  misc_feature (555)..(555): n is a, c, g, or t
  misc_feature (570)..(570): n is a, c, g, or t
  misc_feature (660)..(660): n is a, c, g, or t
  misc_feature (677)..(677): n is a, c, g, or t
  misc_feature (685)..(685): n is a, c, g, or t
  misc_feature (696)..(696): n is a, c, g, or t
  misc_feature (730)..(730): n is a, c, g, or t
tctctttcggagttgttccgtgctcccacntgcttccccttctccactggctgggatcccccgggctcggggcgcaaaaanaattattcaccatgcatcggaaaaaggaggataaccgaatccggattctcattgagaanggagtagctgagcggcaaagatctctctttgttgtagntggggancgagnaaaaaannaggtngtaanacntcatcacaagttanccaaagcaaaatgtgaaggctcggccttacagtgctgtggtgttataaaaaagaactggggtttagcagncaccggaaaaaaaaaaaangaaantgcaaaanaaaanaaaaaataggaaaactgaanataaagcaagacgacccctttgaacatcttcanagcagccanaaacattcgctactgctaanaacaacgaganccacaagatcctnggcaataccttcggcatatgtgtgctncaagatnttgaagccttaactccaaacttgctggccaggactgtagaaacagtggaangtggtgggctagnggtcatcctcctacggacnatgaactcactcaancaattgtacacagtgactatggatgtgcattccaggtacagaactgaggcccatcaggatgtggtgggaagatttaatgaaaggtttatnctgtctctggcctcttntaagaagngtctcgtcatngatgaccagctcacatcctgcccatctcctcccncgttgcaccatagaaggcctgcctccca

SEQ ID NO: 551550 - DNA, 218 bp, Homo sapiens
gtcagcaggatccttcaacagtttgaagacgccccccgcctctccccaagaggaactgaatcagcatgaaaatgcagtttcttcatctcaccatcctgtattcttcaaccagtgatcccccacctcggtcactccaactcccttaaaatacctagacctaaacggctcagacaggcagatttgaggtttccccctgtctccttattcggcagccttat

SEQ ID NO: 551551 - DNA, 122 bp, Homo sapiens
cagtaaaatggttcaatgtaaggtacggatatggtttcatcaacaggaatgacaccaaggggatgtatttgtacaccagactgtcatagaggggggtaaccccagggaggtaccttcgcagt

SEQ ID NO: 551552 - DNA, 164 bp, Homo sapiens
ccctaaactgagtacgattagttggcatgatctatccgccttaggtattgattcctctcatggtacctgccagggtcgcagccatgccaaccttccattgttgaggatgtgcgacttgctaccttaaagccactcccaagctcaccctgcacgttctccgatgg

SEQ ID NO: 551553 - DNA, 389 bp, Homo sapiens
ggaggctttggcaggccggctgttgacaaaatctgtctgtttaaactgagccttcttgtaggcatgatgcaggtgcgtgtgtgcccacagagaatacagaaggacggaagcagctttactagctttgttggaggcataggcatcgcctgcactaatggccataattttctggatgcccacgatgtttagaaggtcgcgtgcattctggcaactgatttggattatgttgttcaatgtgtaacaggcagagactgtagtttcaatgagaaggtcagtactcgggactgtgtcagaaatgatggaaaccaaatcagggagagcttctttggcaatttcattctgcagagaaagattccgagacagattcctcagcagcgagatgactgtct

SEQ ID NO: 551554 - DNA, 142 bp, Homo sapiens
tttttggggcccccttgggttttttttttggggggggccggttttaggttttaggtttttaaaaccgggcctttttatggggacccccttgccccaaatttgttccccgattttttggcccccttaaaaagtttttttggga

SEQ ID NO: 551555 - DNA, 680 bp, Homo sapiens
  misc_feature (56)..(56): n is a, c, g, or t
  misc_feature (133)..(134): n is a, c, g, or t
  misc_feature (158)..(158): n is a, c, g, or t
  misc_feature (163)..(163): n is a, c, g, or t
  misc_feature (172)..(172): n is a, c, g, or t
  misc_feature (174)..(174): n is a, c, g, or t
  misc_feature (606)..(606): n is a, c, g, or t
tcaccaaaaacgcggggccaaccggcctacatgccgccccctggtatgatcccccncgccaggccttgcacctggccagatcccaccaggggccatgcccccgcagcagcttatgccaggacagatgcccccnngcccagcctctttctgagaatccnccgantcacatctngntcctcaccaacctgccagagggagcccacgagctcaatgctgtccacagcgttttcaaatcacgttcccggcttcaaggaggtccctctggaacccgggcggcactgacatctgcccttcgctggagagtcttgaccaccacatagagaggtaacacacaggcacggggcacagctcgcgaatgccctcgcagggctttaagatcacgcaggacacgccatgaagatctcctttgccaagaagtagcaccttttccccccatgcctgccccttcccctgttctggggccacccctttcccccttggctcagccccctgaaggtaagtccccccttgggggccttcttggagccgtgtgtgagtgagtggtcgccacacagcattgtacccagagtctgtccccagacattgcacctggcgctgttaggccgnaattaaagtggctttttgaggtttggtttttcaccaaaaacaaaaaaaaggacgccgctcgcgatctagaacta

SEQ ID NO: 551556 - DNA, 692 bp, Homo sapiens
  misc_feature (56)..(56): n is a, c, g, or t
  misc_feature (133)..(134): n is a, c, g, or t
  misc_feature (158)..(158): n is a, c, g, or t
  misc_feature (163)..(163): n is a, c, g, or t
  misc_feature (172)..(172): n is a, c, g, or t
  misc_feature (174)..(174): n is a, c, g, or t
  misc_feature (314)..(314): n is a, c, g, or t
  misc_feature (618)..(618): n is a, c, g, or t
tcaccaaaaacgcggggccaaccggcctacatgccgccccctggtatgatcccccncgccaggccttgcacctggccagatcccaccaggggccatgcccccgcagcagcttatgccaggacagatgcccccnngcccagcctctttctgagaatccnccgantcacatctngntcctcaccaacctgccagaggatgactcaacggagcgtcatgactgtaccattgcatgtctctcaagtgccagtcttcccctgagcctcttcataagtgacggatccgttcgtggtacccgggcggcatgacatcgcctncgtggagtgacaatgaggtacaggcaggggcagctcgacgagtgcccatgcacgggcttcttagagactcagcagcagtaaccaaacggccatgaagatctcctttgccaagaagtagcaccttttccccccatgcctgccccttcccctgttctggggccacccctttcccccttggctcagccccctgaaggtaagtccccccttgggggccttcttggagccgtgtgtgagtgagtggtcgccacacagcattgtacccagagtctgtccccagacattgcacctggcgctgttaggccgnaattaaagtggctttttgaggtttggtttttcaccaaaaacaaaaaaaaggacgccgctcgcgatctagaacta

SEQ ID NO: 551557 - DNA, 665 bp, Homo sapiens
  misc_feature (56)..(56): n is a, c, g, or t
  misc_feature (133)..(134): n is a, c, g, or t
  misc_feature (158)..(158): n is a, c, g, or t
  misc_feature (163)..(163): n is a, c, g, or t
  misc_feature (172)..(172): n is a, c, g, or t
  misc_feature (174)..(174): n is a, c, g, or t
  misc_feature (314)..(314): n is a, c, g, or t
  misc_feature (591)..(591): n is a, c, g, or t
tcaccaaaaacgcggggccaaccggcctacatgccgccccctggtatgatcccccncgccaggccttgcacctggccagatcccaccaggggccatgcccccgcagcagcttatgccaggacagatgcccccnngcccagcctctttctgagaatccnccgantcacatctngntcctcaccaacctgccagaggatgactcaacggagcgtcatgactgtaccattgcatgtctctcaagtgccagtcttcccctgagcctcttcataagtgacggatccgttcgtggtacccgggcggcatgacatcgcctncgtggagtgacaatgaggtaacagcagctccgatgcctgcacgtttaagatcacaaacaacgccatgaagatctcctttgccaagaagtagcaccttttccccccatgcctgccccttcccctgttctggggccacccctttcccccttggctcagccccctgaaggtaagtccccccttgggggccttcttggagccgtgtgtgagtgagtggtcgccacacagcattgtacccagagtctgtccccagacattgcacctggcgctgttaggccgnaattaaagtggctttttgaggtttggtttttcaccaaaaacaaaaaaaaggacgccgctcgcgatctagaacta

SEQ ID NO: 551558 - DNA, 339 bp, Homo sapiens
  misc_feature (7)..(7): n is a, c, g, or t
  misc_feature (20)..(20): n is a, c, g, or t
  misc_feature (147)..(147): n is a, c, g, or t
  misc_feature (188)..(188): n is a, c, g, or t
  misc_feature (240)..(240): n is a, c, g, or t
  misc_feature (285)..(285): n is a, c, g, or t
atttctnccttaattttgtnagttacccagtagtcattccggagaaggttgttcagtttccatgtagttgtgtggttttaagtgagtttcttaattctaagttctaattgattgcactgtggtctgggagggtgcgtgtaatgattnccattcctttgcatttcctgaggagtgtttcacttctaatnatgttgtcgattttagaacaagtgctatgtggtgctgagaagaatatatatngttgatttggggtggagagttctgtagatatccgtagggaatgtnaggattaaataacaaggtactcagcacatactgagcactctgtaaacagtttgt

SEQ ID NO: 551559 - DNA, 802 bp, Homo sapiens
gaccccatctctacaaaaaacaaacaaagaaattaaccaggcatggtggtgcgtgcctgtagtgtcaactacttgagagtctcaggcaggaggatagcaggagtccaatagttagaccctacagtgagccatgattatgccactgcaacttctatccgtgggcgacaaaagtgagacctgcctcgaaagaaagaaagaaagaaagaaagagagagagagagagagagagagaggagaaagaagaaagcagagcaaagaaagaaagagagaaaataaagtaaaattaaaatttaaaaatacaatgtgagtagaaaactcatttctataaagaaaagatgaagtggctgcaaaaatcaggcaagcagcagtgcatttatgatcaggggagcatgtgagatattatctgaaaaagcaaaagtcaagaaacaaggcactagatttatgtcacgtgggaaaagaagatgtcacaccattcagcacagtaagagaaaagagaaccaaaaggtcagcaaaaaactctatgtattaacgttaattaaaaattaagtgtattaactcccctctggtttgaaaaatctgaaatgtgggtgataacgaaatagtaagaatggggtattcatactaacttaggaaatgtgggctttgggagaaacactccatttttctcatagaaaatacttcctaaagggggcatatttggtggcatgacaggaactttgacaattggtaaacattcacgaaagatggggggagatagacgaagtttaagaatctctgggagagataggccattagggaccaa

SEQ ID NO: 551560 - DNA, 300 bp, Homo sapiens
gctgaggcgatgcgctgcgcatgcgggagtgcgcgcgctcgagcggaggctacgtctttgtacagagcatggctgcaggacaagctgataaggacagtgagagagacaatgctaacgcccatctctctcacagagagctgggctacagactgctgtgacccgtatacacagacactttacgactaccgccacaagccatggacagcaggttgtcaatgctgacgggttcagtggttttattctcgagaaccttactgccaatgtgctgaagataggcacgaatgcgtttcggctcgtgtg

SEQ ID NO: 551561 - DNA, 886 bp, Homo sapiens
acaaagtgtctataacatcatttcttgtcctgggatgtattgctgacttctttataatgaatctgatcctctggggagaaggatcttcagcagctattccttttgggacagtggttgccatatggcccttggtgctgcatatctgtgcctctgacgtctcatggtgtataccttggttttaagaagactgccattgaacacccagttcgaaccaatcagattccacgtcagattcctgaacagtcgttctacacgaagcccttgcctggtattatcatgggagggatttgcccttggctgcatctttatacaatttcttcattctgaatagtatcgggtcacaccagatgtatacatgttggttacctatttcgtggtgttatcatttggtaattacctgttctgaagcaatatatcttccttgtctatttcccacctaatgtgcagaggaattatcattggaatgggtcataccttagagtggttttaatgagttaattcttatctatgcagtacactaacttcttttcaaaatgcagatcacgggaacagaagcacaattcttgtaatttggtatacaatgataatgggtggatcttctttcattttgaacaggaccaattgtttcttgcatgttttggtgtgtaacaaatatcagtgtggtgaaggtgattgagactcagtgtgtccagttaagagagaataattaaatttgataacaagacgtctggatgctgagttatagaatatggctagtatctcagaacacggaattagatattcttaattccgaggtgtgtacgtaagctgttgtgtaatttgggggccgcacaatattgttgaaggtacattgggagaaataggaggtgagggggattatttatgg

SEQ ID NO: 551562 - DNA, 285 bp, Homo sapiens
gacatggtggcatgccctgtggtttcagctactcagaggctgaggcaggaggatcactcgagcccaggggttcaaggctgaagtgagctatgattgcaccagtgcactccagcctgcatgagacattgggaccttgtccccacccccgaaaaaagaaaaattaatcaggtcagatgcgatggcttatgcctctaatcccagcactttgggaggccaacgcagtaggattgcttgagagttaaggagtttgaaaccagcctaggcaacataaggctctgtctccac

SEQ ID NO: 551563 - DNA, 507 bp, Homo sapiens
ttttttatgttatgaatggacgggtctgtgattttttttttcaccacgctgtcaccaactgacgcggtcgatgccatctgaagccaaggactcgtggcctcaggtgctcctatagcattgagtgctccaaagcgctgaaatgacgggctggtcacaccgtccctggactgagccgctgaagctaacacagtgaccattctaagggacagctacccaatgtgggcactaaaagcaactccctcaaagttagaatattacccgaacggctccaaaaccaccgagcttttccaccttacatactcaaatggctctcgcattgaaacgcactgcaaacgaaccttacatgccctggtgtagagccattctcgctgcacttagaggcagatataggcgccttcctggcaacgaactcctactgcgtaggttgccaagaggagaagcaaagtcgtcacttgatggagtgagcattgatgctatacccaacggtctcgagcttgatcgactttt

SEQ ID NO: 551564 - DNA, 195 bp, Homo sapiens
tcgacggtaccaacactgacaacggctagaaaaccaaaaggtctgtagagtcagaggcaggcacgagattgggagagctggatgacggtttgtaagagaatattaagggtgtcagtcttcctgtgtatcctttggattctgttatgctgttgcttgtagacgggaaaaagttcatggtgtcatttatattacaag

SEQ ID NO: 551565 - DNA, 864 bp, Homo sapiens
ggctccagccatgctctccgtcctcgcccggcctgtcagcgctagctctccgtcgaagcttcagtatcctcgggccgagaacaatgctacaagtagctgtgtctaggggcctctggagtgcatctggggtagcccacatttcacgtgtctccttgtaacgaaaactagcccctatgtgctgaagccgtcttgaccccgtcttgattggattatcagcgcgacactacctcgggagatggtctcagcgagattcttgagacccactatcgaagaccgaaaagctcggcttgatgaagaggcgtacgctgcggtaccttgatacagcatgcctggacatgccgtgagaaggtgagtcgaatgtgcgtatgtcattcacgaggttggatgtccctcagaaaagccgaggcgaatgacgccagggacgtgagctgattcataaaacagatagccaccgatgtgtaggacatcctcatgtagacagcatggatctgtgcaccagctactgcaccggaagccatgatctgcgtctcattggcaagtccggttaaattctcacactatttcactcatgcaagcaggcatgatatgtttgtgcaagaaggcaattggaggttgtacagaaccaccaaatcgagaaatcgttcgggcgtgaagacccgtggacatcgtccagagcccaacaccttatgttcgccggaagctagaagcggtttggtgatccatgtgcgaagtcgaaccgtccgctgtcattggggtaggcgcatggctggggaaagaaccatcatccccctggatctctcagtgcaacccccgaaggtgggacatttccccaggaccatggtgacagaactcactgggacggac

SEQ ID NO: 551566 - DNA, 1873 bp, Homo sapiens
gagaccacatgttattatgcaaattatcaggcttttaactctgcttgaggtttgggccttatgaagatcaagatttcttaggcatttatataaaaccactttcttatttctggttttatatcaacaaccacataacctagatacgaaaggagcattctcgcggatttagtgttgacctaagttaacagacttttaaaagacagaactcttacaaaggggcttgagtttttttttttttttgctttttggaagacgtttaaatttagggtttccagaccctgaacctcaatagtgtgcagtagatttccaaagtatgaatcttagaccttgaaaaattctgtatctctgaccttaaaagttttgattattttattctgtttccaaagtgtataaccagttctccaagttctaattggagagctcattagttatcagcctcacagtcacggactctgggatgtcttatttcatatgcctgtaaatttgtgacttgcagtgtgactggccttctcctgtgtgtttatgtagcacaaccacatttgtcttgttggaaggagagccaggtatcatagacagcacattcatttagagccagtcttgactttagattgacctccatgttctccagggagaaaataattatgcaactgtgaacagagaaaaagggcaaggcacactaaccaagggataataaggatgtagtggcatttctaactctgtatttattggttttgtggttttgagatagatgcttaatgttatttctgggcagtttttaaaaaagagatgaaatctccagtgtcataaagactaatttcttcttattttttctaccttaacatcccactatttccaatggcaaaaataggaaacaactgtgttatttaaagtgacttataaatattttgaacaaatcctctgattataataagcctttgctttattttttaaaagaacatgttctgcattcttttctctccaacacagaagtcatatgtgaggcattaatggagggtgggtttactctttcaggccagtagggcattaccatggctgctttaaacttacacggttttttagactcctgaaacagctaacgtcactcatcacacacctgccatactagctgggagtgacttaggcacggcggaaagtctgactcactaaatgtaatgaatgtgactgccattattgagttggagagcagccgaggaggagggattggttcatggtacgtgttgaaaatctgtaaagtcagattttattggatcagtgtggaatgggaattccagagagcagagccttccagaatatttgcagtagaaatatatgtatggccccactgatcactggtagaaaatcagctttgaaaatctcagggtaacagtgactattgtaatctgcatttctgagacttgaaatatttggatggttatgagctacattggaatttacacgtatcagaaatctatgagagtaaactttgaaatgatctttatatctgtaagaaacatttataacacttgtgtcaagacgtatctacaaaaatatttattagaaacacatctaaaaattctaagtacctaagattattaaacagtgcacaaaatagggacagtgtaatacctttatattctattgcatgagtctcatttaatgctaatagcctgcattcaattcagtagttcaattagtctgacatttaaaatgatcatatgtagaggtaataagtgaaatgaaaccgttataaactcaaaatcaagaattttaattccaggccttcctgatgataatgaattaagtaaattattatatttattggatttatctgtatcacaccatttagcaaaagaaagtatctgagaccatttac

SEQ ID NO: 551567 - DNA, 669 bp, Homo sapiens
tcctgagatgggtactcactatattgtccaggctagagtggggtgggtattcacagattcgaacatagtacactgcagcctccaagtcctagcctcaagtgatcctcctgtatcaacctcccaagtaggattataacgacagtgcgccgacgatgacccagaatccacgaacttggtctatgactctccccaataaactagatctgaacagagaagtaccttcacccagaaaacagggaaagccatggaacgtgaggtacatgggtcgtattaccaattcattgggtccgaagtttcacacgggtccgtgaactgggaaaaagccttggcgttacccaacttaatctccgttgtcatatatcccccgttacgtcaggtggatgtaataggcaacaggcccgtaaccgatggcccattccgcaacaaattggcgagctgaaatggcgaagtggcaaatggtcagggtgccgatagggtgacaatgcgcgcttgaattcctgtcgacaacgggggcaaaccataagcggaagggccggaaacacgggcttgcctgtcataagcaacagtgcttggccccgagagacacggttcaaccgctcggtccactgttggcatcccaggagttctccctatagcccggtggcaccccacaacgtcccacgcggcgcc

SEQ ID NO: 551568 - DNA, 347 bp, Homo sapiens
ccgcagtctggcggcttggcctgtttcacgcccccagcgccgccgcccttcctgagtggagatgaggatcccaaggcttccacgctacgtgttcgtgatctcttggctcctatcgcatttcacgggaaggtggctcgggcgtacagcaaccttcggtggttggagaacaatcgcccactcctcatacggttcttcacaacttcatgttcttctatcgtgccttttaatgcgaagtcatgggacctgccctcgtgcctggtcaccccctcggagcctgactccctcacctcccgatcagactcccctatgcacgcctgccctttagagctgggcaccaccccatggga

SEQ ID NO: 551569 - DNA, 280 bp, Homo sapiens
tcccccttgtttcgggggaccgtcgtgtcagcactgtctgcagtgatgtcttttgtgtctttgatcgttacttcatggtcttgattgtatctcctttgtgagcggcggtttggctatgttgtctttcaatactatttcccttcttccgtgaccacgatgctctcctgggtttccttttgaatcaagacagagtctgctccagcccggacctctctagcctcgtatcaatagccgtgcccatgcccgtacatgcaagacatgcaagcccggtacatgcaag

SEQ ID NO: 551570 - DNA, 138 bp, Homo sapiens
agcctatatctaccttcggtctatattctattactacctatttattaatgactagcctgttgtaagactttagccatccatgtattacatgtatttcagacctaggtgatcacattaagatctcataatattctaaga

SEQ ID NO: 551571 - DNA, 310 bp, Homo sapiens
gggggaaaaaggctaaggggggggggggggggggcccattttccatttttttccccgggcaaattggggtttttcccccccggtttgtgttcccccaaacccccccgggggggtaaaggggttttggtttttcaaccccggaaaaaaaattttttttccctttttcccccccccaagaaaaggggggggggggggggaaaccctttttcttggggggttttttttttttccaaaagcccccttggttgggggggggaaaaagggggttttttcccccccgggttttttttttaaaaaaattccccccgga

SEQ ID NO: 551572 - DNA, 210 bp, Homo sapiens
tctcttcatggcgagggggtgatctaaaacactcttatacgccggacttctattgactatgggttaatcgtagtgaccgctgtggctggcacgacattgacccaaccctggggttagtatagcttagttaaactttcgtttattgctaaaggctaatcactgctgtttcccgatggggatgtggctacggataagccgttttgagctgca

SEQ ID NO: 551573 - DNA, 877 bp, Homo sapiens
attgattctttaaataagtaaccaagagttagccaggaaaagaggggtggaatcctttcttagttattttgcattatagaatctaatttcttctttatcataactctgtaagaagacataattgatttttgatattgctatattattttctgtataatagaatttataaaattatacttagaaacaactttattagttaggctgttgagctctagacagacagtgaagaagattaagtgtggtaaaagaagaagcatcagcaccagctggtgccctaatttgcatcttagcatccacttaactcttttttcgccttttctgccgtatttaaagagagctactttgacctctcttgctctcatacactttctctgttgagattccctccatagcagcaaactctgtccatatgcaagatatataaatttttctattggtaatgtatactggatgcattttatgttgcatttattactctctctttataggaatgcttgtgtggaaagtttcagtgttggagaatgtacaagagatacctgtatttggacattgtgcctgctattatttcaacgctagtcgaggaccaaatgtttggagtgtggaatttcccgggaagatccggatggtccaggatcctgcgaaggactaacgaagcccaaaaagtggtgctggaaggaatacaatatttttattgacacgacgacgcaagtgcacacgattagcatgcagggatgctacagatgagacgcaccaagtataaggagggaaagcaaacgaagaaacagcaaagggaccaacgaggccaccaaccaccaaagggccagatgagaaagagaggagagacggttacagggacgaacaatgagaaaagaggcaa

SEQ ID NO: 551574 - DNA, 331 bp, Homo sapiens
aaggaacaattgagacgctatagctagagtctaaggcagcagtccgcaatcttttggcaccaggactggtttcgtggaagacagtttttccacggatggagaggatgatggtttgggataaaactgttccaccttagatcatcaggcattagttagattctcatgaggagtgcgcatcctagtttcctcgcatacgcagctcacaacagggttcgccctcctatgagaatctaatgctgccactgatctgactggctgtggagcccaagcagtaatgctcgctcatgccccctaccccaccttctgctgtgctgccgttaggccgatctga

SEQ ID NO: 551575 - DNA, 286 bp, Homo sapiens
gctgtgctggtgaggcagtctggaccagtccactggctcacagatgttcgtgacgagcctggtcaaatataatatagatcccagatctcctaggcctctagctaccaggcagagggcagcatgccggtgtgtctgctcaggtgttcattgagatgtctggggtgtggaggttgggagccttctgtggcccacttgggaacccacgtgttctcgccactcctgactgccagctgacagaaagcacgggcagtcagcacatgaagttgctattaaatggacttcgtga

SEQ ID NO: 551576 - DNA, 439 bp, Homo sapiens
  misc_feature (415)..(415): n is a, c, g, or t
agcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaangccctaagaggggtccctgctcca

SEQ ID NO: 551577 - DNA, 90 bp, Homo sapiens
ggcacgagcacaaccgtcgtccacatgatgccaaaccagtcccccactggaacacgatgccactcgctgtagcagctactgcatgcctca

SEQ ID NO: 551578 - DNA, 333 bp, Homo sapiens
gggcacaagctcgcatccgtccgccgctccggctaccagcagcccgagcaccagcaacgcagcccagcgccgccgccgcagcagccagccccacgctgggccaggagtcgaggcgggatgaaggcgccgaggagaagccgggtgaaagcgcagcggcgccccggccgcctgcagctcgccggctccgcgaggcgccaccaccgccgccggcgactcctccggccgcccccgccgcctcagacacgggctcccgccgggcgccagcctggtcccatcggcaccggcggcctccggagctctgatcccggctgcgttccctggttccggttattt

SEQ ID NO: 551579 - DNA, 1323 bp, Homo sapiens
  misc_feature (579)..(579): n is a, c, g, or t
ggcttcgaacctgagtgtgtcctgaatgagtacacctaccccgctgagagtagccatggggaataagatgcggatcaggttagggatcttcgccagtgttctattcgaggccagtgcatgcgaactagtgtgttcgctctgaatccatgagtagcatcgcttcgagcgagatctgacaacaaaggagtccagatattaagcatagtttgcatgaccgggaggctgctgcaccagtgtgatcatgcggttccctgccacgatcatgctctcgtgtctcttgctgggtagagcccggtacatgcatgtatccggtgaacgttgatattcatgcaagtacgtgtcttgcttagtgtgaatattagaggtatcgacaagtaccccattgtcgtatcaacctacttggtggaccttttttgcaatgagtctcgtcccacgcacggggactcatccaggacgtagcgtctataattacacggcaggtcccatagttactctaagcaagggagaacaatcattccattgtctagagtgctgctggctagagtgcgtcgcatctgtggggctagactgcggtggtangcggagagacgttttccaccgctgagttctacttcccacaaagagtcgtggttgatcactcgcagaggaagtcgttcgtcgccatgtcgtagggtcgtcaaccacgacttgtggttggttcgaagaaaccgatgcttagactgttgttcccgagtgcttgaaaacaagacggttggcatccgtcacttcgaaggaactattactcgttcatagatgcaacatcaaaggtcacggacctagtgagaccgcgagaagatactctcggtcaatagggagataccgctttagagacaagccctaagcgaatttttcatttagaaccagtgttccagaaggggttagacacaaaggcctcccccccaatgggattggcggcacaagagaggtatcttcgcttagccgcgaagctgtctatcccataagagaggcaagggagcctcgttgttaattacaacggacttgtcgtggagcgggctccgtggatgcctttgtggcgatggctctcgggtgtcgcttaccgcttatttgttcaggaatgttcccattctcccgttgatatggatacattgggcgcgatgggccactttgttactattctccccgtcgatgacgatggagcgcctgtcctggtgggcctcgcgagttaccgttaacctcctgggaggctttcgtgtggcagggctgctttccaaagagccgcttttttcgccccgtcggccggtccgtgcgaggggatctgtccca

SEQ ID NO: 551580 - DNA, 287 bp, Homo sapiens
gcgaagcacgtggatcgcctggggtcaggagatcacgaccatcctacctaacccagtgacatcccatctctactaaaagtacaagaaattacccgggcatggtggcatgcgcctgtaattccagcatactcatgaggcagaggcaggagaatcgcttgggccagagaggtggaggttgcagtgggccgagatcgcaccactgcactccagcctaagcaaccgagcaagactccgtcttgaaagaaagaaaaagagagacagagcgagagagcgggtctctggcccag

SEQ ID NO: 551581 - DNA, 316 bp, Homo sapiens
tcttacgccaacaacatcaacacccacgaaggcggcgcgcgcgtttccggtttccgcaccgccctcacgcgcgtggtgaacggtttcggtaaagagaacgacatgttcaagggcatggcggagcaactcacgggtgacgacatccgcgaaggcctcaccgtggtgatctcggcgaagattcccgatccccaattcgaaggccaaaccaagaccaagctcggcaactccgaagtggagggtctcgtatcctccatcgtgagcgagaaactgcgtatttacttcgaacagcgcccgcagatcgccaagaagatcattc

SEQ ID NO: 551582 - DNA, 182 bp, Homo sapiens
  misc_feature (164)..(164): n is a, c, g, or t
tgtgctgcggtgctctcgcaggctccccagcggggcccaatccattggtggcttttccttggctgtcacatccagctttttccattccaggtccatcctcattggttccactttggcgtcaggtggcctcagccaacacagtgcattggttccgccggctgggntcaccggcagctcgcaca

SEQ ID NO: 551583 - DNA, 235 bp, Homo sapiens
tagtatttatagtttggtctagtcagcaacgctaagctgtctgttatcgctcttgtcacagggtcttgccaggtggggatgccacggtcagtccttccagtatagaaacacgaagcctacgagccttgctcctaagtaagcttgaattctagacatcttcacgcattgccactcaacaccagtccccaggattcaagccctaccaggacctgtcatgctatatctattccagcgt

SEQ ID NO: 551584 - DNA, 714 bp, Homo sapiens
  misc_feature (505)..(505): n is a, c, g, or t
  misc_feature (515)..(515): n is a, c, g, or t
  misc_feature (614)..(614): n is a, c, g, or t
  misc_feature (640)..(640): n is a, c, g, or t
  misc_feature (642)..(642): n is a, c, g, or t
  misc_feature (654)..(654): n is a, c, g, or t
gtggtccggtaccccgttattagctgggcaatgtggcgcacacctgtattcgcctgctagttcaggaacctgagatggaagaattaattggggcccccgagtttcaaggctgcagtgagtcgtgagtgggcccactgcacttccacgccggggtgacaagaagagaaccttgttctcgaaaaggagatttttggaaaccaccatgggacccatgcctttcataagttctagaaagttattttcacactgataaatctatattcaccccaataatcaagggtgtaaggcttaaaataatacattttgtagacacagccaagacttcacggggttacctcccactgggccctcttttagggaagtctgcttgggagaaaatatctccacgccaaatgtaagagggagtatcacccaacctacgaggagatgaagcactgtatcccacgccaattatggagtcccaacaccacggcatattccagctatggagctagctttaaaaggnacagtaaaantattaatcggttagctgggtggaatggcccatgcctgtagtcccagctactcaggaggctcagcagcaggacgacttgagcccaagagttccagaccancctggccaccttagtgagatcccttntnttaaaaataatnacttattgccagatttggggcatttggaaagaagttcattgaagattaagccaaagtata

SEQ ID NO: 551585 - DNA, 84 bp, Homo sapiens
  misc_feature (68)..(68): n is a, c, g, or t
gccagcaccaaccagacatctatgtacctctgtgccagcacccgccccgggcagggttcctctggaancaccatatattttgga

SEQ ID NO: 551586 - DNA, 940 bp, Homo sapiens
ttgtcccgtgcgcagtagtttcccgtgggccctcccctggccggtgtgagtggacctgtgtgtgttaaaagagggttacgcccgcgtgggctgtctacacggggactgtagcccccgtttttggaccacctgggctgtatccctccccccacaagtttatctctcctgcggctgttgcgccgcgcacccctatgcccccccgttgggggagaccgctccccctgttgagacacacaccttgtgtggctgagagaagttcgggctgagggaactctctttcctcgggtgtataattctcgtcgaggagttagaaaaataaagatcacaatgtcctcgggaggaaaacacccgcccccatggggaacctcccccccctcctcaaaagtgtttccttcggttatgctatttcaggcccttctaaacttgtcccactggccccctgggttaacccagaacaacgctgcgcaccaccctgcactcgaggttgttcaaaacacacattccttcctatacacaaaacaaaagcccccttaaatatttttttccgtgaataataatctcctatgacaaatatgttcctgccaaaaggagattttctccgcaattattgtgttttactgaagtaacagtagttctttctccccccgcatctatcccaatagtctcttgtgcatcaacaggggtcgattcatcgccgttaatccccccgcgactctcctcctcgctatatctcgatatttctccgccattactgcggatagaacgatacagacagaccagtcacgctcatagtgagtgaccaccccgaggtgagtgaggcggagctagcctcctacgcggcaagcccagaaaaagactctgaagggcacgacgaagtcagatcgaccgcgtagtatcgcccgcgccccactttccctcaaaaagcatacattacaaaaag

SEQ ID NO: 551587 - DNA, 466 bp, Homo sapiens
  misc_feature (13)..(13): n is a, c, g, or t
  misc_feature (27)..(27): n is a, c, g, or t
  misc_feature (202)..(202): n is a, c, g, or t
  misc_feature (257)..(257): n is a, c, g, or t
  misc_feature (267)..(267): n is a, c, g, or t
  misc_feature (366)..(366): n is a, c, g, or t
  misc_feature (392)..(392): n is a, c, g, or t
  misc_feature (394)..(394): n is a, c, g, or t
  misc_feature (406)..(406): n is a, c, g, or t
ccgctcgaaaggnatctgaaacatggncctgccttcataattctagaaagttacaactgataatctatattcacccaaataatcagggtgaggtaaataatacttagacagcaagactcaggggttacctcctgtgcctttttagggagctgttggagaaatactccgcaaatgaggagtacacaaaccgagatgactgaanccagcaataggatccaacacggcatattccagctatggagctagctttaaaaggnacagtaaaantattaatcggttagctgggtggaatggcccatgcctgtagtcccagctactcaggaggctcagcagcaggacgacttgagcccaagagttccagaccancctggccaccttagtgagatcccttntnttaaaaataatnacttattgccagatttggggcatttggaaagaagttcattgaagattaagccaaagtata

SEQ ID NO: 551588 - DNA, 83 bp, Homo sapiens
aattcaagcttctaacgatgtacggggacatgagataatgttagaggttttaaagtgattaaacgtgcagactatgcaaacca

SEQ ID NO: 551589 - DNA, 795 bp, Homo sapiens
cttgtggcctatgtcctcctggagcccgaggagggcgggcgggcctaccgggccctgcactgccctacaggcactgagtatacctgcaatggtgtaccccgtaccaggaagccctggcctgtgctggagccctacgctgctggcttgcccccgcacaagcatgtgggctcgtgcccactgaggtcctggctggtacccatgctcctctacgcctttttcactctggacccatggggacatgcacatgcctggtgctgaagcctgccacctgtatccctgagcctgagtgctgcctgtgctcttcctgccagatggccacctgccctggctgcactgtcaccaggcacggtctggtcctgcgtgatctcaagcttgtgtcgctttgtcttcgctgaccgtgagaggaacgaacgctggtgctagagaacctggaggactcctgcgtgctgacttgggccagatgattccctgtgggacaagcacgcgtgcccagcctacgtgggacctgagatactcagtcacgggcctcatactcgtggcaaggcacgcctgatgtctggagcctgggctgtgggctcttcaaccatgctggcctggccatacccccttccaggactcggagcctgtcctgctcttcggaagactccgcctgtggggcctacgccttgcttggcagcctctcggccccttgcccggtgcactggtgtcctgctccttcgtcggggagccacgctgaacggctcacaggcacagggtcttcctgagcccttggttggagggaccggtgcctatttc

SEQ ID NO: 551590 - DNA, 1009 bp, Homo sapiens
gtgccaagggaaagttttggaaagcttttcaaaagaagatctacggctgagtgcggtggctcatgcctgtaatcccggcgctttgggaggctgaggcgggtggatcacttgggacgaggagttcaagactagcctgggcaatatggcgaacccccgtgtctactaaaaataccaaaagaaaaaaaaaaaagccaagtgtggtggcacagtgccaggctgaggtgggaggatcaccttgagcccgggaggtggaggttgcagtgagctgagattccaccactgcactccagtctgggcaacagagtaagacgctgtcccccattccttgcccgccccttctcaaaaaaaaaaagatccggggaggcaaagggtttataattcagggaccctacaatttacagggatattgaggccttttcccataatcagggttgaagcagttacaaattaattcacagaaggaggggagtacggcttgacaccagccatttttattattttctggacaaggacttcctggtacaattttgttggccaatgtttaattgctagaaaactggctgtgggaaatggggttagaagcgttggatgttgtagaaaaccaatctgtatattaatgtttacacaaaaagttatcctccaggaaaacagcaaggggaggcggaccagacacttaaacattaaaccccaggtatggcacgcatattgcaggactctatcaactgacaggttcaggactcaactcttgtggaccacttggtattccacatcatatggccaaattttaaagcacgcctggtgggtgatactttaacacaaatttctgccacgtagacttctcggtgtaaccaaaaggatcatacaggctggcccctataaaaggggcctttcatacagaatctcacacggtttggacacatttttctacaaacgtggtctaagattgtttcccattgtggagaaatttccccctacagaggttccgtgcgtataccacaatggaagactg

SEQ ID NO: 551591 - DNA, 2567 bp, Homo sapiens
agaacagggacgcaaagttgagtaattagcaaggagaccagttagaaggccactgcagtaatctaagagagacaactctagcttggaccggtgtcatggtgatggggatagtggaaaggagttgaattctagatatattttgattgcatccacaggatttgctgataggtagcatgtggaatgtgagagagtggccaagagtgactccaaagtttttggcaagtgggcaggtgaatatatggatttggagctcaagggagcaatccagcctagagatacaaatttggaagttgtcacagtgcagatggtacttaaaatcatgagaccagatgagatcaccaaggaaatgcaaatagatagaaaagagaagaagaccaaagcctaagccctggggccctccaatgttaaaaggttgaaagatgaggcagaactagcaaaggacactgagaaataaataatgagatataaagagaaacaagattagtaagtatgcatcatgtgccagacaccatgctccagacaaaggatgcaaagacaaacacaaccccgtcctcatcatcctcatgctctaatgcagcagtcaggtactacaccttgaaataccattgtgattggttcagggataggtgtaaaatgtcagggacagtgagaccacaaccttgttacttctgtgaatgattacacacacacacacaatcagccatacttgcctcttctgagtgattctttttgtttatttattcttttgtctctaacaggcaattggttaccaaaccttgaagaatctacctttgtaatatctcttatatgtgacacctcctgtccattttctcagccaccagtctagatgaagccctcattaaagatcacctgcagtgttgcagaagctcctaaacatcctcgttccctccctttaaccctctaatcctacttttttcattactcttcttcctcgcagttaactctcctgagcaaaagtctcaccacctctaggatgcagcccaggtgcctaaacccgttattgaaggtgctccacaaaccgatactaccctgccccgccagcagtgtcttcactcttcccagtgttctctgtttcctggacactcacatccatgcttggtatcacactttagcctgtgacacagactcccacctggaatgcctatctctattccaaagtgttcatatgccatttccttcacaaagcttttcccctgctgtagcctgcatggttgtctgtgtctccaaattgctgtatcacttggagtctctgacactcatttttgtatgtaggtatacgatggcacgagtagtcactaaaatacattcatattcactacttcattcactttcatttaaatgtgcctcctccttttaaggataagcaactttccgtgcaaggcatgatactattctaataatagattctaaatgaatagatgttagattttttttaaaggtgagtaaatatataaagtataagactgtaataaaacactttgtcgtatgcaagttctaccaagctccaggaatatagtcatgaaaataattcaaataaagtatttactcttttaataaatagttattaagttttatgtgccagccatgtgcaagacactaatgattcaaaaataagtcataattccaaggctcaagaaacctgtaatctaatgagaaagacatacagatcgttataatataatctgacacctgtagttgtagatatatctatgagtgcatggaagagaaggcttcctggaggaggtgatacatatggtgattctcagaggatgagtagtagttcgatacagtggaaattgaataggaggaggaacagcataggcagagggcacagcagtggaggtgagaaaggcatggtgtgtggagatggggaggccagatgatggagagccatgtatgtcctgttaaggtacttgaattttaccctgtgggtgatgccaacgatgtccatatagaaaagccttggaaggattttatgtatagaaagagcatgatcagatttgcatgtttgaacacttggacaacctaaaagatggatttgagagagaccagagttggatgcagagagacaaattatgcgccattccagtagaccaggtaagagatgctgagggcttggattaagtgaaggcagtaagagttgggtggggaaaaggagataaattcaagtatcacttatggggcaaaattcacaggatgcagtgatacagtcactgtggcagcctaggggagggtgtggaaagagccaaagatggcccttacttctgaccttgaagattgggtgagcagtgggccaccccttgcagagagacaggggaagacggcttggtttatggtggaaatgatgagttcagtttgagccatatggagtttgaaatgcctctggcattccattcaaagtaatccccttaaatggtcattgagtgactcaaatagtgctactgttcttggaacttttcagagacttctcgaaaaaccattaccaaagacattttatcagctacataaactagtcatgcattttatagacacaactctccttttgg

SEQ ID NO: 551592 - DNA, 124 bp, Homo sapiens
acacggctcttagcacactcacagaggttggaggctctcagaagctcttctaaaaaaggatacacacctttcacaagggcaaactttttccttttcccggtgtattctagtggaatggaatctc

SEQ ID NO: 551593 - DNA, 414 bp, Homo sapiens
tgtgcgggtatctagaggatcccttatatgctgtctcaaaagaaagaagaaatgaagattcggtcctcagttgcaccacatttcacatgctgagcagcagactgtgctgatggtccgtgttctcgacagcacagatctggaacatttaccccacacacagaggtctggagggcggctggcttgggacaagctctcctagcggtgtgggatgggcagatggtggtgtatgtggcaagtcaggatttagaaggaccacactggccatgaaaggtcacatcctggcagggagaggggccccgtttttcaagccttcatggctttccagctccttggaaaaggaagtctctgtgtcactctcttacctctcatgtacctctgatctttcttaggaaaaacagcaagggtggggtcatt

SEQ ID NO: 551594 - DNA, 142 bp, Homo sapiens
ctagaggatcgccaaacactgcagtctagctgaagagacagacatatagcaggcaatagttgataggctaaagcgatggtaggaatgaaagtgcacaagggcatggggggactggaagtgaagtgagacaatactgtctcca

SEQ ID NO: 551595 - DNA, 270 bp, Homo sapiens
taagagtgaatgtgcatattcatattacgttaaattaacaatatatctttcagatatagtaaactgaaagtgtacactcttctccgtgcattatcttagtatgtatgcctgcctccccatataattgactctctgtgctttttttctctttatggccatttttggttcttaacttccattcccagtgtaatgcaatctaacactttccgtgttcttttaagaagggtttgtctcagatttcttatgaacaaaaatatatggttctggtgt

SEQ ID NO: 551596 - DNA, 236 bp, Homo sapiens
  misc_feature (33)..(33): n is a, c, g, or t
  misc_feature (56)..(56): n is a, c, g, or t
  misc_feature (116)..(116): n is a, c, g, or t
  misc_feature (178)..(178): n is a, c, g, or t
  misc_feature (211)..(211): n is a, c, g, or t
cggcacgagcctggcgtgtgcttggccctcctnctcgcccacgggcctcaaatttnaggaccctcctcctcgcccacgggcctcagacctcaggaccctgccgtctcacgcctttntgaaccccaaatatctgagaccagtctcagtttattttgccaaggttaaggatgcacctgtnacagcctcaggaggtcctgacaacaggtgcctnaggtggctggggatacagtttgcct

SEQ ID NO: 551597 - DNA, 154 bp, Homo sapiens
gatacggtggaggtgagtagatgtcataacctgacccactcaccacaggcctagccttcttctggcctggctattcctgaggtctctgaagaaagctcagaaggttgactgttgcatggtttcctttcccctagtttttctaacacagaatcct

SEQ ID NO: 551598 - DNA, 488 bp, Homo sapiens
cccgacggacctactcgtggactactcgtgggacacactcactcgtggacactcacgagctcccgtctctgtcagacacgtgtacctctgctaaccaccactcaggcatctccgggaggacaggacctgtcatcttctccaagatggttctgctccacccaaaccaggctttcctaaagccccaaactccacaccggaggcaacgcctgctgaagccccgtacccgccacagcatccaccttaaccttccaaatgccactgctgtgaagaggcgccatcgcagatcgccatggcgacagagcccttctgacccaggggatccactgctctcaggcactgtccacccgacacctggtatagccgatagtacaacccaaaggtccactgctgggatcctcctgacccgtggccttacatgagccgagacgggtctgatgagcgagactctgacatatctagacaaaggcaactatatacaaccaattcat

SEQ ID NO: 551599 - DNA, 244 bp, Homo sapiens
cccccccggggtccccccaggggtcccccccggggtgggggttaccaaacaggaaaaaaattaaaccgggcccccccttttccccccccaagggtttttaaacccctttctggcccccttttttttttggccccccccggggagggcccggggggttttcccccccggtttttttcccacccttccccccccaaggtttttcccgttccccttggggtttttttttatttttgaatggggccca

SEQ ID NO: 551600 - DNA, 640 bp, Homo sapiens
gcctggctctagatgtgaccgagcttgacaagcccagtggcaccggtctcggagaatggcagcgacggttctgcatcctttacgagcacgggctcttgcgctacgccctggatgagatgcccacgagccttcctcagggcaccagtcaacgatgataccacgtgcagcaggatgtgggtggatggggagggccgcacgggccataagttctccctgtgtattctgacgcctgagaaaggagcattgctatccggtgcggagaagcaaggatgtatcgtgcgagtcgagtgagcgtggacgatgctcatgtgtctatccccggtagcaacaaggcagagatcagacagaagaaacggaatagtggagtccccccacagcacaggagcctgggcctgccaaggtggctggttaccagcagcagcagcagcagcagcatgcagcagcatccccagtgctgagaaagtccccacacacaagatccacaatctgggaggaagacatgaggaccaagggacgcagccagatggcagcagtctgagtgccagctcagagtcccagccagagccaggctcctggtgccagctccctgcgggaacctgggctagagagcaaagaagagggagagcgccatgagtagcac

SEQ ID NO: 551601 - DNA, 460 bp, Homo sapiens
  misc_feature (12)..(12): n is a, c, g, or t
  misc_feature (38)..(38): n is a, c, g, or t
  misc_feature (157)..(157): n is a, c, g, or t
  misc_feature (164)..(164): n is a, c, g, or t
  misc_feature (438)..(438): n is a, c, g, or t
  misc_feature (460)..(460): n is a, c, g, or t
cctcatatcacncctattaggggtaggaacagatgtantattatgagaaactgggtagaatttataagaataatatatggtgggtaacccctggcaaacatcaccctccctctggacatcccttaattacaaactattaaaaaatgaattagatgcnacgcaancttttgccttaagatcagtggtttcaggcccaggcaacaagtgcacgccagtaatccaagcactttgggaggctgaggtgggcagatcacttgaccccgggagttcaagaccagcctgggcaaaatggcaaaaccctgtctctacaaaaacttaggtaggcatggtgacttgtcctgcaggccagctactcagtgggctgaggtggaaggatcacttgaacccaggaggtccaggctacagtgagccgtgattgcatcctttactccagactgngttaacagagtaagaccctgtn

SEQ ID NO: 551602 - DNA, 137 bp, Homo sapiens
  misc_feature (38)..(38): n is a, c, g, or t
ttctgccctctgtattatgtggcattgccatcccatgncacatcagggagctcactcagtggttagatgtaggtggatgctggctcgggaagtcctgcgcatgtgtggccatttccgtgacacccatgggaggtcat

SEQ ID NO: 551603 - DNA, 603 bp, Homo sapiens
ttgggcatcaaaaatgctgcccatttctctgttgctcccaagctggctggcctttgcataggagcagacagcagatgcatagttgccgcgaaaggcacaacagttttcaggttttaggctgccgtctgagggaagacgcataataggaaggaaccccctcctgcttccccctattttccccccacattcgctcctagcgacctcccacccaccctactttccaaaaaccctttcgtagcccgaccgaccttgagcaatccccttgtcttccttctacgccttaccatctcatcctctcctttcccatccttcatctctcatcccctgtctctcttccatcccttcctcagataaaccccttgattctttcgctccatgctgtgcccttggccgattaatctagttatagtatcccttaaatttccacccacctcaacttctctcccaattatacttcatacctcgccctccctttctcatcctacctcctttccctgcacatcacatacttatcgctttttatctcttccctaaccttctactatacactcaccagcttctctatcttcacaacttcgctttcatttccgccacccaggtgcc

SEQ ID NO: 551604 - DNA, 368 bp, Homo sapiens
catcgcgggaggcgcatgcgcggggtatgggcgctggcgcggggccctttggaagcaagattgttccttggttcctaccttaaccaagtaaccttccttgggttcaacgggcgctttttaaaaatcctctgggaagcccctggggaggccgggaccgggtttttcaaatttcccatttctgggttttcccatttgtgggggatatgggacacttttcacacagggttcacgttttctacatcccccccacccacatacatgggcggatatttcgcatctaattgttgtaaaatgcgtaacaatgacccaaagtttgcgcgccgggatcacgggggttgccttgggcgggcggcccaccctcttacgaa

SEQ ID NO: 551605 - DNA, 236 bp, Homo sapiens
tctcaatccagtccatggtaggtgcagtaaggcatcacgatatcaaaagaacacttgcgtgacgcacaccaagtgacatcatataccacctcagtatagtacctttgataatgtgcctgaaaaatcagtgttcaggggtccttattggagctctataattagcatcctcaaccaactccatgcattttccatcaagtgctttactgtcttttatcaacctggtatcatctgtagtc

SEQ ID NO: 551606 - DNA, 196 bp, Homo sapiens
ggtagcacctttgccaaggtcactgacagtgacagcagtaaaaagggacgtatttgccaaaaacaagattggacactctctgtaaacctcactaccaacggctggttaaacatttacaaatgagagcaggttccacatacacaggtccgttcgtgggtaagtgtgtctgtctttccctcctcgaggaagcacatgc

SEQ ID NO: 551607 - DNA, 508 bp, Homo sapiens
  misc_feature (151)..(151): n is a, c, g, or t
  misc_feature (428)..(428): n is a, c, g, or t
ccagcgacatttgctagttagtttgagaaagattctaactggagcagcgcttggttggaggaggtcaattgtatgtctgcggaaagggttcagacagacttgtcatcagtttcctggcgctgaccctgggtcttacctggaaaggcccttnaaacacccaccccagggatccacggtgcagggaaggtggtcatgcagaaaacaacctctagcgagttgctcggctgaggccctctgtaggtgaccttgtcttgcctccaaaagactggacctccttttcttcttcagtggtaaaaggagtttcttggtgccaccgtgggctctgggcagagactgtgccttcctcccttttgtgtctgagtcgccccgaatgctttggcgcagggagtttgggtcagagcgatctccagccccttccagttcactgngctctgtgataacggttcctggggaattttgtgtcatgttgcttggaaaccagatggaaatagggccaattaccattgaa

SEQ ID NO: 551608 - DNA, 633 bp, Homo sapiens
  misc_feature (1)..(1): n is a, c, g, or t
  misc_feature (61)..(61): n is a, c, g, or t
  misc_feature (139)..(139): n is a, c, g, or t
  misc_feature (341)..(341): n is a, c, g, or t
  misc_feature (559)..(559): n is a, c, g, or t
naagacctcggctttaaccgtcaacgccaggttaagggttacaagcattgaggccacatcntagccattttgatcccaaagcacttctccatgattatgagagaatcatggcacatcgtcacagtgctcaggtgtccgncccgaaggattccctacctcatccatattggtccagcaatttgcgcttgtggcttcacaaaggtctgacatcagacttcaggcctgggaaaaactggtatcaaaccttcatgtctctgccaagtttttgtgaatacttgggtcaaccaaaaatccaagcacaggattatggcctgtattggagacagatgaagtcgtaagangtctgatagatggaatacttaccaataagaaaatgatttttgttccatcgtatatcaatatctttctgagactacagaagtttcttcctgaacgcgcctcagcgattttaaatcgtatgcagaatattcaatttgaagcagtggttggccacaaaatcaaaatgaaatgaataaataagctccagccagagatgtatgcatgataatgatatgaatantttcgaatcaatgctgcaaagctttatttcacattttttcagtcctgataatattaaaaacattggtttggcac

SEQ ID NO: 551609 - DNA, 372 bp, Homo sapiens
ctggaccggacttcctgtgtgtgttggtatgtagcaccagttctttcagcagagtgtacaacgttatatgggctcggcaaagccatagccatgttgcctgtttttgaatatgacacaatgctttacttcgccgtccaccactacagagcaggcatagcagccctgtttactgctctcccggacaagaaaagtgccatctcgcttccctcgcaacaggttttcagctttgtttcggttgctgcttccaacattccatgtcttctcatcatgatggggcaaatcttcatcatcttccaccagtgaatattggtcttcagtgttttcattgcccaaccactcgttcaacttcttttgccgaacacctttttgagt

SEQ ID NO: 551610 - DNA, 133 bp, Homo sapiens
cagccggaccggaaaaggcaaaagaatgttgttctaacaaatccacaaatatcactgctaaatactggggtccaagagtattagaccagcaaggttccccacacagatgctgcgctgatttgctgcatctgct

SEQ ID NO: 551611 - DNA, 721 bp, Homo sapiens
gactgcgcaggcacaacagagccgctcccctctcctcgtcccgacaccggtgactggagagcgcccgacgttgcatttctggcgatatcctcgcagtcattcctgcggcttgcgcgcccttgtagacagccggggtcctgcgtgagaccggtgcaggcctggagcgtatgtctcctgtctgtgacaggagaagagaaaaatgcaggtacactggctcacgtagtgccgtttgcattggttaggcgtttggcgtactcagcactggtgtcgcttctggtgggatcataggcctaatgtaaaagcatgcacgcgtgccgtcccatggttgcagggctgctctataggcagtctacgccgagcctgggtgcattacctgaactgtctcacggatccaaggaacgttgtggcgttatcctatgactacatctggtaccttgagcgtggcagtagtgggaattgaggttctaccacatctggacagttcagtggcctgcaggttcgaattgcagggtgccagttggctgatggtcgccaaaagtagagagtcagtatgttcgaacagagcccctattgagcaagaagtcatgtgccagcttgagactgatgaagaattaatatctctggatcttccactattttcactcatatgaagagaacatacgtgcgcattttgcaatctgacattttacctaaaagtgaagacacatacttgggcaaagag

SEQ ID NO: 551612 - DNA, 825 bp, Homo sapiens
  misc_feature (1)..(1): n is a, c, g, or t
  misc_feature (75)..(75): n is a, c, g, or t
  misc_feature (84)..(85): n is a, c, g, or t
  misc_feature (90)..(91): n is a, c, g, or t
  misc_feature (119)..(119): n is a, c, g, or t
  misc_feature (134)..(135): n is a, c, g, or t
  misc_feature (149)..(149): n is a, c, g, or t
  misc_feature (169)..(169): n is a, c, g, or t
  misc_feature (178)..(178): n is a, c, g, or t
  misc_feature (196)..(196): n is a, c, g, or t
  misc_feature (238)..(238): n is a, c, g, or t
  misc_feature (241)..(241): n is a, c, g, or t
  misc_feature (268)..(268): n is a, c, g, or t
  misc_feature (274)..(274): n is a, c, g, or t
  misc_feature (280)..(280): n is a, c, g, or t
  misc_feature (284)..(284): n is a, c, g, or t
  misc_feature (286)..(286): n is a, c, g, or t
  misc_feature (300)..(300): n is a, c, g, or t
  misc_feature (308)..(308): n is a, c, g, or t
  misc_feature (325)..(325): n is a, c, g, or t
  misc_feature (346)..(347): n is a, c, g, or t
  misc_feature (359)..(359): n is a, c, g, or t
  misc_feature (384)..(384): n is a, c, g, or t
  misc_feature (401)..(401): n is a, c, g, or t
  misc_feature (422)..(422): n is a, c, g, or t
  misc_feature (486)..(486): n is a, c, g, or t
  misc_feature (513)..(513): n is a, c, g, or t
  misc_feature (597)..(597): n is a, c, g, or t
  misc_feature (601)..(601): n is a, c, g, or t
  misc_feature (661)..(661): n is a, c, g, or t
  misc_feature (664)..(664): n is a, c, g, or t
  misc_feature (708)..(708): n is a, c, g, or t
  misc_feature (729)..(729): n is a, c, g, or t
  misc_feature (755)..(755): n is a, c, g, or t
  misc_feature (761)..(761): n is a, c, g, or t
  misc_feature (795)..(795): n is a, c, g, or t
nggcggcaagggagccctagggcgaggggaaagcagggtgtcggcagcaagatggctccgggggtttagacactnctggcttcnnccccnnccgccacctgcctctcactccagctgcnagcagcttcacttgnngccctgggcctccnactcctcctcgtcgtcttcntacatctcnccctcttcctcggccgtngcgtcctggtactgctggtactcggacaccaggtcgttcatnttnctctcggcctcggtgaactccatctcntccatnccctcncccntntaccagtgcagggnggccttgngccggaacatggccgtnaactgctcggtgatgcgtttnntcagctcctggntggccgtgctgttcccgatgaaggnggaggacatcttgaggncggggggcgggatgtcacacncggccaccttcacgttgttgggcgataaactccacgaagtagctgctgttcttgctctggatgnacagcatctgctcgtccacctccttcntggacatgcggccccggaacacggtggccaccgtcaggtaggcggccgtggcgcgggtcgcaggcggccatcatgttcttggcntcgnacatctgctgggtgagctcgggcacggtcagggcccggtactgctggctgccccgggctnttnggggggcgaacggggcatgaagaagtgcaggcgcgggaagggcncatgttgacggccagcttgcncaggtcagcgttgagctggcccgggnagcgcnaggaggtggtgactccgctcatggtggccgatancaggtggttgaggtcccgtagtggggcgtg

SEQ ID NO: 551613 - DNA, 217 bp, Homo sapiens
atccctacgctggtcgcagtcaactttcaatctggtactcacagtgaatctcttcctaaggtgaaagaaaaaatggttatattaaaacaggagatagtctctgtcaagtatccagtgtggcatttggctaaggatttcataagaataattcttgaataccaagattttttgggaaatatggttggtaccggaaaattgcaacaatttaactaaaaaa

SEQ ID NO: 551614 - DNA, 306 bp, Homo sapiens
tggactctcctacgtatctactccaactccaagcgtctgtcattcctgagtgaaggctgaactaacttgggagaaacttagtttatagtttaaacaaacatggtagcagccctttcccaaagcagacctccttcttgcctggtgactagatcgccttggtaggactaacattagccacaagattagaaattatggtttaggagtcatgcagctggaggatacaagattctgaccctccctaaactgctcctaagatcagtgcttgagatattctgcagactctgcacttaggatacagtagggaga

SEQ ID NO: 551615 - DNA, 248 bp, Homo sapiens
cctgttttagcacgctggagtcagggtgggtggatatgagtgtcaagagatcgagaccatcctggccaacatggtgaaaccccgtctccactaaaaatacaaaaattagctgggcatggtggcacgtgcctgtagtcccagctacttgggaggctgaggctggagaatcagctgaacctgggaggcagaagttggcagtgagccgagatcatgccactgtactccagcactccagcgtgctgatacaa

SEQ ID NO: 551616 - DNA, 160 bp, Homo sapiens
  misc_feature (88)..(88): n is a, c, g, or t
  misc_feature (128)..(128): n is a, c, g, or t
  misc_feature (131)..(131): n is a, c, g, or t
aaaacaaaacaaaacaaaaaagaagggaagacatacaaggccaggtgcaggggctcacaactataatttcagcatttggggaagccanggggggaggatggctggagcccaggagttcgagaccagcntgngccaaacaggaggacctcatcgtgattta

SEQ ID NO: 551617 - DNA, 332 bp, Homo sapiens
cgtgagtcaccatgcccagcctacgatgagtttattaagatttggttatgctggggacatgggaaaagccacgttaggggcacgcatgctggaggaacggggactgagggggtggatggatagccatcgaagcacattagaacctcatggcgaagagtctggctaagcgatgacgaagcgctgaggcatgggagcactgtggaatgaccctgaaggcgatacgggatgatgatgaccagacataaacagatctcgttcaagacgtatgtgaggcccgctctcatgagcaagaggctatatgagaataccatgaggcccatagagaccactca

SEQ ID NO: 551618 - DNA, 555 bp, Homo sapiens
accttgaatgttggccccaacccggcatgggccggctggttggaggcgttctggctggtttccctggctcctggccgggttcgtgctcgcagaaccgggggacacagagaagtcgaagatggactggcatgggtgggcataagtggcaccatttacgaatacggagccctcaacattgatggggaagagtacattcccttcaagcagtatgctggcaaatacgttctctttgtcaacgtgggcagctactgaaggctgacggggcagtacattgaactgaatgcactacaggaagagacttgcaccaatcggtctggtcattctgggctttccctggcaacaatttggcaggaaccaagagagaactcagagataccttcctaacctcaagtatgttcgaacaagtggagggtttggcccttatttccagctctttgagaaaggggatgtccatggagagaaagagcagaaattctacactttcctaaagaactcctggttcttccaactcggagctcctggggacctctgacggctcttcgggcccgtggtccc

SEQ ID NO: 551619 - DNA, 314 bp, Homo sapiens
ggcggttcgaccctcagcaaaccctgctgaagatggcggtatatagcctgagcaagaggtggctgaggttgatcggggtttatcgatcacagaacaggcccctctagagggatatgaagcaccgccagccctttgagttttaagctgtggctcgtagtgttctggcgagcagttttcttgattcaactcttgacgtttagggctacgcatagtggcgcatctaatcccagtttccgtcttagctattctctgttcagatatgttaaagccacttccgtagtctatctcgtgtcaactgcgagtttctgtcgacg

SEQ ID NO: 551620 - DNA, 313 bp, Homo sapiens
  misc_feature (10)..(10): n is a, c, g, or t
tttttttttntgaattaaaagaattggtttattcatagcttgatttggtgagtttctataataccttaattatatcaatagttcatcccactagaagtagcttcacttgttctaatcttttggactcctactgatgaaataataatggctttttttctctgcatcttttcatttatggtattggtttcttggttttttgactcaatataaactagaaaatcctatgaagagtattcaatagaaattaactgtcaactaggtatgttccaatttagtcattaaacgtatattgtctgttgaaaaagcagtcgac

SEQ ID NO: 551621 - DNA, 228 bp, Homo sapiens
tgagaaagaaacactttccagagttccctgcaatcctgtgcttatgcagatagttactattatgaagatggaggaatgaagccaacgagtgattgaaagaagctgtatctactccatcacgaatggcccacatgggatccaggaatggtattgcatgcttgaaattgccatgaaaactcgcaacaagcaagaacttttcgtcgctaccaggtcggacattgagagcct

SEQ ID NO: 551622 - DNA, 467 bp, Homo sapiens
agcatgtgctgggtaatcggctggggaactacagggaaaaaaggttgactctggaagctcccttgtctgccaaatggacaagacctggattcagataggagtggtaagctggagctttagttgtggccagcgccacttccaaggtatctacaccagcactgcccacttcaaccagtggatcaggactgaggttgctaacataaggttcatcagtagggctggccctgccttcctgagcccagttttcctcactggctacattctactgggctccttgagctccctgtggctcctgtgagcggtgtttcaaggacagtccctcccagaggctgcttctccctcccctctgttctaccctcagaagtggagacgagaggttgcccaggatggcagggcagagtgagggggagggtccgagagccactgttactttctgatgttcaatgaagatgcttttgaactttaaa

SEQ ID NO: 551623 - DNA, 268 bp, Homo sapiens
atgggccccggggagggggggcccccccatccgcccatttttccttaggggtccgaggccaaggttttcctttttttccgggctgggccctacgatatccttttcaaataggggtgggtccagcccccttgtgccctgctgccccccttttccagggggtaaacatggacaaaggtttttttgtggttgttaatgggccttttttccccccttttttctgttccatgaccccccccccctgttttttttaaagggggggtgggggtga

SEQ ID NO: 551624 - DNA, 669 bp, Homo sapiens
  misc_feature (64)..(64): n is a, c, g, or t
  misc_feature (68)..(69): n is a, c, g, or t
  misc_feature (71)..(72): n is a, c, g, or t
  misc_feature (74)..(74): n is a, c, g, or t
  misc_feature (86)..(86): n is a, c, g, or t
  misc_feature (88)..(88): n is a, c, g, or t
  misc_feature (92)..(92): n is a, c, g, or t
  misc_feature (123)..(123): n is a, c, g, or t
  misc_feature (174)..(174): n is a, c, g, or t
  misc_feature (176)..(176): n is a, c, g, or t
  misc_feature (179)..(179): n is a, c, g, or t
  misc_feature (205)..(205): n is a, c, g, or t
  misc_feature (251)..(251): n is a, c, g, or t
  misc_feature (277)..(277): n is a, c, g, or t
  misc_feature (296)..(296): n is a, c, g, or t
  misc_feature (318)..(318): n is a, c, g, or t
  misc_feature (323)..(323): n is a, c, g, or t
  misc_feature (351)..(351): n is a, c, g, or t
  misc_feature (397)..(397): n is a, c, g, or t
  misc_feature (455)..(455): n is a, c, g, or t
  misc_feature (463)..(463): n is a, c, g, or t
  misc_feature (528)..(528): n is a, c, g, or t
  misc_feature (531)..(531): n is a, c, g, or t
  misc_feature (544)..(544): n is a, c, g, or t
  misc_feature (560)..(560): n is a, c, g, or t
  misc_feature (571)..(571): n is a, c, g, or t
  misc_feature (637)..(637): n is a, c, g, or t
ttattcaaaagaagcagtccaaaatgatttgaccttaaaggaaaaatcaaatttaagagtatanacannanncntctcctcccccngnaggngggttgccccccggcaggcttcgttccaggngcgggattcttgggagcagcgggccggggtgtggcccaccagaggcttccncngcntctcaacaccaacagcagccttcttnccttccttacccaccacaggcctcttgcctgcaaccgccgccttcncatctgatttggcttgtagtgccgcngctgcagcagcggccttanccacccggagcttgtgattccnggccnggcgaagaagggggtgccggcgcagggncttggcaaaggggtttagcctcaacatgattctcaagtttttcagngggttcttctttaggactcggcgagggatcttcttgcggggggcccgaagggcccttnggatctcngggcttttcaagattctgccaagatctgtattaatcatcttgggcatgggaagattggaggaacnctngagggaagcggcnttacgccaagggccgnacaaatcaccnaactcccggaaagcacttccagtccaaatgcagaaacgccccacatgcccaccaggagcaagcttnaaaatgttcagcttgcttacattaagcagagt

SEQ ID NO: 551625 - DNA, 111 bp, Homo sapiens
gggagtggcattacgtgcatcctaactgacgagatgctgccccaggactctctaacacatgcacacagtctactaaagaagcaggctgaccatcatgacccccacccatcg

SEQ ID NO: 551626 - DNA, 1070 bp, Homo sapiens
cggtgcactgccattcgaagaggtcgcaatctacatatgaagtctctccttcgtcagcattgtactatcaacattactaataagtggcgtcctctagaaacttctactcgtagcctgttcattactatagcatgatacatctctgattgttacctgtccatcatggacaccttgagtggatcattgatcgattatatcgtaccgagagcattaggcgtgaggatccaaaacaggaggactcatcctatacgtagactgtggcctgaagggggtgcagatacctgaggcgaacgttctggacggtcggtcgcactaaaccgattttggccgacacgataggggtcgccgtctacgaaccataattggggtgcataaaggcgcgagtcaacacagagacatttattaatagagaaaggcgtcacttcaaccaggaactaatggtggccgaggagtcaaccatatgacgcaggtctccgcctgaacgtctgagacaaacgtgattttgtcaaccaacgcaccctactctctaatctaccactgtactgaatgaatctcagaacagtatagccccgatttcacgtacggagcaattcatacacactcctatgacaaaacttcctaccagtgaccctagacatattcgtatgacatgtcgtccataccgcataacggatctccagaatacccactcagaaggcaaaagcgatacaaccacgcagagatcgaacaaaccgtgggccacgacagggcacacacaacaaaagttgaaacacaaaaaacagcgccagggcaacaaaccacgtcacactgctgcagcgtgtcacacacacgacagcgtcacaaacagcacgtgcaacacaccaagaagacaccgggacgacaggctcacacgaccacgtgcgaacgccaacggcaacaacgggcacgacaaaaaacatcacccccgtgagcgaacacgacaagcgacgagaacacagcacaaccaggcacgcacacagtccctcgccatagcctcgcgcacaacaaaaggagaccaacaaagcgcaactacaccaccgacgagcacagca

SEQ ID NO: 551627 - DNA, 416 bp, Homo sapiens
gtcgacctgaaccacaaacttcagtggactactcttctctgcagtatgtctaagccacaatatagtgtaacctaccctctcagcctgaaatctgactgatcaggtttgactgttagcactaagagagcatcaggggtggagcctgccaccctattgttcttccactcccactgctactacctgcaacctgctgttccagagccaacatgtggttacctgaaactggactctaaggatgatttggtgggaatgggcccctcccccttcttcataacccagtgcctgaatagtaaaattgaaccttgatcagactaatgtcttggttccatcctttcttgcaccaccttgtctgacctctagcattgggcctcttagctatacttgtacagggtcacctgcctcactttttgtggcag

SEQ ID NO: 551628 - DNA, 893 bp, Homo sapiens
  misc_feature (11)..(11): n is a, c, g, or t
  misc_feature (257)..(257): n is a, c, g, or t
  misc_feature (297)..(297): n is a, c, g, or t
  misc_feature (367)..(368): n is a, c, g, or t
  misc_feature (372)..(372): n is a, c, g, or t
  misc_feature (466)..(466): n is a, c, g, or t
cacacttactntttccaaattgatctacgctggtgtaatcagagtgaatctcagaactttggacagagctgtgagcagagactgactttcctgctgtctccaggtagctgcaaggctgaacagcagcacctactttattaccatcttactgtcattcaaagaaggcagagctgaatgctggagaaaaactgagtactagcaacagtttttgaaccctgaatactgtcataactgaagctagaattatccctggactngtttgccactaaaatttccttgtttggcttaccctggttncagctggcaccctgatcacttgaaaggaacataactgatatactgtcctttgtttttctttccttcctcnncgcngcctttgatgattttaaattagaaatctacctgcctctaatctctttaattttctcatttatttactgctgcctattttccaaaacactgcttntcgaatattcctggctcaaaaacatctatgtcttcatgacatatgaaacccctagaatccagcctttccccagcttttaatatctcctaattgatttctcaattccagtgaaatgattccatttatttttttcccaaacacatcacaaatattcctaactcttgtgagcaattttctctcattcttctcaacttatctaaatcctaacttttcaaaagatctagctcaagttctgtcttatcatattttgagttcctttctttggcattgtattattttgtatctttccatgtacacatgtgtgcattatctccctgataaaactaactggctagaggataggagtaaagactcaattctaatatccttgttacctaataatacacaaacgtgaaacatgtttgaataaatcactgttaaatatttt

SEQ ID NO: 551629 - DNA, 531 bp, Homo sapiens
gccagctcgcctgaccgccagtgagcagccagtgcatccgtgcagtgcagctggagaggctagcctcagagcctcgctccggttactttacagcaagtagatttctgggtgtgtcctaaaggtcagaggtcaggtctgcatgcttgagcaggtggaggatttgcccctccccaactgggacccacagtggcctcaggggctctgggccgcagctctgggtctgggtcgagtcaggctgggctgtgtgtctgcctggttggttagtctctaaccacctgtctggcctctgcgccagggtggggagtgaggacattggtgtcccgccctatgtgggggctcacagacgatgataaggtaacagctctcagcagttaggcacgtgagggcacggttctcggtagtcaccacaatgttcacaatgggaaattatatcacacggtagcagagataggcattttatgtgttccttatattttacctcaaattgtagatatagggtaataaataaaatccatccatgcctttcacatg

SEQ ID NO: 551630 - DNA, 840 bp, Homo sapiens
agagagaggagaagaaagggctgggctgcccctactcaagctcttcttccaaaagcagtactcagatgggtcactccataattcccagggtccagtcagggagcggtggggagaggctggagtggcctactaagggagagccctgttaacagagcctcctacacaaggaagaatcactaggagaggggaaggaacgtgcgaggcccctgccaactcctcttccatactcgttcgtttgcgcattcaacacacttttgagcaccttcttttcctctgtgctctgtgacaggaattcaaacatgaaactagatgtggccttggtttcagagaagtcattcccttagtagtgaatactagttccctgaagtttaacattggaggagaaggagttattaaacacccattctaagcaagaacatcagtagcctacaaagggccttttttcacactttgagtctgttgaagaaaactcacagttggtatcacttgctttaaaagtgccccccactctgccttgtacggtccggattgctgtgaggccatgacaaggaaccaagttctgtttttctgtgaagagaatggaataatcatttacctctttcctgtggctgccagctggtcccttcactcagtcactccctgtttctccttcctccctttcctctccccttccagtacacagaatcccttctccatatccccccatgatgaaggaccaccagtcattggctcacctctcttccaaaattccaatgactagagtctttctcagagtatgtataactgatgtcacagacccctgagtctggaagagtctaagtaaaagtgggtgttgacctg

SEQ ID NO: 551631 - DNA, 819 bp, Homo sapiens
agcgggagacctagacctcggtcagcgccccgccgcccctctgcgtgcgacttggtgaggccggtgggtgcgcgtcgagagggccgagggacgagcggaagagaagctgctgcgaactctgggccacccagatgggccggcggagttccctggtgttaggcgcgggctcgggcactttcgccgaggagcccgggaaagggtctagctttccacgcctgagaaaccacctttgggcagtttctcgcgctgccggggtgctagacgcccgggaggcttcccgggtggcgtctcccgcgtgatgccccggcagtctcagtcgtccctggtggggagcgtcatcccaaaacaccaggtgtgtcgccggggaggcccgccgcaaccaacgactgtccttttattggagaagtccccgctgtcccggcgagcgaagacgactgggcgtgttctacctaacaaaaacaagacgtgtcgccactgtttgccgcacgggctggggcttgaagctccttgggcgtcaagtgatgactccttggcgttgggcgtcctccacagtgcgtggggcgttacaacggagttatgcaaatcctccccttgtaggagggcgggtagaagtttccacgcgacgactgtgaaatttgggtgccggaggtatctgcggggggggtggggaggacacatggttgtgcatatctaccttattactccatttctcaacaaaaaattttaccgagagacttgtggggctcttaactattgggtctggggctcggggaggtatacaccatcttacagagctggagacccacgtacttattccct

SEQ ID NO: 551632 - DNA, 604 bp, Homo sapiens
cagtaaccaccctgcctgatatgcccactgttggtggagacatcaccccagcacagacctcaattaagacgactacccctccgacgactccccctcccttcactggaggtgacttcacgcacttcttcagaacctcctcagcagcgatgcccatagactggggttcctaaggcacaaatttgatatttgagattctgtgatgagctgagcttgtgtccgctaacccgtgatcctggtgtaatctcaaccaaaacccacagccctgcaccccttgcctgtaggaaaatctggtaggagttagtagtgtctgtgaagtctcaataattgataccaaaatgttttgtttcaccaggaggtgcccgcctcctatcagcctctgggaaggccactgtctccccagtgccttctcctccgctgcagctttccatctcatctccttactcccttgacttggcttcacacagagcctcttctttacacatactaactgtttgcttcataccctcctgcagcagaactacagacctgccatcctgataattgtcaaactcatccctttatcacctttataactcctcaaggatattatcattggacccccaac

SEQ ID NO: 551633 - DNA, 324 bp, Homo sapiens
tgagtactctagacctgtgtctgctgtatcaggagtgtgtgctcacaataaatatatacaagatacgtctcattctaactgtgatctcggaatgcatgaggatacacacaggcttattcattttttctcagtctccccctgtatcacaaaaagtttgcctcccaacacaaggggctgggaggtccagtctaaacagagcatgctgttggggtaaacagtaaccatgtgatcccatgattcccagagctctgagcacaaagcttttcatcccagtggcaactggaatgtgggtaattctgtaaactccagaggcaggacaagcag

SEQ ID NO: 551634 - DNA, 897 bp, Homo sapiens
  misc_feature (109)..(109): n is a, c, g, or t
  misc_feature (118)..(118): n is a, c, g, or t
  misc_feature (231)..(231): n is a, c, g, or t
  misc_feature (288)..(288): n is a, c, g, or t
  misc_feature (293)..(293): n is a, c, g, or t
  misc_feature (302)..(302): n is a, c, g, or t
  misc_feature (305)..(305): n is a, c, g, or t
  misc_feature (360)..(360): n is a, c, g, or t
  misc_feature (364)..(364): n is a, c, g, or t
  misc_feature (384)..(384): n is a, c, g, or t
  misc_feature (390)..(390): n is a, c, g, or t
  misc_feature (393)..(393): n is a, c, g, or t
  misc_feature (414)..(414): n is a, c, g, or t
  misc_feature (421)..(422): n is a, c, g, or t
  misc_feature (438)..(438): n is a, c, g, or t
  misc_feature (461)..(461): n is a, c, g, or t
  misc_feature (470)..(470): n is a, c, g, or t
  misc_feature (481)..(481): n is a, c, g, or t
  misc_feature (550)..(550): n is a, c, g, or t
  misc_feature (552)..(552): n is a, c, g, or t
  misc_feature (572)..(572): n is a, c, g, or t
  misc_feature (584)..(584): n is a, c, g, or t
  misc_feature (592)..(592): n is a, c, g, or t
  misc_feature (599)..(600): n is a, c, g, or t
  misc_feature (624)..(624): n is a, c, g, or t
  misc_feature (648)..(648): n is a, c, g, or t
  misc_feature (697)..(697): n is a, c, g, or t
  misc_feature (707)..(707): n is a, c, g, or t
  misc_feature (801)..(801): n is a, c, g, or t
  misc_feature (849)..(849): n is a, c, g, or t
taattagaagttgtggaaagtagaccctctctgggacagaaacgatatacgtggtccatgtggtttgagtctgtcatgaatgacactaacggcacatggactgctgatntttgcgtcntagacacgggtgagctcatggtggaactcctccttgtctgtaggtttccaggctgggcacttaggtgagggcagaatgttggtggtcccagtggatctccccacaacttcctncagggcaggattttcacccaggcccaggctgcccgttcctctccttctccgccagtntgcgntgcggctgncanggctcacaccagagggatggggtaggaggcgcaggcagccaggccacacatgttntttncgcgctcgatgaggaagtanccgttnatnccccactggggaccccaaganttttttnngattcagtaagggatnacatttttttctccatacccaanagccagtantgcatggtttnttttatctggagttttatggcaggaagtactggagtagatgcccgttctatacatcatgaagtcctgantnatctcaaaggcaaagctcanagggttgtaganggccacancctccannatcgcttcctcgtcatagattgtnatgttggctacatccttgacaaanccgatggcctttccaggttggaacttgcaataaacatccttgccctggnaggggtaggngtcttcacccatgatccccttgttgtacaggatatactcgaaagcctggctggggagaccccttggcagccgtgattattgaagtcctgggcgngtcaccagctgctgttccgccaaggacagcatctttccggttgcgatngcgatcgcagactccagggccccagtggtggagaaagtccagcaatgc

SEQ ID NO: 551635 - DNA, 121 bp, Homo sapiens
cttagaaggagagagctttacgcttgtctttcttctccgcctctatatgcagaattttgatgctgtgggtttggatatttagaggacaatattcatgggtgacggggtccagttattacag

SEQ ID NO: 551636 - DNA, 448 bp, Homo sapiens
  misc_feature (297)..(297): n is a, c, g, or t
  misc_feature (329)..(329): n is a, c, g, or t
  misc_feature (362)..(362): n is a, c, g, or t
  misc_feature (374)..(374): n is a, c, g, or t
agattgtgagtccatgttttgtctgttgtgcctataaaggaaatttgaaatctgtatcattctactataaagacacatgcacacgtatgtttattgcagcactgtttacaatagcaaagacttggaaccaaccaaaatacccacaaatgatagaccggataaaagaaaacgtgacacatatacaccatggaatactatgcagccatagaaaggatgagttcatattcctcacagggaccatggatgaagctggaaaccatcatcctcagcaacttacacagggaaccggaaaccaancaccggcatgttctcactcataagtggggaanttgaacaatggggaattacatggacacaggganggggaacaccanaccccttggggcctgtttggggggggatggggggctaaggggaagggataagccttagggggaaattacctgat

SEQ ID NO: 551637 - DNA, 306 bp, Homo sapiens
  misc_feature (33)..(33): n is a, c, g, or t
  misc_feature (35)..(35): n is a, c, g, or t
  misc_feature (40)..(40): n is a, c, g, or t
  misc_feature (82)..(82): n is a, c, g, or t
  misc_feature (95)..(95): n is a, c, g, or t
  misc_feature (291)..(291): n is a, c, g, or t
gggaatcctacctgcagtggttgcgggatcagnanacccnggctcgcaggtccgaggccccagcagccccggaaagccaaanacacatgcacccncggccacagcagcagcctccagtggcctggaggaggtggactagccggtccccgcggcagaggtgtcagcctcgtcaccttgagcaccctgagctgcatgctgaattgggcatgaagcccctttccccaggcactgttttagctcttgccaaaaccttccttcggcccttgtgggccaggtacaaagcaagtcagnttctcggcaaggggc

SEQ ID NO: 551638 - DNA, 155 bp, Homo sapiens
tatagaggatcccttcgattggcgggcaacttatgcacgcttaactatcttaacaagcttgagtgcaggagatgaagagtcaaatctgaccaagatgttgatgttggataagagaattctctgctccccatctctaattagcccgccaatcgaat

SEQ ID NO: 551639 - DNA, 935 bp, Homo sapiens
  misc_feature (1)..(1): n is a, c, g, or t
  misc_feature (102)..(102): n is a, c, g, or t
  misc_feature (128)..(129): n is a, c, g, or t
  misc_feature (131)..(132): n is a, c, g, or t
  misc_feature (154)..(154): n is a, c, g, or t
  misc_feature (163)..(163): n is a, c, g, or t
  misc_feature (181)..(181): n is a, c, g, or t
  misc_feature (197)..(197): n is a, c, g, or t
  misc_feature (199)..(199): n is a, c, g, or t
  misc_feature (219)..(219): n is a, c, g, or t
  misc_feature (223)..(223): n is a, c, g, or t
  misc_feature (238)..(238): n is a, c, g, or t
  misc_feature (256)..(256): n is a, c, g, or t
  misc_feature (263)..(263): n is a, c, g, or t
  misc_feature (293)..(293): n is a, c, g, or t
  misc_feature (313)..(313): n is a, c, g, or t
  misc_feature (356)..(356): n is a, c, g, or t
  misc_feature (358)..(361): n is a, c, g, or t
  misc_feature (383)..(383): n is a, c, g, or t
  misc_feature (448)..(448): n is a, c, g, or t
  misc_feature (465)..(465): n is a, c, g, or t
  misc_feature (515)..(515): n is a, c, g, or t
  misc_feature (525)..(525): n is a, c, g, or t
  misc_feature (558)..(558): n is a, c, g, or t
  misc_feature (609)..(609): n is a, c, g, or t
  misc_feature (626)..(626): n is a, c, g, or t
  misc_feature (926)..(926): n is a, c, g, or t
ntccccaacatactatgcgttctcgacattcgctccttgtcatcccaccaacccccaaccctcttcctcgcatccaccctaaatgcgacttcattaattttntattttctcacggtttcttattcctnntnntccgccgaattctcacacattntacatacgnattttttttttcttgttnttgcattctcctcctnanctttcttcccaccaccattnttcntcccatccgggtacntcctcccccacccgtttnctccccntttcttctcctactttgccgcttttccagntttccttcttcctaccattnccacttatctcttttttattccatttttccttcttttacatcntnnnnatcttctcacaccctttctttntttaaaatatttttttcttactcttctccttcacctttgaggtctttcttttattcttttttttnttttttaggtgcattantttttattttttcttcgctctccttcccaccgggcctatccccatctggnctttgcctcngtctctattctcctcggtctctgttcgcctctntcccgcctctttcaccgggtggcgtctcctctgtatttttctttgttcatntttcctcgtttttcccntttgtggatacgctctcgcgcaccaggtacgcctggtgtttctttgtggtttttcggattctttttggggagtgcggggagtcacagttagaaggcggccgggtgttgctggaggaaagtgctgaggtccagagcgtagtccgagggctccgaagtcagattaaagggctcgaggacgggggacacaggggtgggcgccagggatgcggcgttaggggcgtcctctggaggcaggggcgccggcacaccctcttcagccatcaggatctggcagaagacgatggtgagcagcagaaaganaagcctttt

SEQ ID NO: 551640 - DNA, 109 bp, Homo sapiens
accaggcgatttacggtgacagctcccatggaacagcacacacatcgcatggaatggcacacacgtcccatggaacagcacactctcccacggaacagtacactctcgc

SEQ ID NO: 551641 - DNA, 754 bp, Homo sapiens
  misc_feature (534)..(534): n is a, c, g, or t
gtcagctagagtaagatcatttaaagcacagttttttgctgggcgcggtggctcactcctgtaatgccagcaccttgggaggctgagatgggcagatcacaaggtcaggagatcgagaccatcctggctaacacggtgaaaccccgtctctgctaaaaatacaaaaaattagtcgggcatggtggtgggcacctgtggtcccagctactcgggaggctgaggcagaagaacggcgtgaatcggggaggcagagcttgcaagtgagccaagatcatgccactgcactccagcctgggggacagagcaagactctgtcaaaaaaaaaaaaaaaaaaaaacaaaaaaaaaaacaaagtttttctctatatatacttccttgtgaattgctcctatattccctttgtgttggggaaaagtcttccctttttgggtggtggtttgtgctttggtcttgtgtgtttggagaaaccagaagttcttggcccccttattgcgccccgaggctcgtggcaccttgtggcggtggccaccgcangtgtggtgagcctccccggtggaaacccctctttggggctctacgtggaaaacacctctcccaacgctttcacgcgagagccttagaacgccaaattgttctcgcggtgtcctcaagacctcttcccgagagtatgagccgtgggcaactacacagggccgttttgtgcgccacgcaaagagacccagctataaaatcgacggcgactattactagcggg

SEQ ID NO: 551642 - DNA, 313 bp, Homo sapiens
aaagagctgaacatattgaacaggtggtatctataacatccacatgtgaatagcttaatccagaggtttgattctaaaatgttttgcttttctaaaatcctaaatatcttgggctattaagtgatcatttgattctgaaaccccaaatgttgcaatttgtctacatatattttcttttttgtgcatcaggagaaacttgagtatagttatagagcaggtacaagctaaatcttgaaatagctccttttgttctatgtactctgaagaagatacgattttgaaggtcatcccaatgaaaacattgctgatacat

SEQ ID NO: 551643 - DNA, 102 bp, Homo sapiens
gagcattggtgctcagtgtagtattgtacatgtcaaaaaatgtgtgaattttagatgtcaggagatattccaggagatcattacactactatggtacctgat

SEQ ID NO: 551644 - DNA, 570 bp, Homo sapiens
gagttgaggacccaaagtgtcaaaatcctaaagggcgaggcgccaccggcatttttcaacttctccaatcaagaatggcaagtaaatccacttctggctgccatccgtattcctcatcaggctgggattcaagcaggtgcttcaacccccacaaatgccacagcagcgtcagatgctaatactggagaccgtggacagaccaataatgctgcttctgcatcagcttccaactccacctgaacagtcccgagcagccagctgcacaggaaaaaccaccagttacttgagtgtcactcagcaacactggtcacgtttggaaagaatattaaaaagagaaaaaaatcctgttcattttagtgttcaatttttttattattattgttgttcttatttaaccttgtaaaatatctataaatacaaaccaatttcattgtattctcactttgagggagatccagggggtgggaggggttgtggggagggggaaagcggagcactagaacatacaatctctctcccacgacaatctttttttattaaaagtctgctgttgtatactttaaaaaaaaa

SEQ ID NO: 551645 - DNA, 1383 bp, Homo sapiens
ccccaggtgggtgtggcggaacgaccgcgcaagaagagtggtctgacaacagggcgcgcctgtgagcatagacggagcggcggggtggcaaggatcaggcgggcgaaagatgccaggcggtcgcagcgggggaggaggacgcgggcgtggggcgccgcgccaaaagggggctcagcaaagtgtgcgcggagaacccagggctacagagcccacgggaaggtgttagaagggccacagatggcgccagccccgtgtgaagagagtaagaaacgcgcgcggggagacgggcggacagcttcaaagcgcgcctaacgtgccacgggggtgctgtaacgcgcccccgagggtggagcaaagggcgctccacaattacgacgcggtgtaagttgctcgtgtgtagggtgcaagggggggccgcaggcggggtatgttcgccacttacgtgggctaggaacagcgggctggccaacaagtggccgcgtgccacagagattgttgccgtgctgccacggctgggagctgtttgggtttgtcgggaaacgcggcgcagaatggacaaaaaaaaattctgcgggggccgtaatccccacccacgggagaccccaccaggagagggagagagaggtgagatatatacatggtgagcacccgggtaatatggttaaggaggccacggagagactggaaaacagcgggaaagatatatgtagaggggcctccacaaatggagaaacaccctcgacgcctacagagatgactctcgtgaaatatactgtgggtgaagtttgggctctcccacggagatatgtgcacacacaggggcaacggcctttgacacgggggagagataggtgtcacactgtgggaggcgcacagcacacgctctgtcacagaggacacacatgtgaacactagcgcactcttgagaataacacacacacgttccacaagttctgaactcgtggttgcctcaaggggtcgcacgaacaccccctgtttctcttggtaatagaagaagagaggtccacaaaggcgtctggtgttccctcgggagagaaaattaagtgtttcgcacttaaaatgtataggaggtatgtggcattgtgttttctttcttgttatccccctcggttttgtgttcttgtaaactaagtgtgcgttctcacttttaaattttcacgctggccacccactcattctttcgcatataatgcaccacattctatcattctgtcctaccacgttccctgagttcttttcatggctgaagctgcacattctaacacctttactgtacctttataataagggccaattctttcattgtctattattatgcttaagaaaatattccagttaatccaccacagagtattttatgta

SEQ ID NO: 551646 - DNA, 1284 bp, Homo sapiens
gagttgaggacccaaagtgtcaaaatcctaaagggcgaggcgccaccggcatttttcaacttctccaatcaagaatggcaagtaaatccacttctggctgccatccgtattcctcatcaggctgggattcaagcaggtgcttcaacccccacaaatgccacagcagcgtcagatgctaatactggagaccgtggacagaccaataatgctgcttctgcatcagcttccaactccacctgaacagtcccgagcagccagctgcacaggaaaaaccaccagttacttgagtgtcactcagcaacactggtcacgtttggaaagaatattaaaaagagaaaaaaaaaaaaaaaaaaaaaaaaaaaaaatttttgggccccctggccggaaaagttttaaacccatccgtggggggcggggcccaagtgtgtatgtcgactctgggccatagctggttccaaagagaaatcgggcgccattgcatttaagtgttgggtttctcacccattaaaaaaggccgggggacaccagaggggttctggacacaaattccagaatgggaagttccggacgggaaaataccggggttcataactcaccgcgggtccaaggacgaagctcgaatattaaaattaagcgcccccggcgctggttgaatacgacaaaacaaaagcagaaaacgggatggagacaaagacagaaatgagaacgaagacaacaacaaggagagaagcaaaacgaaagccagaggagagaaaaaaagaacacagtagaagaagaggaaatagaaagggacaagacagagacaagtagaaagaaacagaaatgcacgacaacaaaaaagaacaaaagaaagacagaagaaagacgaaaggaaagaagaaacagacaaaaaaagagaagacaagagaagaaaaaagaaagcgaaagagagaaagagagccagcagaggagaaggccagccgaccgagagcaagaacggaacggacagggacgagaagccaggggacagacgagagggcaacaggagaagcgaacgcaacacggaagggacaggcaagaaacaagtagaaaggaacggagagcacagaagaaagcaaggacacgaaaagaagacgaaaggaagcacgaaacaagagagagaaacggagacccgagcaacaaagaagcagagcgacagaagaacagaacgcacggaagagaacaagaagcacacaacagacacagagagaagaccaaaggaggaagagaggaagaaaagacgaaggagaaaggacaacgcggaac

SEQ ID NO: 551647 - DNA, 832 bp, Homo sapiens
cggaatcctaccaggcttcggaataatctcccatatagtaacttactactccgaaaaaaaggaaccatttgggatacacttaggtatggtctgagctatgatatcaaatggccttcctagggttgatctgtgtgagcacatccatatatcgagcacgtagggaatagacgtagagcagcaccgagcatatgtcgagccatcgggcgtaccaaataagtcatcggctagtccccaccggcgtcaaagtattctaggcgtgactcgcgcagagatccacggaacgcaatatgaaatgagtctgctgcagtgctctgagccctaggatacatcttactttgtcaccgtaggtggcctgactggcaatgtattgagcaaactcatcactagacatcgtactgcacgacaggtactacagtgggtagctcacttccacatatgtcctgatcaataggagcggtattgccatcataggaggcgacattcgacggagttcccgtatatctcaggctacagcctagaccaaactacgccaagatcgatttgactatcatattcatggggtacatctaactttcttcccataacacttgctccggctgtcggaatgcccggggtactcgggagtacccgatgataagtaatgaaaatctatattggaagtcgttattcgctagagcagtgttgagaattcatgttggaagctcgttgaggaaagctaaagtgaaacccaaaaggggggaatggagcccacacaaattggaacgtataattaaaaagaggttccgttgtaacggtctttttgaaaaaaaaaatgggggaagaaagggggaaa

SEQ ID NO: 551648 - DNA, 704 bp, Homo sapiens
  misc_feature (329)..(329): n is a, c, g, or t
tggaaatggagtttcgcctctggtttgcccaggcttggagtacaggggtatgatctgggctcacgtgagcctcgtgccctccgtgggttcaagcgattctcctgtgcctctgcctcccaagttacgcgggcgttataacgggcacccactcaccattgcccacgcttaatttttggcgacttttaggtaaaagacagggatttccactatagtgtggcgccagggtgtggctcctcaaaagcttcctgtgaccttcagaatgactcataccagcctctcgggccctaccgtgaacaggtgccgtggcgacaatcccggggtgtgttganagcccccaacgtggtgccccccagccgaggggaagtgcctcccaattctttctcctagagaacatttcactcctgcggcacttggggacactttatatctcccataaacagtgttttccacaattttacgttggtagcgcttagtgcacacaatctacgaatcgtggcgctttataaaccagaaagttctttgctctttctttaaaccacaaaaaagttcgactctccgtgggtgtgggggaaatttatgactacctgagcggcggcctcttatatcccactgtgtgggaatcttgacttctcccccgaggggtgtttcgccaatcacacgaggacgttctcgtggactaaatataatagccgtgccccttgcag

SEQ ID NO: 551649 - DNA, 542 bp, Homo sapiens
aagatggtcctcagctgtacgaaagaccattaaaatttattcctccggtcaaacggaaacggtatccttggaccaacatctcgcgctttcctcattgcctacccggtccacaccccacgcaccagcgctcggtgtaatcgactgttctccatctctacttctatgaagttggagttttctagaaatccatattataagtgagaacatgtttattcacttatgcatgctgtcctccaggtcttccatgttgttccaaatgagaggagtatcttctttttaaaggcggaatagttatcctgtggtgtatattcatatataccacgatgatctctatccatgtattcactgatgaacacttacatggctgccatatcttgcttatggtgaacaatgggtcaatggatactggagtgcaggtatctctttaacagacggatttcaatttctttgggtttttttatttgcagttgtccctaatgactaaagatgttgggcgacctttcatttgcgtataggcgtggtgcatatcttctcctgagaaa

SEQ ID NO: 551650 - DNA, 93 bp, Homo sapiens
ccgcctactactactactgctcgaattcaagcttctaacgatgtacggggacatgacttttccaaaaatcatcaaaaaaaaaagttgtactgc

SEQ ID NO: 551651 - DNA, 84 bp, Homo sapiens
cccgcgttgatctgatgttgctgtagctgcgattggacccctagcctgggaatctccatatgccacgggtgtggcacccaaagc

SEQ ID NO: 551652 - DNA, 671 bp, Homo sapiens
ggactaacgctagaaacagtggtgcgcggagaggagaggcctcgggatgtctctggcagatgagctcttagctgatctcgaagaggcagcagaagaggaggacaggaggaagctatggggaggaagaacgaggagccagcgatcgaggatgtgcaggaggagacacaggtgggtctttccggggattcagtcgagagcatggtcgaagctatgggatagtaagatgtttgcgtgagattatgatgaagattgaggagtatatgagcaagggaaagccaaatgcttcagaagtgatgggaccgagtggacgggcggcctgaatagcgcgtcaatcgtggatgccagagaagctgaccgtggagatcgaagaacgagctgtaagcatcatccgataagttcatccgggcataagtactcggaagagattccctgaagctggagtccttggtgccccaatgcacttggattacatccgcacggtcaaggagctgggcaacagcctggacaagtgcaggaacaatgagaagctggcagcagatcctcagcaatgtgcacatcatggtcgtcagcgtccagcgctccaccacccagggcagcagctgtccggaggaggagcttgcgagcggctggaggacggctgcgacatggcgctggagcttgaacgcctcaag

SEQ ID NO: 551653 - DNA, 239 bp, Homo sapiens
tcgatagccaatggtttggtattgacagcgcttaaggaggaaaaaaaatacgggaatgaaaataagaaaaggctggtgacacccccctggtgttgtttgatctggctcccagttagcagtccctatgggacagcagagctgtcaaacagaacccattgatgacggctgaaaatcaagccagactgctgtgcggtcagcttgccgccgtggaatgccttgtgttcttggccttatccgag

SEQ ID NO: 551654 - DNA, 569 bp, Homo sapiens
  misc_feature (540)..(540): n is a, c, g, or t
  misc_feature (553)..(553): n is a, c, g, or t
atacatcaatgacctccttatgtgtagtccctcctttgatctatccatcaacacatcacccaacttctaaatttcctctatggccagggatatcaggttttacctacaaaggctcaagtagcccaaacccaagtcactaaccttggactcaccctaacccctaattcttgagccatgccagcccgatggaaggagctaatacaggatgtgccccttccccacaccaagaaggacccttcctttttgggccttgtggggtacttccagctgtggatcattaactttggcctgttgaccaaaccactctgcacggcatcacgtgggtccatcctagaacatttggacccagcttgcccattaactcccacttctaaaaactgaaagatgcccttttaatgtcccagcactaggactacccaattccattaaaccctttaccctgatgttcattgaatcaaggccttgcccttggattctctgccaaacccgtggcacactccagaagccattgcatactttttgaaacttgactctatcatncaaggctggcctncatgccttgagttctt

SEQ ID NO: 551655 - DNA, 331 bp, Homo sapiens
taatcagacgcgggatcaggacatgcgtacggcaggaaactggacaagattacatctatagagaggccgccaagaaaaacagaatggaatgactggaaaattaaaggtaaacgaagaagaggaagaaggtggggacggacagaggacggacgaagtagacaggtgactggtgaggaagaggctggagatgacgatgaggacgctgcgtcagctacgggcaagcgggcagctgacgatgatgcggatgacgatgtcaataccaagaagcagaagaccgacgaggatgactagacagcacaaaaggaaaagttaaactaagaaaaaaaaaggc

SEQ ID NO: 551656 - DNA, 420 bp, Homo sapiens
  misc_feature (96)..(96): n is a, c, g, or t
  misc_feature (290)..(290): n is a, c, g, or t
  misc_feature (317)..(317): n is a, c, g, or t
  misc_feature (407)..(407): n is a, c, g, or t
aatctccctaatattctttacaagttaagaatgttttaaatgttgatttggctcacatacttttttttcatgaaatggaaaatgcaggtatatttnccccttgtaagtgcaatgtctttaaacattacagtttaggacttacatgaagatttgcattttgtctgtcgttttattaattatttatttatttacttttggttgagtgaatttatgtgagaaaagagaaagtagatggttgattctatttttcatttttgcatctcattctaaaatctgatcatttttaagtngcttttttaactgagcgagagtgaggngtcatcaaagattgacatcctatttgccatccttctctatccaactacttctgattctttctgggaagcttttcaggcaataggccagtnctgtctaatttag

SEQ ID NO: 551657 - DNA, 698 bp, Homo sapiens
  misc_feature (379)..(379): n is a, c, g, or t
ctttaagagcatgatcataaagagctattttgaccccccccccccaatttttataacatttagagttagtaaggggttttaatatctcttcgtggtccatactgggttttaaacaggaattgagggtgtttagggtggctggaaaagccattgggtaggaagcttagattgtgaactattagaccaaggggggtatattcacgttgagaagtgtacttgtgaagaagtggccgtgttgaagccagggtggtgggattcataacttctaggtggccattaggaaatagaaacgtggaggtctattctctcttcgatagggggtttacgccattatgaacagataagattaactttgtgcactttcgtggaaaattgttcnagcgatttttaagagtgtatcttgtgacgttttatatataccgatgaaccctttaaaaatttttataaaagaaatcctgtgggaaacaacacatatttttgataatatctgtgtgaaaggtgcgatatctcctacaccgcaactggaaaaaatttctgttgcgtgtgaatatttttataaaaaaatttttcataactattcaagttggcgcacgattcactttttaaacgtggggagcaaggcaaaaaagtgcgtccgtggggcgcacaaaggggtaaaattggggttaaaacagttagagtgggactatgtgctaacc

SEQ ID NO: 551658 - DNA, 834 bp, Homo sapiens
gccttaacgatgctgctggcgaacccatgagtatgcgtcaggcttcagaaagaggctcgcttctagtgtcctccgtgtgggccaagaagcaaggtcgtgggttgagacccactaatggagaccatattgaaatccgccagtgtcgaactccacgtcagccagatccggagaggcgtcattctaacagatggggttgatcatccgtggatgcgctgtgatggaccaataccgtgggggtcggatgtgtgcaaaacaaccgtatggcccttctgtaaaggtgtaggcagcttagcggcgaatagggtaaccgccgggagatggcgtacacggcacatatagtcgcagtaactggctcaagaatgagaggtgtacctccagtgcggtggtgagacgtacgaaatgagaaggatttgcttcgcaaccctgccgttgcaacaacgaaatcgtaattaaccgcgggtggaattgtcttccattaaacgtattgctgaatcagtcccactatgtcgctaatacagagaggcttggagccctttggacgcggtgttggacgtggggactaacgtgtgcgtcccatagagatacgagcgggccggggttttctccatgggagcgtgtacattccaaaagagggctgagattgggcaagactgtggcctctgctaagtagaagcctccgtgggctagaaccatgtggttttgttggccccataagggtattaaagcacccaaggggtaaggcattgccacatgggcggcgtgtgaaggaacttgtttggaataggcccaaacaaggggtggcggatcaagcacaggattgatatgccagggaag

SEQ ID NO: 551659 - DNA, 212 bp, Homo sapiens
ctctgtgcacatccattcatgataattcctctaatcgtcagctctcatatatacccccagtatagtcttttgacatccagcattccaaggttattgagacatattactgcaattaagatatattactatcattgagaactacatcttttaagattgtacttttatcttatcagggtggtagttttccctaaaatacttcttcatgtatgggt

SEQ ID NO: 551660 - DNA, 115 bp, Homo sapiens
aaaacatttggttgtgtgattgaccggaatgacagcttgacagcagatcccaggtacagagggcacgcattgaggcagccaactttgaaatacaggtatggctatttggattcct

SEQ ID NO: 551661 - DNA, 140 bp, Homo sapiens
gggggttaaagacttacctgcaccagcgacagaaatcgaagctgcattcgaacaattctggaagctgtatccgaagaagaagagccgcaaggatgcccaaaaggcctgggtcaagctcagccctgatgctgatctgcagg

SEQ ID NO: 551662 - DNA, 651 bp, Homo sapiens
tgggctgcttacgaggaccttcccaaactctttctgcctgcctgggacggccgtcggtggatcaggagtgagtctggaacacacacaatataataacaaagagaagtgggcataagagggcaataaaaacacatttaaatgagacttcaaatgtagctttccctggtatcaaggaaaataaagcacacaaggcaaaataaagtaatgcgaactgatggtcagaataagctgtgtagccaatgggaagtgaggttagaggtcagtgtgtctcaccttgcaggtgagtgatcgcgtgcaggaccttttgctctccgggtcctggactccacagtgcttgttcgggtcaaacaccctccctgtaaacaccagacggagagaaaaaaaaaaaccaggtcatcacggctgatttcagaattttgtcttccggagtaccacgaagacatcttttgccaatacatggtgaatgacaggagagaagtgtcttacaaagtggtgttataggacctacagtagactgttgttcgactgaaacttcccaaattctcctgagaagttttccccctgagttaaacacttcaattgtgcctgtaatcttccacatgtcatctctatatctagctaggagtctgagttgggcgtaagcggtacgac

SEQ ID NO: 551663 - DNA, 354 bp, Homo sapiens
  misc_feature (1)..(1): n is a, c, g, or t
ngggttacgtggcttcctttaaaatgcataaagatatagaacatcacaggccgagcatggtggctcacacctgtaatcccagcactctgggaggccaaagcgggcagaccacctgaggtcaggagttcgagaccagcctcaccaacatagtgaaacccccatctctactaaaaaaaaaacacacacaaaaattagctgggggtggtggcatgtgcctgtaatcccagctacgtgggaggctggggcaggagaatcacttgaacccaggaggtggaggttgcagtgagctcagatagtggcactgcactccagcctggagacagagcgagactcagtctcaaaacaaacaaacaa

SEQ ID NO: 551664 - DNA, 374 bp, Homo sapiens
ctttgaggtgctgggagttagggcttcaacaaatgaattttgggggggacacaattcagtttataaccctgggaaataatctaacataggctggacgtggtggctcatgcctgtaatcccagcactttggaaggccaaggcaggtggatcacttgaggttgggagttcgagaccagcctggccaacatggcaaaaccccctctcttataaaaaaaatacaaaaattagccaggggtggtggtgtctgcctataatttcagctacttgggaggctgaggcaggagaatagcttgaacccgggaggcaaaggttgcggtgagccgagattgccccattgcattcgagcctggatggcagagcgagactctgtttca

SEQ ID NO: 551665 - DNA, 589 bp, Homo sapiens
  misc_feature (558)..(558): n is a, c, g, or t
atatgctgcaggtcatctaaggatccgtggcgtgaggcaacatttgcatttggtagagacaggtttgcatgtcggcagctgtctcgaactcctcactcaagtgatccacccactcagctctcaaagtgctgggattacaggcgtgaagccaccgtgcccagccatttttgtctggtatttgattcttaataatccaaccttgccaataaacagttggaatcctctaacccagaagatctaagcaatatttccccaacttccatgactaatccagaaagatatgcaaagtcatgaaatggtattgccattaatgtattcaatatttaatttctaactacttcaaagcatcctcacctgccattctctccatggcaatacaattggagatcaaatcctatttcccttatctgggatgccaagaggaccgttccgagtaaataaaaatcaatgcctttttcttacttattttcagatacctccattctctccctctctaccctagcctctcctctaacaaaccggcctatctcagagacccatcataaaaaatgacttggnctgtattagagattttgggggttggggaagt

SEQ ID NO: 551666 - DNA, 248 bp, Homo sapiens
gacctggcgcataatagtttcaccgcacatctttttgttcattgtttaaatgactctgtgtctttccagagaatttcctctatcttctcctggtgtcagttcctctatttgaagaggttcagcttctagttttcgctgatgaaccattaaaggactgtatctgccgctttgaggacctgtattctagctgttgtgacaaatgaccgaacgtctggcaccacactctcactaagaatttcactgataag

SEQ ID NO: 551667 - DNA, 399 bp, Homo sapiens
  misc_feature (280)..(280): n is a, c, g, or t
acggaccacacgctgactcttcccgggccctccatcgtccacgcaaatgctttaaacggactcagcagatgcgtagcatttgctgcattgggttaagttgagaatagagatttgcccctaggtatatgcacacatcctcatgctagcctcacgaaactggaataagccttcgaaaagaaattgtccttgaagcttgtatctgatatcagtcactggattgtagaacttgtcgctgattttgaccttgtattgaacttgactgttccccttggtatttgtntaataccctgtacatatctttgagtcctacctttattacgtgtggcttggtcatttcgtggctcaggtaagaacgtgcttctggaacacaagtctgtggcttgggagagtctgtgtggc

SEQ ID NO: 551668 - DNA, 311 bp, Homo sapiens
agtcggcctaagttaggtcccaggttggggagagccccaagtgagacaataatgaacacattatgtatgaacaactgttagagacagctaatcacaaacaacctgcgggcacaatgacctcattccacacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 551669 - DNA, 406 bp, Homo sapiens
  misc_feature (4)..(4): n is a, c, g, or t
  misc_feature (106)..(106): n is a, c, g, or t
  misc_feature (134)..(134): n is a, c, g, or t
  misc_feature (176)..(176): n is a, c, g, or t
  misc_feature (332)..(332): n is a, c, g, or t
  misc_feature (344)..(344): n is a, c, g, or t
  misc_feature (350)..(350): n is a, c, g, or t
  misc_feature (378)..(378): n is a, c, g, or t
cggncgccacgaacctgaacattggtctgtctataaaaaatatcttgaattctatgttcttgaatcaaaactaacaaaatttcatggtgcatttcctgatgcccancttccttctaaaaagatcattggccccnaaaattatgaattcttaaagtcaaaaaaggaaaaattccaanaatttctacaaaaacttctgcaacatccacaactgaattatactcaacttctggcagactttctttcccctaatggtggggaaacaccatttcttggataagatactaccagatgtttatcttgggaaaattataaaatctgttcctggaaaactnatgaaagaaaanggtccncatttggaaccttttatcatgaatttcnttaattcttgtttagtctccaaaagcct

SEQ ID NO: 551670 - DNA, 452 bp, Homo sapiens
  misc_feature (378)..(378): n is a, c, g, or t
  misc_feature (402)..(402): n is a, c, g, or t
  misc_feature (404)..(404): n is a, c, g, or t
  misc_feature (414)..(414): n is a, c, g, or t
  misc_feature (444)..(444): n is a, c, g, or t
ttttagaggtacttctcataagaagcatttttattctggcttacgctatatatatttatgcacttacctaattcccctccttcaatgaattctattttttttttccttgagacggagccagctctgtcgcccaggctggagtgcagtggcgcgatcttggctcactgcaagctccgcctcccggcttcacgccattttcctgcctcagcctcctgagtagctgggactacaggcgcccgccaccacgccaggctaatttttttgtatttttttagtagagacggggtttcaccgtgttagccaggatggtctcgatgtcctgaccttgtgatccacccgtcttggcctcccaaagtgctgggattacaggcgtgacanccgttgtcccgaccaatggaattntnatttaaattnatttatcatctgtcttgtttagccttaatntttccctt

SEQ ID NO: 551671 - DNA, 301 bp, Homo sapiens
  misc_feature (47)..(47): n is a, c, g, or t
  misc_feature (124)..(124): n is a, c, g, or t
  misc_feature (135)..(135): n is a, c, g, or t
  misc_feature (160)..(160): n is a, c, g, or t
ctcctcttttggtaccttttaaaaccatacctatatggttttacccntgttgtttaatatttgccatgttgtttcccccacttgaatgtaagcctcccaaagattttatttttttaaactgaantattactgtantcccagaacaattcccctggcaaanatttggtactcaatagtaatgcctaagttagtaaataaatgatgaatttagaatcaaaataacgtgtctatggccaaaataaaacctgaaaaccctgtcctattttcccagaggtaactgctgttaatagtttagttgtgt

SEQ ID NO: 551672 - DNA, 169 bp, Homo sapiens
ctatcgctggggttactttgtggagtaagaaggatgatctgcacacacccctatccccagcatcctggagctgacactatagtggggaggagagaaggggcaggttaataagcaaacaaagaaaataaatgctgtatatagttggatgtagatactctctgtcagctca

SEQ ID NO: 551673 - DNA, 156 bp, Homo sapiens
  misc_feature (25)..(25): n is a, c, g, or t
ttaaaggaagtagtcacatatctcntcactgttagatcaaagagctataaagtgattaatcattagggaggaaggtatgtcaaaatgccaatgatatggctaaagaagctatggcctcattgcaccttagttaagcaatgtttgtgatgtgcaaat

SEQ ID NO: 551674 - DNA, 589 bp, Homo sapiens
ttttcctgacatctttttttccttttaggattcattaagtcatatacttagtcccctgcaaagaagaagacagatgtcccagagcagactgaaagcggggcgtgggatcctaggcaatgcaggagggcaggtgggggagctgtagcagaacaagggtgctaggtgggaagctggcttggggaccacacgtctggctgactcacagggctatagcagcagacagagagccagatgctctactgcaactggtgagttggaggcttgcccacataacactgtctttctctccacccgccaagcatccagggcacagggctggttgctcacagattgagcgaggtagcacctcctaccagcactcaagtttatcagggccgcgttctaaacattctactgaagtttgctaagaaaccattaggtgaggctgagccaccgtgcctggccaaatgtcacttttttgataagtcagcagatccagctcttgagcacatcagaggctagataatcgggacagaaaggaaaaatcaatccatcagaaagtttatacatgcaattatgtaaaataaaatcaagaacaaaaagcataaaa

SEQ ID NO: 551675 - DNA, 138 bp, Homo sapiens
cagcagaaacgatgacaagatgagccttctcttctgctcctggtcaaggagatagcagaatttctcattctgccaggtctgtgttgcacatgcaaatacccgggtcaactgagatgggaactctgggctctccgatcc

SEQ ID NO: 551676 - DNA, 433 bp, Homo sapiens
ctttagctgcagtatatcttttttccagattcccccatgcaagcatgtccacaaaagacaataaaatgacatgtgtgcaggccacacacaccaaatggcaggttccccacagtgccccacatggggccaagacctacgtgcatgactcactctggttttgttttgttttgcttattctctgtggtgtaaagatactgttacaaatgccaaaaaggcctgcagatacccttatgggtaatagtaataagaaaaatgaagcatttgtgtttatatataacagagaaagtcaagcggctggagaaactggacagtggtgtaaatgtgaaatgtcttacaaaagaatagggtgttgggatcattatatatatgacctgaagaaacagaaacatgaactgttgaagttctatgttgaaaggataaagagaagtcagtg

SEQ ID NO: 551677 - DNA, 751 bp, Homo sapiens
ttttcctgacatctttttttccttttaggattcattaagtcatatacttagtcccctgcaaagaagaagacagatgtcccagagcagactgaaagcggggcgtgggatcctaggcaatgcaggagggcaggtgggggagctgtagcagaacaagggtgctaggtgggaagctggcttggggaccacacgtctggctgactcacagggctatagcagcagacagagagccagatgctctactgcaactggtgagttggaggcttgcccacataacactgtctttctctccacccgccaagcatccagggcacagggctggttgctcacagattgagcgaggtagcacctcctaccagcactcaagtttatcagggccgcgttctaaacattctactgaagtttgctaagaaaccattaggtgaggctgggcacagtggctcacgcctgctatcccagcactttgggaggccgaggcaggtgggtcacttgaggtccggagttcgagaccagcctggccaacacggtgaaaccccatctctacaaaaatacaaaaaaattagccaggcgaggtggtgcatgcctataatcccagctgctcaggaggccgagacaggagaattccttgaacctaggaggcagaggttgcagtgagcctagatcgtgccattgcactccagcctgggcgacagagtgagacttcatctctgcaaagcttgggctcccttccgacggagacaggcgagcagctgcc

SEQ ID NO: 551678 - DNA, 969 bp, Homo sapiens
  misc_feature (678)..(678): n is a, c, g, or t
tcactgggacaagattgcagtctccctcccccgctctgagaaactccgttccctagtgctggctggcatcccacatggcatgaggccacagttgtggatgcggctctctggggcgctgcagaagaagaagaactctgagttgtcctaccgtgagattataaagaacagctccaacgatgagaccatcgctgccaaacagatcgaaaaggacctgctccgtaccatgcccagcaacgcctgctttgccaatgtgaacagcatcggtgttccccgcctgcgcagagtcctccgagcactggcctggctctacccagagattggctactgccaggcacaggcatggtggctgcttgtctcctgctgttcctggaggaggaggatgccttctggatgatgtgtgccattattgaggacctgctgcctgcctcctacttcagcactaccctgctgggagtccagactgaccagcgggtcctgcgccacctgatgtccagtacctgcctcgcttagacaaactgttgcaggagcacgacattgagctgtctcttatcacgctgcactggttcctcacggcttcgccagcgtggtgcacatcagactgctgctgcgcatctgggacctgtttttctacgagggctcctggtgttgtccagactacgctgggatgtgggccttaangggggaagagctggaacaagctggaaaacaggttcaacttcaaaacgccggagagattctggcagatggtagccaaaagcgtgggggaagcccaaagcgggggggccccaaagaaggccgggaaaccaagggaggaacggccacctttggaccaggaccgggaggggcgccacaacacagggagaagaacacaggaaaggtgacactggagaaacaactgagaaaaaaacagaacgaagggtgcacaccacagggacagaaaaacaccaggctctccagccgcccacggct

SEQ ID NO: 551679 - DNA, 205 bp, Homo sapiens
ctgtctaagcaggtggcacactcagatctgatgcacagtaacacgacgtgcactagtatagccagacacccaggcacactcgtctctacgcacacagtggtcacaagtgcgcacacatgcctccatgcacacgcacacaggtacattaacatgcatgcatgcctccacgcgcacaaacgcctcctagaaatgctgagcacacacg

SEQ ID NO: 551680 - DNA, 100 bp, Homo sapiens
cttggacacagcatctagcaggagtacaaataggagctcttcaagcagcacatgaagatggccaggagcttcagccatcagagcagagagcagcactaaa

SEQ ID NO: 551681 - DNA, 191 bp, Homo sapiens
  misc_feature (38)..(38): n is a, c, g, or t
  misc_feature (42)..(42): n is a, c, g, or t
ggccaggccctggagagacagtggggcctcagtgggtncccnaagagaggagagaaacgcatggagacccaagagtgctgagcggccgggcacagaggctcatgcctgtaattccagcaccttgggaggctgaggcaggaggatcacttgagcctaggattaagaagattagcctgggaacccatctctac

SEQ ID NO: 551682 - DNA, 2129 bp, Homo sapiens
actgtttcacacttttctgcttctggaaggtgctggacaaaaacatggaactaatttccccaacagtgattataatcctgggttgccttgctctgttcttactccttcagcggaagaatttgcgtagacccccgtgcatcaagggctggattccttggattggagttggatttgagtttgggaaagcccctctagaatttatagagaaagcaagaatcaagtatggaccaatatttacagtctttgctatgggaaaccgaatgacctttgttactgaagaagaaggaattaatgtgtttctaaaatccaaaaaagtagattttgaactagcagtgcaaaatatcgtttatcgtacagcatcaattccaaagaatgtctttttagcactgcatgaaaaactctatattatgttgaaagggaaaatggggactgtcaatctccatcagtttactgggcaactgactgaagaattacatgaacaactggagaatttaggcactcatgggacaatggacctgaacaacttagtaagacatctcctttatccagtcacagtgaatatgctctttaataaaagtttgttttccacaaacaagaaaaaaatcaaggagttccatcagtattttcaagtttatgatgaagattttgagtatgggtcccagttgccagagtgtcttctaagaaactggtcaaaatccaaaaagtggttcctggaactgtttgagaaaaacattccagatataaaagcatgtaaatctgcaaaagataattccatgacattattgcaagctacgctggatattgtagagacggaaacaagtaaggaaaactcacccaattatgggctcttactgctttgggcttctctgtctaatgctgttcctgttgcattttggacacttgcatacgtcctttctcatcctgatatccacaaggccattatggaaggcatatcttctgtgtttggcaaagcaggcaaagataagattaaagtgtctgaggatgacctggagaaactccttctaattaaatggtgtgttttggaaaccattcgtttaaaagctcctggtgtcattactagaaaagtggtgaagcctgtggaaattttgaattacatcattccttctggtgacttgttgatgttgtctccattttggctgcatagaaatccaaagtattttcctgagcctgaattgttcaaacctgaacgttggaaaaaggcaaatttagagaagcactctttcttggactgcttcatggcatttggaagcgggaagttccagtgtcctgcaaggtggtttgctctgttagaggttcagatgtgtattattttaatactttataaatatgactgtagtcttctggacccattacccaaacagagttatctccatttggtgggtgtcccccagccggaagggcaatgccgaattgaatataaacaaagaatatgacatctgttgggcctcacaaggaccagggccttctggaggagtggcactaccccacctggcagcacctagacctgagctctacaaaaacacactgcttcactttgttttaggacttagttcaagaacacattcaaatggtgcatgtgtttggtatcttcaacagtagaccaagaatctaacatcactctcagtaatatagagaccggaatacatggtttataggaaatgatcaaatgatccaaaaaaactccacattttttaagaagttggaatttgatttcatgcataactgtattaaaacattaaatagaaataatgtcatttgaatgaaaatcttatcacattaaattcactgtgaaggcagcatacttaaaggaatttgatttcatgcataactgtattaaaacattaaatagaaataatgtcatttgaatgaaaatcttatcacattaaattcactgtgaaggcagcatacttaaatttttattttgaaaagtctaaaaggcttagatttttaaaatttaataattatttctacaaattttctatttttcttgaggtgattctcaactagcaattggaactcctaggctctattaacataattctttattgtaaacgtatctaatgctaaaagtaataaaatggtagttttctgagacctgtgaggacagg

SEQ ID NO: 551683 - DNA, 201 bp, Homo sapiens
tggtccggtcggcggcgagacggcgctcgttctcttcggaactgtcggggtcggcgtcgaggtcgtcatgcacccggtccagcagcgacagggcttcgtgcagctggatcgaggcgttctcgatcaggccgtccacctcgcccaggcgcgggtcgtgttcgatcaggcgcgacagctcgtgccgcacctgctgcagcaggt

SEQ ID NO: 551684 - DNA, 212 bp, Homo sapiens
tataataaaggaatataaacttgttctattataagacacatgcacgtgtatgttcactgcagtgctattaacaatagcaaagatacagaatcaacctacatgctcatcaatgatagactaaagaaaatgtggggccgggtgcggtggctcacgctaaggcttttttttttttttttttattaacttttaaattagacttttttttattgtgt

SEQ ID NO: 551685 - DNA, 502 bp, Homo sapiens
gacatatcaatgacacgtgatggctgtgtggcgaatgggaggactcaggttctacaacttgaaacctggggctcatgtatcatgtaccaggtggctagaagtgtagcaaatctcagtgccaatttgaggggaagccagtcattccaggagaatcagctgagtggaaagagctgtagacttccatattgcagtctcaattatccagtcaccctcctgcctagatggaaaaagccaggtggcagtgatggtggtgggggaaacaaaacacacagtctctggcaagccccaccgggaaaggagggctcagaaggcgtagcgcgtccggatatcctcgagttccttggacacttcgggttggggttcggcccaagttctccagagacgtcctatggtgggtggggttccatggacttgaactgctcacagaggtctccatcaatcacattcttcacagggaagtagtaggagcgaagctgagggtggtcccgccacacagagaggg

SEQ ID NO: 551686 - DNA, 137 bp, Homo sapiens
tgtgtattgatcttcactgtgtacgctgtctcctaaaacataccgttacctgtattagggccttatctaatataataaacactattcctgaaaaatctattttgtcaccctttatttcaggaagtttagttatagga

SEQ ID NO: 551687 - DNA, 427 bp, Homo sapiens
tattgagatagtcagatttttaattctaaaagaaagccacatgtagcggggtgtatgaggggggtcatcataattatgaataacatgcaatattatggtcaaaaagatgaaaaataatatgattagtataggtactttacttatttggccaaaagtctgttggttggatttttaactcagataatttttcttaaatcaaggtataaataccatgcctgacatattttctacggtgtactatgcggggctctcattgggtaaggataagcctacgttatgctgcatctcccaagtccatcctatagctttggtatgtcccactatcggcagcatcatcactaaatatctccatacttctcactatctcaatctttttcttctacaacatggtacaagggtggtctgtcaccacctaaccctatctatc

SEQ ID NO: 551688 - DNA, 243 bp, Homo sapiens
aggaaggaaaagataaaaggtgctaaagacaatgacggaggtagagatgaagctactcatggagataaaaaatgtatgaaaagaaaaattgagagaaaggactacagagccccgaactaataccaatagaagggcaatgcttgagatagacatgacaggtgactgaaaacagctaacaagtcacagtacacaagatagtaggtgataaaacataagtagaaggcgatgctaaacagcagaaga

SEQ ID NO: 551689 - DNA, 1500 bp, Homo sapiens
tataactaaccccccccctcatctctctctctctctctctccgacgcgggggggagagagaacaaaaagagagagagagagagagaaaacaacagctctctgcgcgcgcgcgcggggagagagagagagagagagagggagaaaaaagagagagagagagagagacgacacccttcgctgctgctggcgcgggggagggagagagagacacgcccgcgggggggggggggggaggggggggggagacgagagagagaaaaagagcgagagggtgtcgtagtgtctctctcgtcacagcggagagagaagagggtagggagaggaaggagaagagagagaaaacgcgagcaaccaactagcgcgagggagacaagcgcccgagagcacgaagggaagagagagaaacgaacaccgcgacacgagggggcgagagggacgagcagagcgaggaggcaggagagacacgaggcagacagatcagccggagaggcgtgtgctctctctgtgtaagagagcgagggacacgtaccaccgcacagagacgcaacaaacaccagagagagtgagcgggagagagaggcgaaaaccaacacaagcgggagcgccatgagacgcgcaagaaaatcgaataactcagccccactacgcgcacagtagaaaaacaacaacacacaacagcagcgctcaactacgagaagagacgagaacaaagacaacaacacacaccacaccggcccgccgaaagcggcgaagggcagaccaccacgacaacgcccaccagagggcagcgagaaaccaccaacaaagagagcagcggcgcgccccaccactactacaagaacgcagccgagaagagcgacacgtatcgtgtgacgagaagcagccacaaaacaccacgggccacatcatgatgtgaatgcagcacaataacacaagcgggcgcaccacacgcaaatcaaacaaaaagcatatataaacactgcacactcctcagatcgccgcaactccaaaacaacagtacgaacgcacaaccacgcggaccgacttgacaggcccacaccacaaccagcacaacaacgaccaggaagaaacacaaatcaacggacgccaggctacgagaccaacagaaaacgaacaggaacgcgaacgcgacacgacacaaaccaaacaaagaagaaccggacgccacaaaaacaacgaagcagcagaacaccgcaaccaccgacagcaggagaggagacgagagcgacgaacaaaaaaacacaaaaatcaacacaacgagcacggaagcgagcgcgcacaggacatcaaaactaacaccacgacgtgagaggcgagagcaggaacacaaaacacgacgccgacggcaaccaacgcatagtacaagaaacaaaggcgacagcccaacaagaccagacgaggaaggcaaaaatacaaacaacgaacacagcaggcgcagcacatcacaaacaaaaggcaggggagcgaaacaaacaacgc

SEQ ID NO: 551690 - DNA, 800 bp, Homo sapiens
tcgacggtccccttcattaatcatatttgaagagaggagccgagtggttatcagggtacagctattgtaaaatttaccatggcttacatccaatggaatgagtagatgtattttattgctataaaatgttagaatggagcctcagctaatgccagggttacgtatatctagaccataaagcagtttttcacaaatacatctttacagaaaaacagcattctagcttagcatctttccccttttaatttgtaggcttttaaaggcaaatcattcccaccatcactttttgccgggattatacacattctagaaatgattctgagaggagtgtatagtatggtgcctatctacactcacatgatattcttattcacgtttttttttaaccataagtggcaaatattttaaaatatttgaaaaacactccagaatctagtacgctttatttttagactgaacctaaagtaggttgttcttttaacaaagggtttaattcgggtggggaatataaccatatcaaaatacctgaacaaatggaacgttacttctagaaaagccaagaaatttgctatcatttttgtttcttgggaagctaattttgttgactgtttcgacctgcaatgtccgacggggggacctctaaagtcacctgcggcattcaacttggactggccctctttacacacttgctggacccctccgaagaagaaacaaaaaacacctcacaacaaaaaaaccaacaaaacaaaacaaaaacaaacacaaaacacacaaaaacaaaaacaacacaaccaaaccac

SEQ ID NO: 551691 - DNA, 114 bp, Homo sapiens
ctctttttcaagggctaaagggtttttaaaatttccaactgattaatatgtttctgctgttttgggttttgatggcctttacaataaaaccacctacctttggctttggtttta

SEQ ID NO: 551692 - DNA, 320 bp, Homo sapiens
  misc_feature (222)..(222): n is a, c, g, or t
  misc_feature (257)..(257): n is a, c, g, or t
  misc_feature (316)..(316): n is a, c, g, or t
caataaaggttcttgaaattgttaccagtgaattcagtttataaatcttattacaaaagacttacccacgtacctgaaatagctgccgatagaccagtgagaggtaggttctcctctgcccgttattaccgaccaaaaaaaaaaactggacatcaattttttagtaaaccaaaaaataagtctcaacaaatgcctttgccaaaataaggttttatttttganagtctttgatggaaagtcatttggaaggacactgngggggggagggggcctaaggccccacaggtgtagggtcccggtctggggtttcgtgccngccc

SEQ ID NO: 551693 - DNA, 777 bp, Homo sapiens
ggagagtagtgtctcgcatgttggccaccccctgcatgtcattctcaatgcgctgcatggtccagttttgtgggacgggaggccaagtacagtggtgtgctgagctccatgggaagatttgcaaaggaggaacgggctgggtgggattcttcggtgggacttaatcccctcaccctcctggtgcgagtagtgggtgttgcttggtggggctgttatcctgtctggggccacttcatcgaatgcctacgcgtggtggatgacagtctgtgagtgacacccctaggggaggctggggtaaacgaccagaatccatggtttcccatgttcagccaggccctgggtcatccggagctataccgaagttcgtgatggggattgcaagtgagcatgcgtgacctacccccttgctgtctatgttgggcgatcctcatggcttgtggagcaatctgcgggctgcaccgctgggttccccccttactccccagtgttcaaattccgggacttcacctgctggaagtacctgagtgtgcagggccaggtcttccgaggctccaggctgtctttatgcgacgggtgtcatccaaggatcattgcttgtgccctgggagtaacacctgaatctatcgtggacacacacatattggtcgtcaacacgtggtccaccgtgggtgaggctgaccaccttgggacacgctgccaggaagactacaaccaaaaagaacgagatgtggctccaggaccagacgggggttccagtggcgtattgccatgtgtctg

SEQ ID NO: 551694 - DNA, 406 bp, Homo sapiens
cagcggagtgacccagggacggaggacccaggctggctggggactgtctgctcttctcggcgggatccgtggagagtcctttccctggaatccgagccctaaccgtctctccccagccctatccggcgaggagcggagcgctgccagcggaggcagcgccttcccgaagcagtttatctttggacggttttctttaaaggaaaaagcaaccaacaggttgccagccccggcgccacacacgagacgccggagggagaagccccggcccggattcctctgcctgtgtgcgtccctcgcgggctgctggaggcgaggggagggagggggcgatggctcggcctgacccatccgcgccgccctcgctgttgctgctgctcctggcgcagctggtgggccgggcggccgc

SEQ ID NO: 551695 - DNA, 430 bp, Homo sapiens
ccatatattcatgtaccacatatatttggcaactggactcttatttgttttttttttttggaaacgagagggcaagggggcgatctcagctcactgcgacttcggcctcggttgtccaagtgattctccggcctcagcctccggagtaaaaaaacagttcctccagcgtccaaaaacatggtttaatgctcattgggaagtcagagcttcccctttctttactctcggcccttcactagtctgtactctatcacatcattgggtctttcccagaggggaacttccatagaaggggatgcagggtaatacgcctgggggacaagcttcttccgctaagttggatgcttgtgccatccggccatggtggtcacacagttgggtcccttgccctgctcagtgtggtctcataatataacaagtacccccatgg

SEQ ID NO: 551696 - DNA, 154 bp, Homo sapiens
tcatttcagaagaaaaactgaaagcaagactgtcagccattgagttccaggaacctaagagcctggatgcattatcccaccattgattcatgcagtgtgtagtggcaccacaaggactggcctcaggggccagacactgagagggagtgggagg

SEQ ID NO: 551697 - DNA, 304 bp, Homo sapiens
aacacactttttatttatttatttacagacagggtctgctctgtttcccaggctgtagttcagtggcgcgatcacagctcactgcagccttgaactcctgtgctcaagaaatcctcctgcctcagcctccagaaaaaaaaaaaaaaaaaaaaagggaaattttttgggttccctcgggtagggccaaaaaatctttttcgggacggggagggtatttaacacttttgggtggtcttttgggggcctgtacgtagtaaatggagggcccaattatttataaaggatggcacaattgggtcgagat

SEQ ID NO: 551698 - DNA, 267 bp, Homo sapiens
  misc_feature (254)..(254): n is a, c, g, or t
cagaacaaccagatttaaatgatgaattaaatgcccaatttgggtgaggcatggcaggtgtaagagaaaggaaaagcttaagaaaacatttcctgtatgataccaaccgtttctttcatcatctactgtcatttgacagataattaatccttttagaagtttttacccggtgacactttcatttccttgtacaatgtaggtgtaacatctccatcttctgtatttatgtcaaatatacatgtcgttagtcacangctccctgacggc

SEQ ID NO: 551699 - DNA, 786 bp, Homo sapiens
ggaagtaattagagcttgaaaaaatctgttggttcaggcagagagctatattggaggaagcattacagaagaaagagatcttttaggaacagttgtggggtgggcctgcaaatttagaggctatggctaagaaaggaaaatttaataaataatgggtttttcgtgtggatgtactccaagtaaagctccagtgactaatatgtataaatgttaaatgatattaaatatgaacatcagaattactttggagggtactattaatatggcgaattaattttaatctcctatggatatactcggcgaactccatttacctcatttctgtgccaattactcacgtggggtattagtgcgtaatctggaacatttagctaaaatatacactttggcttaaaaattatggctgtcaattccaataataattcttagcttataaccaaagagcagtgtttacaaggagagcttctataaaaactattcctgggttacttttcatacaattttgttctgttttacctggaaataatttaccaaaataactgagtgtgtgctgtaaagaacaaaagtggggaggtatcagggaacaagaacacaagaaagggtatgatcaatcattttcttctggtccaaacagctgggttacattcatggggaatggccttcatttaaaaaagatgtgcctcaataccatacaaattgtggactttgcgcttttcataataagttctattgtaattactaatacaggcggtgccagacatggagccatggtctcaagggcccttg

SEQ ID NO: 551700 - DNA, 972 bp, Homo sapiens
  misc_feature (632)..(632): n is a, c, g, or t
tagtttgaacccagagagtgatgaggctgcaaagattgtgccgagtatactcgaatctgatacgacagagatgagatcatgtctctaaaaataaagctcttctcatataactagtgactgcgtcgtagtctggagtagccccaggtgctgcatcgagaaaacggcccaaacgttgtactgacgataactcttacctagcttacagtagtgactttgtgtgccgttccttcgactctaagttgcttctaactgttataaaagaatttgggttactacctgggtattattagaagtcaatacaagttctaacactggcgttacacctttgtcgacttgtcagttaaggtcctgccagactagggtgcatctgtgatatacattgacaatttggtcaggaaagctcggtaatgcaacatgtattttatgtgtcgggtccatcgcactcttcgtggacttctggacggggatacaaggctttgtgccgtaacaactgggcatgtgaggttagtatatcataaggcagtatatattatttgtttcattgcaactaagttgagaaaagagcaattggagtttacggacagagagtagttagaacctggttgcttatattctggtaaaattccagatgntgcaattatctcaattgaggtgtcccaagttcgaacttgttttaaaggcatggggttaaatattggagcttggggggttcttggcggcttttatcatggcgctgctgctccttataactacgactcttgtcacagtgagaagcgacgcctaacccttctgcacgcgaagaactggtaacactggagatgcgccacattcgcggggcttcggcacaacgctttgccaaggcccccaccggtattccacgcgtacacagactctatggcgacacactcctccatgagactggtcactgcatcgcaccagatatcacatctgtcctcacccactgccgccgcc

SEQ ID NO: 551701 - DNA, 198 bp, Homo sapiens
gaaatctctttctgctcactgtgctttgcctgatgcatggcgagtgccccgcagtagccttggctccgtgcttggtcccactctggggttctcgctgtgggcgcaggctggtgtccgtctttcctttctttatccgagtgctgagggccctgtgcatgccctgcaaaccaacaaccctgtttcagcccctacaaagtt

SEQ ID NO: 551702 - DNA, 980 bp, Homo sapiens
atggcacatgcagcgcagagtgggtctacaagaacgctgatttgccctatcataggaagagcttatcaccttataacatggatcacggcccttcgataaatccaatattgtcctttgatcttgggttccctaagtcccttgtattgcccttttttctctagacgaatcgacaaacaataagtaactgaatactgaacaatcgtcagacggctcaggagcatacgagaccggtcgtggaacttatccttgctccggccgatccatccatagttccgtctatcgggtcccttctcgagtcccttgacagcgtcccttttaccagtcaacaaggacggagggctcaaacaggaaagttccacattcccctttataggcattcaaagatctaattgggcgcggccaaatggctagctgtaaacctaacgtagcataacacccgggataacttgcaggggaataaagtcttggcaatattcactaccgatttacttttccgccgcattataatgtcctagacatccggagacgaactatgagaattccttaggaagagttggaacaatagaacgaggtttagtaatctgccccgtattggaaagaaaccctcaattctgtaatataatattttgccgtcacaaaagaccgtctgggcagcccaattgaggcatgccccgcaatatttagggctttaagataggaggattgctaatactcggtgagggtcataagaggacacaatcaagtttatcaggtacaacgactcggggagtaatactaacgggagatatgctcctgaagatcctggtggagcaaactcaatagttgtctgacgcatcgtcgtagaatttatttccccttatcaattgttgacaaatgcgggccgttcaagtacctaaattgaacgcctgtagccgtttaaagagacatcaaataataagtgaggacatacacgattgcgccacaacaaaactcttagaacc

SEQ ID NO: 551703 - DNA, 345 bp, Homo sapiens
gctcgactattaacgcagtggagaatcgaataattctttgaaaagataggccaagcgtggtggctcaccctctaattacagcactttgggaggctgaggcaggtgggtcacttggggccagaagtttgagaccagcctggccaacatggtgaaaccctgtctctaccagaaatacaaaaattagctgggcatgatgacgggtgcctgtagtccccactgctcaggaggctgaggcaggaggatagctcaaacccgggaggtggcggttgcagtgagccaagatcgcaccattgcactccagcctgggcaacagggtgagattctgtctcaaaaaaaaaagtcgac

SEQ ID NO: 551704 - DNA, 775 bp, Homo sapiens
  misc_feature (9)..(10): n is a, c, g, or t
  misc_feature (21)..(21): n is a, c, g, or t
  misc_feature (80)..(80): n is a, c, g, or t
  misc_feature (443)..(443): n is a, c, g, or t
  misc_feature (553)..(553): n is a, c, g, or t
  misc_feature (560)..(560): n is a, c, g, or t
  misc_feature (574)..(574): n is a, c, g, or t
  misc_feature (634)..(634): n is a, c, g, or t
  misc_feature (640)..(640): n is a, c, g, or t
  misc_feature (652)..(652): n is a, c, g, or t
  misc_feature (665)..(665): n is a, c, g, or t
  misc_feature (678)..(678): n is a, c, g, or t
  misc_feature (686)..(686): n is a, c, g, or t
  misc_feature (690)..(690): n is a, c, g, or t
  misc_feature (694)..(694): n is a, c, g, or t
  misc_feature (705)..(705): n is a, c, g, or t
  misc_feature (712)..(712): n is a, c, g, or t
  misc_feature (735)..(735): n is a, c, g, or t
  misc_feature (757)..(757): n is a, c, g, or t
gacgccttnncggtctttttnataatgaattagtaagatttcatttttttttggctaatcaatggagggggagatgagtnaaaccagtatgttattgactgagttaaatcttacaagttgccttcagttgaaaataggtatggaaaattataagtgtctttttgttcaaaataacattttaccttaaaaactaaacttaaatatgaagcaataaactataatgtacataaaagttttaaagagatattcacataaccacaatttcctaattttctctattcccactactcagagggaaaccacagcttaattttggcctgatttctacctagatgctactttgcaatgctgatgcctttccatgattttactgtagaaatgtctatccagataaaagtcaaaagtccttttagtttctcagcgatgcttacagcctgtcttanattcaatcactggttatctgttactttaaaatacaaaacacttttttctgattcatctgctcacttctgttttatacaaagattagaaatgacttataaaattatataanaaatggnttggtaccccctanaatggatcatttttggtaatacacctgccttccccccataacacacgtccttaaaatttnccattntttaaccaaccngtcctttttcctnaaggcatgggttnttataatnaccnccgnttggtgggttnaactaanttttttaccaattttaccttttnaaattttggaaaagttttgaanccctttgccttcaaaatt

SEQ ID NO: 551705 - DNA, 358 bp, Homo sapiens
gctcgaccgggttcaagcgattctcctgcctcagcctcccaagtaggtgggactacaggcacatgccaccatgcccagctaattttttgtatttttagtagagatggggttacaccttgttagctaggatggtctcgagctcctgacctcgtgatccacctacctccgtctcccaaagtgctgggattacaggtgtgaaccactgcacccagccacgtacattgtgcttttaattgtcaggatgtccgcagtgatgacacctggccctagccttgccggaactcgcccggactgaacagggagctgggattggaacctgggattttggtttctgagactgggctctcaacagtcgacg

SEQ ID NO: 551706 - DNA, 367 bp, Homo sapiens
  misc_feature (325)..(325): n is a, c, g, or t
ggcacgagggtctagtggctgagtggtgggtcacaccctgtaatcctagcactttgggaggccgaggcaggtggatcgcttgaggtcagaagtttgagaccagcctggccaacatggcgaagccctgtcttcactaaaaatacaaaaaaaacccaactaaacaaaaaaaaaaaaacaaaaacaaaactagctgggtgtggtggcacacacctgtggtcccagctacttgggaggctgaggcatgagaatcacttgagcctgggaggcacacgtggcagtgagctgagatcgcaccgatgcgggccagcctgggtaacagccaccngggggggggggggagcgaaggcgcggggggcgcttcaaccgc

SEQ ID NO: 551707 - DNA, 413 bp, Homo sapiens
ataccttcataatgatctccagctttactaaatgaaaaaaacaattgacagaatatgattcatagtgtgctgcctctctagtgcaagaaaacaggaaaagaccatatattgcttatatctgcttgaagaaatgctacatcgaaatagatgtataggaaataaaaggggttacctggtggaggggaggaaccaagtgattgggatgaggggaggaggacttctccatctctacttttttatgttgttttgtatacctatttttaaaacagattgaaaaattaagaaaaatgtgtactttgttctagagtgatgatggttgtacaactgtgaatattgtaacaaatcactgaatggtacactttaaagggtgattttatggtatttgaattatatttcaataaaataattatttt

SEQ ID NO: 551708 - DNA, 620 bp, Homo sapiens
agttgggcaacgttcttgaaggagcggacactcgggtcaagtcttgaagatgagcagaagtgtttgctagatggggaagaggcagggtaggtcatcctaggttttccctgctcctagtgtgaaagggcatgatgtgtttgaaaattcatctttgtagttgcacataactaatgcctcagatatattggtggcctttatctaatgtagctgcacagtacgcccatggacttctaagccagagagggcctaatgtggggcactgtagctcctacagggctttcgggtccctccgccaaaaggtgggcaccttcacgttctcagaagtcccagggttctttcgcgggaacaccgagaagataatccctgaggtcctctcagccttccaaatggagcttagctctttcaccccagtccttactttcctgctgcgtacacttcggcggtgtcaaacaggtttacacatgctcataggctacagtcagcacatcctctgctgtctcatctgagatctgagaacaaaatgtgacccaggtacataggccaagacaggatacccgaagcaccgacttccctaggttcctgcaagatacagaagcagagggaaggggtggagctccatt

SEQ ID NO: 551709 - DNA, 469 bp, Homo sapiens
gggctgacccgaggttatgtgatttatcccaacacctcaggagtaaaggcaggcagatcatctgaggtcgggagatcgagacccacctgaccaacatggagaaaacccgtgtctactacaaaattagccaggcgtggtggcgcatgcctgtaatcccagctactcagaaaggctgaggcaggagaatcacctgaacccgggaggcagaggttgcagtgagctgagatcgcaccatttcactccagcctgtgcaacaagagaaactccatcgttaaaaaaaaaaagggaggctttccttaaagagaaaaattaggtaacgggttgtgtggcatgtgccggcccggtttttaaattccttcccagggtcttggtccctttgacggttagggaaagggacctttataagggtttgcggtttaagaaaaacaattcttttggagaacgaggttttccttttggtaaggccaca

SEQ ID NO: 551710 - DNA, 588 bp, Homo sapiens
ctttctgcattggtctagacgctggtttgtaacccaggtgcagctcattttagctcattgtggtcatctcctcggaagtcccacagcgagcgtgcactcaccttttagcccagtcctggatggggtgtgactgtgcacacacgactggcgtgggtcccagatctgagtgccccagtaagcccatttcctaaacaaaaagggtttgaagaggctatctagcctaaccctctgccctgcaaacagagccaacggccttgattatcaaatgagaatgtggacttcggaggcaaactggtaggggcattaagaaaccagaacttaaattgcttccacatctggaaaacaaacccagcagccagccccaagaattccaggcatgccagctcaaagagaagctgcaggtcaaggggaggcttttccctcttagctttcagtccccccatcacctacctaaagccacagagatctcctgtctacaaataggctgtggagccacaaatcagaagaagagaacaaagttgaaatactagggcgcctaccatgtggccggtctgctctgtgctttacagaggtggtaacttccatgct

SEQ ID NO: 551711 - DNA, 276 bp, Homo sapiens
aatctatggactgagatactcctcctgaaggactcctagctagaccccctgatgatagtggtcaccaagatgatggtcctcagcagagagcaccaaaacatggatggccatcaccgatatcctcgcccacctccttttcaaaatcagcaacgaccaccccaacgaggacaccgtcaactctctctaccccgatttccttctgtcagcctgcaggaagcatcaacattctatccgtagggacacaccagccggcagatccccaagaggaggaggaat

SEQ ID NO: 551712 - DNA, 237 bp, Homo sapiens
cccaaacccactccaccttactaccagacaaccttagccaaaccatttacccagataaagtataggcgatagacattgaaacctgcgcattagatatagtaccgcaaggaaagatgaaattataccagcatattatagcaaggactaccctataccttctgcatattgattaactagagataactttgcaggagagcaacagctaagaccccgaacagagagctactcagacagcta

SEQ ID NO: 551713 - DNA, 247 bp, Homo sapiens
cattggtccgagagaaattagttgtggcaataaaaataattaatcgatactagtataagagatcaggttcgtcctttactgttgtgtatcgttatcatttgttttgaggttagtttgattagtctttgttgggtggtgattagtcggttgttgatcgcgatatttggaggtggggatcattacagggggaaatatacattgatccgttctgcttgcgcggtagcgccttatttctctcggaccaatg

SEQ ID NO: 551714 - DNA, 241 bp, Homo sapiens
atgccaatcatttttcatccattttcctcaaaggttggtgaacaagtgctaattcctcgggggccaatcgggcctttcacatcttctctttgtcagagtggtctcttccccaaagagcattgattccatccgcggcactaggaggtgaaccatacccaaagaactttgcctctttagctctttcagcacaattccaaatggatctgtggcgttcctcaaccgtgttatgccctgttcaacc

SEQ ID NO: 551715 - DNA, 282 bp, Homo sapiens
tggcagtcgtatttattttaattcataaattacatttaacattagcagatttaggcaattggtataggctaaatttacaaattactttaaaaaactcattacaaaaggtggccgggcaggggtggcctcacagcgtgtaactcccagacactttagagaggctgagggtgggcggatctcacgaggtctcgagggagtgtgtgagaaacgagccgtggcccaatcagtgggtgaaaccttcatcttctacctaaaacaaaaacacaaaaacaaacaaacaga

SEQ ID NO: 551716 - DNA, 291 bp, Homo sapiens
ggtcaggcgaggtccactttgggagactgacggcagatcatttgggctcaggagttccagaccagcctgggcaacatggcaaaaccccatctctacaaaaaaaatagccaggtgtggtggtgcatgcctgtggttccagctactcaggagactaaggttggaagacggcttgagcccaggaggctgaggctgcagtgagctgtgatcatgtcactgtacttcagcctgggtgacagagtgagaccctgtctcaaaaaaaaagaaaaagaaaagaaatacagagtagttgcc

SEQ ID NO: 551717 - DNA, 946 bp, Homo sapiens
ttgacgaaaatacatagcgtgcgtcgttcttcaaaaatggtattatccctgggggatgtccccgctcgccaagtggtgctagatccgtcacgatagatcgttttgatggctcctggtgggcatcaccaggactattaggtgtttattccccatagcgagctcccttgtggacaatgagataggtctatttggcgggaactcaactctaaaagtggtttcaattactccacaataatcacatttctgggaggcaacgccctaattctcttaaaagaggaggggccacctccccaaatgggaccgatgctacccaattttgctccagggccggtttaacactaagcgcggaactcaatgtgcggtatccaaactggattttgacacccaaacgtcctaaaatagttacgcgttgaaatttccactacaacggggtgggaaatttgaccaccgtaacgtgggaaaagaactatcttgggaaaaggcctccattcccattaattttccgggaaaaagaggaagagaccgtggaagcccttttaagcctgcgctttaaacccgggaagggaatggcaacctcaggagcaaaccagacagtttcgatggtgggagaattcctcttttacagaaagttttcccagctagtaaaactgtcaaaggaataacacaacagactattaaactttttagagaatttctaattaatagattgggctgggcgcagtggctcacacctgtattcccagcactttgggatgccgaggagggcgaatcacaaggtcaggagttcaagaccagcctggccaatatggtgaaaccccgtctctactaaaaatacaaaaaattagctgggcatagtggtgggcgcctataatcccagctactggggaggctgaggcagaagaataactgaacccgggagttaccgaggttggcagtgagtcctcga

SEQ ID NO: 551718 - DNA, 171 bp, Homo sapiens
  misc_feature (23)..(23): n is a, c, g, or t
gctcagtatcccccacgccaccngagaagggctgtgttcctttaaatgtggttgctgaggtgctgtgggtggggaaggctctggaacggataactccagcagtgttgtatgaggggggaggaggaccgtatatccaatgctttccttctccggtggcgtgtggaagccctc

SEQ ID NO: 551719 - DNA, 1858 bp, Homo sapiens
cctttgtcggaggcgtttgtttcgctgcgtgctgtttctgtctgttcagtatgtctgcgtctgtcgttgtttctttttcgctcctgcggtcatcatagggggcacacttcccggctgtttggttggatttcgccgtcgctatcatcttgtatagaggtgatcagtttttgcacctagttcgcgcggttcctcatgttgtgtgtctctccctcgtttgagtgaggtggaggggattgttccctctgattgtgttcttctgttctgtgcctggggttccgccgcctcgatgtgggggtgcgcacgccccacatatgtctgtggacctgttccacaacgggggacccctcggtcagatgctgtattatcaagagggataataagagttggattggcccaaatgctcagatgtgcccgcgatgaacttctcctccgaaaaatgggcccacactcgtgcggatgacaaaccgctgtttcagtctgatgtgccccatagcttgagttgtgggtgccctcaatattgtgtggtgccgccccgtgtgggttaataccctctgtctgtcgttgatgatagtggttcaagcggtggtgattatcttccctctcccccccggtgttaatgtattcgttgggggcccccgagagggggcgccgtgtgtgttggtgtcggaaaagctggttgtttgactagtgcggtggtgccaccatcattggtgaagccccccatcggttgcccacaatattgtttgtgtctgttgtgtgccgcgcgtgctgtcgtgtcaacgacttctcatctgtgggggacgcctcccgttgtctgcgcgttattactcccttcaggatgttgcttccacgggggcatgcgcccgttgtgctcccgggtgttagtgcgacacctcacggggcggttgtgtttgtgttttggtgtgtggtgttccttggaggtcctcctcctccccatgtggggggtgttggtgtcccctcttccccatagcgcatttgtgttcctcgcctggtggagtggtgccacttctgttgtagatgggtgttataatacccttatgctctcacaccccctttgggtcggcctctgtggtgtgttacacccccaacggagttttttggcgcttctctggcgcggtctatatagtgtgtgggacgcacttgtgtgccgcacttccccccactgttctcctgtgccacacaccacacagtggggagtgcctctcacacttctcacagtggggggttgtgtgagaaaggttgtggttggtgatatgtctacggggctctcgcgggagaattgtttctgggccgccacatgccgctggggcacaccactgttgccccgctgtagacacacacccactcggagagaggtgtcacatggcctctgatatctgcgtgatactgtgtctgacacacagagagagttccctcgaaagagaggattttgaaaaaacagaaagagcgcacggctcgctcgcgctctagagaaagcgcacagtggcacacacacaggagaggaattttccacaggggttgaattggacttgcttccccggctccctgcgagggtgtcctctgtgcgtaactcacccctcgagaggtgtccacgagctggttctcgaaaggtgtaccacaggtggccctcctgtggcctattcacccacattccctcatctgaaagaactggaagcgctcacagcctgccaccggaaagaactggttctccacagctccccctgctcacggccacctgaatgggtaggagccacccctgactggttttaacctcgtttttgcataggctcttaagccgcctggaaaaatggttgatggaaaataaacctccgttttt

SEQ ID NO: 551720 - DNA, 505 bp, Homo sapiens
ggagagagatgaactagtctcggtctagattgtgtttcttttataagaggaaaacccggtaatgatgtcggggtgaagggataggaggaaaatgggggataggtgtttgaccctgagggtgtattgactcgtggtgactggagtggtttgcatggtaggtcacaggtgaggtggagtgtagagtggacgtccccgatgtgttgtgtgtgcgtaacatatttgtacgaaggagacgtactagggctggtagagatagtcatcgtataagatgtcccatagtaaagtaggaggaaaagtgacaatattggagcatccgcagtagacaatatgcgtggtgcaaacgaaaacacctacacggtagatagtgccctcccgccatcgtcagttccaacataatgcgaggaggtgggtcaaagcgtcaacgcgccaaacccgtcgcgccttggctgtactacccgccagcaccgacccaatccctttcacgcggagcgctccccacgtactg

SEQ ID NO: 551721 - DNA, 346 bp, Homo sapiens
  misc_feature (346)..(346): n is a, c, g, or t
acgagagaaaacctgtgttggagtgaccagagcgcgaagtgtttattgagcacattacactctcagatgaagagagagagagttataaatctgtgatgaaagcagagccactattggaagaggttttaatggaaggactgtgctgtgacaatatgcacaagtgccgggtcttttggttagactcggggaaatttgtgtggcatacttacacttttacaggaaggttataagggagatggaggttattctgagcttaaggtcagatgaggaatgtgcaatttggctggattctttaacaagttctgtgatatacacaatgtgcacaagtttttgtgccctgtgtttn

SEQ ID NO: 551722 - DNA, 201 bp, Homo sapiens
caggatttaggtattgagtggcatgtgcaggagtgtacaggtatggggaaaggaaggctggcttggcgagagggcaggtttgcgggctttcgacccccttattccaaagtaccaacaaagagtccttcccacaactcccaagctcaacccctatttggcaactactgtgtaggtggttcgggacacctgatgagtcagcat

SEQ ID NO: 551723 - DNA, 543 bp, Homo sapiens
gtgcggagccgcaggtcctggtacaatacttgtgtgttacgaaatggatctatcacaatgctccgttctcctgtgccggcgtggcgcactggtagctgcaggcttgtcacgcggccaccgcggccttgcacactcaccgctgaccaccctgcacacatgcctgcttacctccaagatgcttgggtgctgcatgctgcaaatgtgtgtcctctgaggccccagatgagaccaccctaaatggagcttggcctgagaccctgcaaacatgaatgaacatttgaccacatgctgtggcttgagcaaccagagaatatcgccacttgtatatgctctccgggccctaccccaaggaagaatttgggccagtatttgaagaagttccagatgtgttcaagtaacttgctgctttgatgtgtatagaatacgcaggccacccattccaaagcatcatgtgtaccttgcagatgtcagcattgctcccgtctttcagttgtgacaatttcttgagggttaagcacatgtcatattaaagttgtcattaat

SEQ ID NO: 551724 - DNA, 301 bp, Homo sapiens
cacgagctgggtgtaggaaccccgggcctggcgtcccctttaagccacgccggccccacagctggggcatcgtcccttccccccgccaccccagcaaactgacaccaaacggggaagaccacgatgcccaggaagatgcccacgaaggtgacgcagtcctccagcacccacacctccagcacaggacagcctcccacgcccacgatccagttggcaggccagccgccccgcgtcccgcctgtggatgttgtacacctggcgatggtgggtgggtatccctgccacgaggtaggggtagggc

SEQ ID NO: 551725 - DNA, 775 bp, Homo sapiens
  misc_feature (18)..(18): n is a, c, g, or t
  misc_feature (29)..(29): n is a, c, g, or t
  misc_feature (45)..(45): n is a, c, g, or t
  misc_feature (54)..(54): n is a, c, g, or t
  misc_feature (56)..(56): n is a, c, g, or t
  misc_feature (63)..(63): n is a, c, g, or t
  misc_feature (67)..(67): n is a, c, g, or t
  misc_feature (78)..(78): n is a, c, g, or t
  misc_feature (82)..(82): n is a, c, g, or t
  misc_feature (91)..(91): n is a, c, g, or t
  misc_feature (93)..(93): n is a, c, g, or t
  misc_feature (420)..(420): n is a, c, g, or t
  misc_feature (425)..(425): n is a, c, g, or t
  misc_feature (459)..(459): n is a, c, g, or t
  misc_feature (764)..(764): n is a, c, g, or t
gcctttacattaattgtnacccggcaggnttttacacacattttngaattaagntncaatgantttnttaattaaccnccgntacagcccngnagcgcctccaccccagagacccggaccaagttcacacaggacaatctgtgccacgcccagcgcgagcgcctggactcggccaacctgtgggtgcttgtggactgcatccttcgcgacacctccgaggacctgggactccagtgtgacgccgtgaacctggccttcgggcgccgctgtgaggaactggaggacgtgcggcacaagctgcagcaccacctgcacaagatgctgcgggaaatcacagatcaggaacacaacgtggtggcactgaaggaggccatcaaggacaaggaggaacctctgcacatagcccagacccggctgtanctgcnctcacaccggcccaacatgcagctgtgccgcgangcagcccagttcagccccagctcacaccccccaacacccccaagctggtgagtgaggtggaggagctgtacaagtccatcacagtgccgcgggagaagcttctacaagcagagcagtccctgtgcaacctcgaggacatccacatgagcctggagaaggacgtcaccgccatgaccaacagtctattcatcgaccgccagaagtacatggcccatcgtacttgctaccccaccatcctgcagctggctggctaccagtgagcagcggcacggtgcttccccccaatcccccaaataaaccagggngttagctttca

SEQ ID NO: 551726 - DNA, 155 bp, Homo sapiens
  misc_feature (9)..(9): n is a, c, g, or t
  misc_feature (21)..(21): n is a, c, g, or t
cttaaacgncggcgtcctttnttccgggtaaactcataaaacaaaagttaagcccgcgatcaaccataagcctaatcctaacaacacttcatatcatgcctacgatgaacaggttactaccatttcccatcgaatgaccaacaggaggctaagtc

SEQ ID NO: 551727 - DNA, 1222 bp, Homo sapiens
  misc_feature (439)..(439): n is a, c, g, or t
tgtgtaaacaccgggtaacccagtgtttattataaaaaaatgcccctttactctttaatttgagaattgcgagaagccgccacgcaccgggccccttttctcgtcacaatgcaacggggggcactgcacggcaaggtgggcaccaaaggcaaaggggcttcgcgtccctgtggccagagattgcagtgtgtgaacgccttggtcctccaccatatccagttctcagcactataacagagtcacaggaaagccccctctctgtgcgggagtgccctgtggggagccacagcgggtctctgtgtcacacaaatgtctctctgtgcgtctcaaacagagaaagcgctcataccatatgtgagggaggcgttggtgtgcgctctgtgaggagaacacccttgtctggcgctctcaggagacacatgctcctccacaacgagcngcgacgaacatgatgttgtgtgtacacacaaacgcgtgtgtacaaatgaggggaccacacaagttgtcttacacggggtctcaacatgaagttgtcttcaccacctgttgtggtgtggggcctctccccaaacgaggacgctatatgtccggggacaaaaacaacgcccccccactgggttctcctgtgggggccaccaaaagaacactctgttgtggggtcaccccaagagatattttttgtcgtgctgtagtgtctcccccaaagatattaattatctcttcccccaccacaataattttatcaaaaggcctctttcattctcaacacaacatattctacccagagaaaagaccccgttatctgtgagctctacgaggggggagatattaaccctattctcaaaaaaatgtggtccccaaggggagggatgatacccccaccagatcagcgacttaagacaaaagaacctcactttttgacccaggggttcgacgagggggcgccccatatgaggaggaaacataaatcaagcacggagtaccacagagaggttacaacccccaggaggggggcgcaccacgagacgaccacgacaagacggtgggcccccccctgaagaaacgatcgccgccggggcccctttgtgtgggtgagcacaccccccgacatgtttccccccccgaggacacacatccgcagttgcaacaaataaaataaagtgatacaccacccggtgcgggaacacaaataagattcccccctactgctgaggcgccacca

SEQ ID NO: 551728 - DNA, 192 bp, Homo sapiens
cgatcccttgtgactgtggcgtaggtgggcagctgcagctctgatttgacccctaccctggagacttccatgtgccgcaggtgtggtcctaaaaaccaaaaccaaacaaattttaaaaatgcatagaaaaggaaatttgcaaaacatatatcaccactttgggggaaataaaaatgtttttgaacttgatgg

SEQ ID NO: 551729 - DNA, 654 bp, Homo sapiens
  misc_feature (133)..(133): n is a, c, g, or t
  misc_feature (135)..(135): n is a, c, g, or t
cggacgtgcggatcccagcggctgtcgtgtagctgagcagcctggggcttggtgctatgtacctgtgcgttatgtttccagctgtctctgggtgtgccaagagcgaataagagacgacataaatctctgcccngnagcgcctccaccccagagacccggaccaagttcacacaggacaatctgtgccacgcccagcgcgagcgcctggactcggccaacctgtgggtgcttgtggactgcatccttcgcgacacctccgaggacctgggactccagtgtgacgccgtgaacctggccttcgggcgccgctgtgaggaactggaggacgtgcggcacaagctgcagcaccacctgcacaatggtgcggcaccctgaacccacgaagacggctccggcgcctgcccacgcactctgacccctctcatcacctggccttgggacctcaaacagccattaactcacgtcgtgatcccagctatatcccgagggaacccagaagcaagtgtcacactctcccaaaagcctatgtaaaaccaggtgacactgggtatgatcgcaaggtgatgtagcaaccacccagtgactgagccaggaggagctgatgggagcaggatgaagggcaggagctggactaggggagacattgaatgccgg

SEQ ID NO: 551730 - DNA, 387 bp, Homo sapiens
gacaacacaaatttgggagggtgagacactgcacagaagacagcagcaagtgtgcgcctctctgacatatgctaacccccaaatactctgaatttgggagtctgacttgtgccccaagtgggtccaagtggctgtgacatctacgtagggttcaacacttcaaatgctgcctggaaccaagggtaaaagtctgggtcaaggcttgcaatgtgcgcctcaagtgtatgaaaggccctcctgctgaacctttcctgtggcccaatcaacggcaagcttcccttaattcccctatccaattctccttctcaaggaaggggtcatagatcctaagccataaaataaatttaattccaaattaccaaattaaataatctactgtacacaatc

SEQ ID NO: 551731 - DNA, 675 bp, Homo sapiens
aggttctccaaaccctagggatattggccaccatggttgcaaacctcttgattccaaggaaacccctgggcactattctatctatctttgtttttaaccagttatgtttgtggattataatttgccataagcccaatgttcccggagtttgccaaaaactttgagacagggggacaccctttttagtttggaagtctataaaacaacgttcccaaacagtttaatgttgaatcattccccttccatccatatatatgcgcgctttgttacagtacgtggcatatcaagaaccaatctgcgcttgttgagctagtcaaacactagcccaagtcgtctaacttgcaagtgaagcctgttatgtatcatttcccagcttgtgtatagaagtgttgcaaggctgcgcataaggagactttcttttccaaggagggtaaaaaacttgttgttgcaaggcaagctccgtaaggcttataacatcacatttaaaagcgtgtcagcctcccttttttgttatttaaacaaaatgaaaatcaaaagcttattcatctgttttgcttttccgttggtgtaaagccaacaccctgtcttaaaagcataaattccctccccccttttgcctcttttatcggtgctgcaattaatgggaaatggaaagcctcttaaaaaagtaaaata

SEQ ID NO: 551732 - DNA, 491 bp, Homo sapiens
  misc_feature (18)..(18): n is a, c, g, or t
  misc_feature (29)..(29): n is a, c, g, or t
  misc_feature (45)..(45): n is a, c, g, or t
  misc_feature (54)..(54): n is a, c, g, or t
  misc_feature (56)..(56): n is a, c, g, or t
  misc_feature (63)..(63): n is a, c, g, or t
  misc_feature (67)..(67): n is a, c, g, or t
  misc_feature (78)..(78): n is a, c, g, or t
  misc_feature (82)..(82): n is a, c, g, or t
  misc_feature (91)..(91): n is a, c, g, or t
  misc_feature (93)..(93): n is a, c, g, or t
  misc_feature (480)..(480): n is a, c, g, or t
gcctttacattaattgtnacccggcaggnttttacacacattttngaattaagntncaatgantttnttaattaaccnccgntacagcccngnagcgcctccaccccagagacccggaccaagttcacacaggacaatctgtgccacgcccagcgcgagcgcctggactcggccaacctgtgggtgcttgtggactgcatccttcgcgacacctccaagctggtgagtgaggtggaggagctgtacaagtccatcacagtgccgcgggagaagcttctacaagcagagcagtccctgtgcaacctcgaggacatccacatgagcctggagaaggacgtcaccgccatgaccaacagtctattcatcgaccgccagaagtacatggcccatcgtacttgctaccccaccatcctgcagctggctggctaccagtgagcagcggcacggtgcttccccccaatcccccaaataaaccagggngttagctttca

SEQ ID NO: 551733 - DNA, 313 bp, Homo sapiens
cgctacgctcgcacagattttttacctgagtaggcctagaaataaacatgctagcttttataccagtatctaacctaagaaaataaaccctcgtaccacagaagctgccatacaagtatatcctcacgcaagcgaccgcatccataatccttctatgtaattcaagactctcctagatatatttaaccacatctccaattaatcctgattcatttctaggcctctaccaactgcccacctataaaatgtatcttccatgtttaatttagaattctgtatatacagttcagcttgtattaaaaactaagaattt

SEQ ID NO: 551734 - DNA, 155 bp, Homo sapiens
tcagctcgtactggctgctgcttgcgttcgccgttgaccgccagccagattctgccttccttgtagtggcctggtctgggccaccggattgatctgggccgatcggcgccgcgtggtcgaagctcttgccgatctcccacggcttcttctggtcg

SEQ ID NO: 551735 - DNA, 481 bp, Homo sapiens
tatctcactagtcaataactggctcactatgtatcatgtatacgaatggcaaattattataaaactttatacaacctagccacttggagctcagacaccattttgatgttctaaaaacttactgagatacacctgttcatttatagaatagatatccttagtaaagaaaaacatcagtgtagccaagcttacgagtctgaggctgacagtgcaaactacacttgccttattttctaagccataaaaggtataacaattctctgattcacaggcaaagaacacccaaagtagttcataatatttattcggaaaatacctgggacatactttacataacgagggctcggaacctgtgtgaccaatttgccatttcacaaactcccgatttaccttgtactgacagcagtgattcaggttgtcacgattgctttaccgtggatcaaaattctgcttagatagtccttatctagaacccggaaat

SEQ ID NO: 551736 - DNA, 373 bp, Homo sapiens
gctgtgaacctgtgcgggcctgctaactggccttccacggttggcactgctgttgcaggtccaacgttatcatattaagtcaagctgtcagctttttcacttgttacaaggtcggcgataacagacttccgtgggagtttagatattttcccgtgttgtagatcttctcagggtttaataaaactggttaaaaattgagtctttccctgaagtaagtgctctttccagatgaaaactactcttttggttttgtttgaaagtaagaaagggaggggtaactttgctcttttaataattatgttcagcctatgatgaagtatttgattattagacagcaatgtcactaataagttttaagttgtccggggttgtt

SEQ ID NO: 551737 - DNA, 203 bp, Homo sapiens
gactgctgtcgctaggggagagctgttatgggccacagtgtgacaggagagctggtgagagcgaggtactgtggggaaggatagcgacagcaggaaggtctctctcaccttccccccagaggtaggtcatgagacactcatgtgagatctgtcctttctgtacccagagggaaagaacatccttatctctgaagacacaggga

SEQ ID NO: 551738 - DNA, 112 bp, Homo sapiens
gttgcgcagaacacaggttcgtgaaactaccctaaagcaaatggaaggaagactcatatcacattgtcgtcattggacacgtggattcgggtagctcccccactactggcca

SEQ ID NO: 551739 - DNA, 186 bp, Homo sapiens
  misc_feature (164)..(164): n is a, c, g, or t
aactgccatgaagtaacctgaaggaggcgctgactggagggattgattacaggatcggaacactccacactcgccattctctgcatataccggttagcgaggcgagcctggcgctcttcttcgcgctgagctaaagctacacacaatgctttgcgaccacaatncacccttcatttcgtaactgct

SEQ ID NO: 551740 - DNA, 407 bp, Homo sapiens
gtcaagggtgtgtgtggccacaggagtggctctgcgaatgtatggctgaatgtacgacagacctccactactcactgacgcggcagtactcgggttgatcgcaagcatgcgctggaacgttgactgaaactatcctaacgctgctgggaacatgaatcgccttgacgtgctcctgggatccgctgatgcagatgtctctagctgccgtgcgctgcacttagtacacctagactcgacatagaccagtctgatgacacgcgtgagcatctgcatgatgctagctatgctgctcctgacactctctggcacagatagctcgagtgtatcctgttcttggtgctcaatgatacttgcagtgatgagactgccacctatgctgtccctgagcttgatgtgacttatgttcg

SEQ ID NO: 551741 - DNA, 112 bp, Homo sapiens
gaccctagtatcccaacacaaataactaatgaaagacgttgtctccatctctgtcaatgaggaaaggcaaagtgattctttgattccaattcgaaatggtgttgggcgataa

SEQ ID NO: 551742 - DNA, 201 bp, Homo sapiens
  misc_feature (165)..(165): n is a, c, g, or t
gcgtaatttttttttaaagggaaagaatgggtatattaataatgtcggtttttctaaataaccggtggacaagggaagccccacggatttactccctctcttccccactccctgtgaggctgggctgaggcacggatcccgggtgccacatgagcaagtctccanaatcagacagcgtgcctacagccccttgggatgtgt

SEQ ID NO: 551743 - DNA, 469 bp, Homo sapiens
tgcgagatgacactccatgctgacacataccttgaggaaacgacgggctctgtagagagcgacgtgaagtcctgcaagtgggcagctgtgtgagtggcagccaggcaggctgagctggccagggggacttgtcactctcgttccgaaagtacatctccactgagcaattcccagaatcttcctggtacagtgcaaatatgtggcaggaggcagatcatggggcttgtatcaccattgtagacatccagtgccattatgcagggcaaccagggtcagtgtcagtgctgcagagtaacaccagcagcttggggaagctgggaggtggtcgacacgagggtcaggttcttccttatctagagccagaaggactcccccctgaagccgggccttctccgcctgctggtcagattccgaagaggaagctggaagctgaagtcctttagccggatgagacgctgcatggtattgg

SEQ ID NO: 551744 - DNA, 153 bp, Homo sapiens
attattgcaaaatcatgtggttagacgagctgacctctagatcccttctgtgatcctttaggggaactgaaaccgtttaggaataataaggccacatacccactgctgtaaagtgtgttacgaaccaccttgagcgagagcttgctcctagag

SEQ ID NO: 551745 - DNA, 369 bp, Homo sapiens
  misc_feature (62)..(62): n is a, c, g, or t
gcttgactatggcaatttaaacagtggcaacacgaggaggggtggagaaagggagaacgggnggaggacaggtgtgaacaaagagaattgggactatcgagtataaggttgtcgagcaccaggatcgagggtcgtgaagtgcaataaaagtggcaccatagtcaataagtgaccggggcgggggataaatccaaagtgacgggatacagtaagtcaacgagggaaataagatcggcagcaagtggaggccggacagtgcagaataggcggacggaaacggttgcggcgggcaaaggtgggtgagtaatagtcgtgacccacggtaacatgccgcattgtgggacagaaagacgagtggggacatggggc

SEQ ID NO: 551746 - DNA, 401 bp, Homo sapiens
tctgtcctactaaaaaaaacgaaacaaatctgaaactgccttttcaaagaggccagtgaacttgtctatcctccacattcatgtgtttagcgtttaccgttttcaccatgttcatctacacagccaggcgacagaattcccgttgcttaaactatgattccagagaaccaaagccagtgatgtgaaatggggcttcttttttcttttaaaaattctgctttgttttttttcctccccttcccttcccactagctttccaagtgaaaacctgcattttatttgtccctcatttttagttgaaagtgtgaaaggctgcaatggggacgcctggaaatgaggaataattcagtcttgctttttgtgacaaaaaagcttttaaataacctttttttataaagaga

SEQ ID NO: 551747 - DNA, 111 bp, Homo sapiens
atgtgcagtgcatagtgctacctcttctcagtctgaggcccctacttccctaggagctccccccctcctcagaccctccccacatctgaaactgcctcctgagtagctggg

SEQ ID NO: 551748 - DNA, 194 bp, Homo sapiens
  misc_feature (15)..(15): n is a, c, g, or t
  misc_feature (38)..(38): n is a, c, g, or t
  misc_feature (41)..(41): n is a, c, g, or t
  misc_feature (46)..(46): n is a, c, g, or t
  misc_feature (65)..(65): n is a, c, g, or t
  misc_feature (68)..(68): n is a, c, g, or t
  misc_feature (83)..(83): n is a, c, g, or t
  misc_feature (131)..(131): n is a, c, g, or t
  misc_feature (182)..(182): n is a, c, g, or t
gtagttgttggagangaagctctcgttcaggctgacgnagncgcgnttcagcggcggcacgaacntcngcaccttgaccgggnccttggtgctggccacgaactcgaccttggcgtcgatgttccacaggncgtcggtttcatcctcggtcaccgggaagccgaggaagaagatctgataanccgtgaccgcca

SEQ ID NO: 551749 - DNA, 755 bp, Homo sapiens
atcggccataaggccggggacagcggcagacaaccggaagttcagcacaaaccaaggcgggcgcaggcgcaagaggaaagccaaaaagcaccgagagacgaagaacgaaaagagacgagaacaccgacacaaagaagacgaggcaaagcagagagcgacagcaaccagagccacagagacagcgagaacaaacaagagaaggagccaaagagaacggaaaacaacagagaccacagaaaagacgaagaagacgagccaacccgagaacccacggacgggaagcaagaggacacacagacaacgcacgaacgaccgacggaacagaccacaggcccaacgaaccacggagacccgaacgaaaagaaagcgcaggacagcgcgcaagagcaacgaaagcgaccgaaaccgatgacagagagggcgaaaacaagacaagggggcacgaccacaaaggcaatctctgataacagccgacagcaccccaaagatcggacaggagcagcaagaacaagggagaaaaccgacacagaagggagactcaacaaggcacagaacgcagcagacggggaaagacaaaccaaaacgccacgaaaggacgaaagctggcaaatcaaaacgaaaaggagaccaaggaaaataaacaagggccaacacaaaaaggccaaccccggaaaaaaagccgaaaaaccccagaacaagcaagacgacaagcgatgcccacaggccacaagacgcaacaaggccagcggacgcct

SEQ ID NO: 551750 - DNA, 196 bp, Homo sapiens
tcatctggtggcgcatactcttttgatttcagttcacacaccagagcgggcgcaaggggcataggtcagctgggcggcggcagggagggtctgctctgacctgggtgctgatgggtccctccagctgccacacctgcaccaggcagtcccgagtggtcacaggctagcccagcacactgtcattgaaggccaggca

SEQ ID NO: 551751 - DNA, 251 bp, Homo sapiens
tggagagctacatcgagcggctgctggtgcggatcatggagaacctcacccaagctgctgcagatcccgccgggaccccccaattgtagtcttactcagcctaacaccaggagggtgggcatggacctatggtgactgcccctcgctcctgctgaactctctcatgcctgcagtggggcatcgtagtgtctttggcctggtcactcctggctcctctcccatccatgcctcagcgtgggggctgctgcaag

SEQ ID NO: 551752 - DNA, 119 bp, Homo sapiens
tgcggtgtgcgcgagtgcgcctggtgtccctcaaggaggcggagttctacgacaagcagctcaaagtgctcctgagctggagccaccttcctcgtcacgtttggaaactcagagaaacc

SEQ ID NO: 551753 - DNA, 390 bp, Homo sapiens
gctcggcagaactggacggccgagacaaaaaccatctgggcctcaaagcgagaaatatgtactatcggtcccctgaccaacaatcataaatcctttacccacccctcatctcacaacatgaaacattcttcctctgaacatttctcttttgtttatacaaagtcataagttaaagggtcagtatctttatatattaagtgtacagcatgtagtcacacttgcttctaaaaaccaaacaaaaaattccacatctgcagaacaaaaccaatatctctttagaattccacaagtgaaactatgcagcatacagccacatctgctttggatccttcataacttatcacaatctttagtaatttaattcaattagagatttccctttaaaatagg

SEQ ID NO: 551754 - DNA, 591 bp, Homo sapiens
cagttacggcctggatgccagtcgccagcccagctgttcccctcgggaacatgagtgtggtggtggcgcagcagactgcgatcaattctgcatggtcacagtagagatcccctgcaacatctgcttgtccttgggtcacccatgcattccatagccatgtgcttgtcccatgtgctcccactggttcccagggtgccagtgctggtgagcccacagccaccccactatgcctgcaggcctgccctacccaccttcagtgcatgcctattgggactgcatgtgggccccaatcttgtccctctggtccgcctgttgttggccaagagttgggagtcctgtctgtccccaacaactccgttgctcgctcagcaccactatatgggcagcgactgtcttgggggcctcaacacacgcacgtggagcggcgttgcaaagccacggggcagagcgggcccaaccttagaaccccagcatgccccctctgggaagcaccccagacctacttgtgtgctgaatggtagccttcctccttcccctcatgccttgcaaagggtccccgatttgcccatccgacaaatgacaaccttctag

SEQ ID NO: 551755 - DNA, 155 bp, Homo sapiens
caaggcgccgcggggccaccagcacatgcctgggctgacctaggtccaccctgtggccgagaaaggggcgtcgcccagcccttccaccccattggcagctcccctcacttaatttattaagaaaaacttttttttttttctgtagcaaatatgag

SEQ ID NO: 551756 - DNA, 921 bp, Homo sapiens
acttgggaggctaggtgggaggactgcttgaacccaggaggcggaggctgcagtgagccaagattgcgccactacactccagcctaggcgacagagcaggactcccatctcgaaaataaggtatttactttcgtaaattatttgcaatattagaatatctgtcagcctacagtatttctctgctgttattctgaccttaacacattgaaagagttcttaattttgcttcgccatcccttacgcatacttaaactctttcgtctactctcgccaaacttcccatttactctttacacagatcaacttctcattcctcaacagaacctaaccaagacaagaaaatttgcccttggttattccccactttcctatattagcttggctggccaaaccctttatgcccattattctcatcaagctcattcctcacgggggtttctcctgacgccccatcctattccagtggccctctacttgacctttcctgcgcccggtctcatgctcctcttcactacgcttacatttcccctttcaaccacccttcccccctctccttcccttggtgctgtcctgcgttactccttactacgccaacaagcctaacagattcatgtcaacctactcttaagccgcagtcgaggagagcttgcccccatttcccctcttatcacctcaatattcccaccccctgttcttccctaccaaacacccccggggccgccacatccaatggccctacacggcgcgtacgcgggacccggacacatcgaaccccccctacaacgccccccaccctagggacctacacgcccccgcctgaggaatatataacccccccccccctacaccgaccccacacccacacaccgccccaccgacacccacccccaacccccacccccgcccgctaccatcacaccc

SEQ ID NO: 551757 - DNA, 767 bp, Homo sapiens
ctgacagcttgaggatggccggagccgagggcgccgctgggcggcatggtcggagctggagcccgtggtatcgttggtctgagcgtccttgcatggaggacgacggacgctggagacatgagtgcgtgcgctgtcctgggcggcagcgcacctccgagaagtgctcctactctcagggcctcagtagagagagacaagcactagtatgcctgtagtacctggcaccccagtagggagaagaaccgagcagggaattctgtgttagcttggcagttatgaatgtcatggaagtcacaaactatttgagctatacacaaaaagaaatttgcgttgtgattgtggaaacagcaatgtctagacacacattctggaatgcaagagttacgtgtccgtgacaaagcaagaggtacacattctggcaatacagtacaatgacaacttttcggattgtactgcatttgcaagagaccttatcctgatcctgaagacgagattccagatgagatgatccagatgcgtagtctgtgaagactggttccatggaaggcatcttggtgccattccccctgagagtggggatttcaggagatggtatgccaggcctgcatgaaacgtagtcttctttgtgggcttatgctgcacaatgggcagtaaccaaaatatccactgaggatgatggattggtgcggaacattgatggcaataggtgatcaggcacgtgatccaaacgtgcaccaatgcgacgagcatcaacgatagtaccctca

SEQ ID NO: 551758 - DNA, 152 bp, Homo sapiens
acagcatataaaatacaaaatagcgggcatgtggtacttcctgtacccctgctactcaggagctaaggtacagagtcacttgaaccaggaggacgagactgcagtgagatcgcaccactgcactccagcctgggcaacagcaaaactgtctc

SEQ ID NO: 551759 - DNA, 215 bp, Homo sapiens
gtcatgctataatccagcaccttgggaagccgagcaggaagatcgcttgagcccaggagtcagagatgagcctgtgacaacatatgtgagagctcagtctcttacaatatttaaaaaaattagctgagcatacaactgtgtgtctcagctacacgggaggccgaggtgggaggactgtttgagcccgagtggtcgagccgcagatcgccccttag

SEQ ID NO: 551760 - DNA, 1747 bp, Homo sapiens
  misc_feature (1694)..(1694): n is a, c, g, or t
tgaaaaaaccacactcgtggtggtaaaaaaaaaagggaatgaggttgggggaacagggtgggggggggcgcgaaaaaacacacccacaccccttgaagtggggagggagggggggaaaggaaagcgtgcactttgcgaaaccctcctgtgccccggacgcaacactctcttggaagacaacagagctcgtgttgagtgacatctctctctcacactacaccgctgtgggccgagagaacaagagtaggagagagaggtttacacagaggacagacgcccacacaattctccacacctccccgagccaacgagggatatataaacaataacacaccccgagacaaactttctcttgtggcggcgcggcgcacccaccatatactctctctccacaaataaaacaccctcccttaacagagagaagggtacacaacatctctaggagcaaaggaacatctagagggcagaacaccactaacaacctcctcctctctgagggggggacagtggcacgaaaacaacaatacgacaaaatctctacaattcaatataggcgagtcacgaccaacgcggcgctctcagtaggcgcgaaccaaaaaatagacggacgcatgaatcatcatcagagaggagatctacgtacagcacactggtacgatgaaggagcgcaccaccaaactaaagaacaccctttctggaaccactgcaagaacatcatatctatggcaacaacaaagaaccacgccacaaccactacattgtgtgatattaccaggcgcagagggtcctccgcaccacagaagagagaaccaccactctgtaatgagaaccacctcacgctgcagtgagcggacgcgacccacaccagtgtgatgtgaagagagccatagaaacaggaaactcaactacacgaggagagcagagaaggaaagacgcgtacgagacatcaaaacagtacgaaacgatgcactctttaaaacacgcatgaatgagacatatggaagagcgggaggagaaatatacatacacgccacgagtatacgaccacaagcaaaggtaccagatacacacacatcagttgccgcacgacgcaacacaaatccattggtgggcgtggcacgcaccactaccacacaccagacgtatgatctacgagttcgtcgttcaacaaccacgatatcacagcaagaacgcaacgactgccatcatcacaactgcagagactaatcaaatccagcaagcatgtagagaaagtgagattgtagcttgatcacacagcaccgagtctgtcatgcacaacacagagaggatatgtaaatcgcaaccgaccgataactgagagtggagaagcacaatcacctacgtcaagcacagccctccgtaacgggggcgagacaaaaatccaaccaaccacgctgtctgagtgtttacaacaacaaccgtacaaagatgtagttgtggagggacaccacccaagacggccacgccgacaaaccgctcgatgatagtatagtaaatgaaagacaccacacacaggcgacgcgcaacgcaccacacactcactgcgacgtacgagcacggagatgagcgaatagcactatacccagacaacatgtgccaacactagtagtagcaaacgccacacacacgtacctgatgacgctagtgtcgtggaacgcgcacagatacggtgntaggcacgtacacaacagacatagacctagactgccacacatacgtgagttgt

SEQ ID NO: 551761 - DNA, 486 bp, Homo sapiens
  misc_feature (204)..(204): n is a, c, g, or t
  misc_feature (242)..(242): n is a, c, g, or t
ttttcccattccagcctcgcccctccccccatttagaaggggtgtggcccccaacaggtttctccccgtttattcccctagaagtcccattcctaaacacatccgtatttttcgcatcaggggtatcattcccctgggctccccattgtttaatagaaaccccccgaacccaaataattcaagcccggctttttccaattttanggggttttttttttcccctcctacaaccctcagagganttggagtctcccttccccatttccgggggcatttaggggtcaactttttttgtacccccaggtttccccggacttcaggtcattatggggtcaactttcccccaaatttggttttttcccccaaataatttttccttttacatcccaacatccttttggccttgaaccccccccctgaaacgggccttttgtaaatggggtttgactttttttgtatgtcccccttttttgatgggggttttta

SEQ ID NO: 551762 - DNA, 146 bp, Homo sapiens
caagagactctggtaccactgctggctcatgagggaggattattccttatacctaaagtctccagtctggggcaggcgggagtgggccctggtcaatgtttcctgatggggaggatggcaaaacaagcctccccaccagaaaaaaa

SEQ ID NO: 551763 - DNA, 299 bp, Homo sapiens
agactgtactagtcatggctgtaggaacaggctgcacagaggaggtgagtggcggtgaccggtgaagctgtcagtgttatagccactcgctattgcttgattaccgctgaacttctcatgtccgatcagcagagacattagatcctcacagaagcatgaaccctattgtgaactgcgtgtgcaagggatctagattgtacgctcgtcatgagaatctaatgcctgattatctgtcactgtctcccatcacccctagatgggaccatctagttgaaggaaaacaagctcagggctcccgg

SEQ ID NO: 551764 - DNA, 577 bp, Homo sapiens
gtgaatcggaaataagggtcaatgtgaaagcggggcgtggtgaacccattgtgtgggaaatatgaaagggagacagattgtgcatatatgttagtcctgcaagtagtgcttgatatgtatcgaagacgtggttctagctacagagtcgcacagtagcttatatggtgggtatgaaaggccatcagacttgtataagtagcatcacacaattagtggagtatagtgttagtcttcagacagcattactatcgactgtaagtgcgatcgtagtgtgagaatgctaggccacggtagtaatgaggatgtagcccagtggctgataatgagaatgtagggcgcgttgaagatacagattgtcttcattaaaactaggtatctttgtagtagagaagtgtcagcttgttagacaactgccaaataggaatagccaatggaaaggctaggatatgtgtctggtcaatgggatgaggatgagagttaggcggatcattacataggggcgaggattgtatagtactgcgaaatggcgtatcctcccacccgtcagtctaagacatggtctgtacatacatctaag

SEQ ID NO: 551765 - DNA, 858 bp, Homo sapiens
  misc_feature (292)..(292): n is a, c, g, or t
ccggggtcccgtgttctcgtgtttctttgcggaaggaagcccccgtggagactgccggagacccggggttctctagaggatgtacaactgatgagggagaaagggagtggacatgggaaaggggggacagtattggaccccaagtgaactgtaacttccttggcaaagacgcgcgagggccgagtgccgacagtgggacagagacgtgcaagatacctgagcctaagaagtgagagacaagagccccttccagactggacgcaccacttacttgactgattgacgcatctcntgacctgatactagctgagccagcctgataatggagggacgaggggacaggggatgacaccggggttgagtgcaacctcgggaacatcaggatcctcaggggatactgcctaccaagtagcgggtatcgtaaaggcatgtacccataacataagcggaatgtaaggccagaaagtcgagtcggaagaatgcgaactgagtgaagatggtgccgctgatgatgtaactgaaaaagtcagtagtgcagcctagaggcagaacgccaggagaagcgtattctggaagagacttgcaatctagaggaaagttacaaggaaggatcatattgtagaattggaggggagagttcgtaaaattgaaggggtgactaggtgaggggccagagggaagtctgctgtgcttctctatgtaggatgtcagccctgccctgcaacgttctctttttaggccaactgtcattgttcactatgtcctgaccctgttagaatcatccccagccagacgcaatcatggaagttgcctgattgtcaactggttaagaaacttaacgcccctgaggggctatag

SEQ ID NO: 551766 - DNA, 408 bp, Homo sapiens
  misc_feature (57)..(57): n is a, c, g, or t
cctcctgaaagaccccgtcgggcttctgcttctccagtctcagccatttacacagcnccgcagaggccttggaagtcatatgcctatgaggttccagccagagagaagcccttgaccacgtagccggtcagccaggttctgggtgcccgtttcacaaagcccgcaaagccagatctgggttgtctagaggccagctgctgggtgtaccccttctttatgagctccaagcgccccctgccgcttctctagcccgaccttctccctgtgctccgtttcatccaggtaatgcacagcaatgcccgtgggcgtcatgccgtctcatgttctgttccccacagcccgagggggtcactatgaggtgcctcagccgttgcgcgtccacggcatcctgtgtcatctggccctctg

SEQ ID NO: 551767 - DNA, 486 bp, Homo sapiens
tgagacagagtcttgggagtgcagtggcacaatctcggctcactgcaacctccacttcccaggctcaagcaattctcctgcctcagcctcctgagtagcgccaccatgcccggctaatttttgtatttttagtagagacagggtttcaccatgttggccaggctggtctccaactcctgatctcaggtacccaaagtgctgggattacaggcgtgagctaccgtgcccagctagtttggtattttattaaacaaatgatatgtcctctactttttgcctctatgttcatatagcctaatgtcatcaagggtcatctatgttgagacaatgtgccaagtattcttcccttataaggctgactaatattctactgggtatatcccgggcgttgttgcccctgggcttgcttcttctttagattcagtaaataatgtggaaaaaacatagtgaacaattttgcttccaaccctgttgtaatggtgttgg

SEQ ID NO: 551768 - DNA, 382 bp, Homo sapiens
  misc_feature (24)..(24): n is a, c, g, or t
ttaattttttcctctctctaaggnggtatgcataggatgaaataaaaatccgatgatctcatagaaaattaatttcacaggtttccaatccactattaaaaatgtatccagatcctacatttatttactttctaaatatataggtatttaacccgtgctttacagaataacaaagatataaatggagacacatgtaaaatttaaaaatagaggtgctgatttttcttcttgttagtgtgtgtataatatttaatcacagaaaaaatgcttatatgataaatggcttgcttttggtttgtgtcatttcttggcatattttgactgggggatgttcgtgggggcaaattgacctgaaataaaatcactacattttgtttgcttt

SEQ ID NO: 551769 - DNA, 654 bp, Homo sapiens
gaacccgggagctggcgccatggtgctgttgcacgtgctgtttgatcacgcggtctgctaggcgctgctggcgctgaaggaagtggaggagatcagtctgctgcagtcgcaggtggaggagtccgtgctcaacctggggcaaattccacagcatcgtacgtctggtggcctttggtcacctttgcaactcatcccgaggttgctcgttggaaatatgccaactgccagtgttctgaaggggttgttcatgaggatctaccgcctgctcttggagatccaactgccgtccaagagagagaagaagagtactcttggaaatcggggatcccaagattggtgccgcaatacatcggacggagttcagggtacaactgccagacctggacggcagtcatagcctgagatcctggcgaggaagttcgtctgcgacttccacgaatctggttgaagggtctgaccgatctgtcagcgttgtaaaagcacagtctgggggctggggtacacaagctagttacccgttgtccattgagttaagttctaactgtgaacgcgggttggacatatagtgatcagtccacgtccgattagtcgctccttggacgcacgctggagtaacggacagtcgaactaccgttcatctgatgcgtgtcaggg

SEQ ID NO: 551770 - DNA, 507 bp, Homo sapiens
tccggagggggtcctagtcgctcctccttcccagggaccagcaccttcaagcgctccaggataaggagggcaagagggggacctgccaccagggagctaactggctctgggggacccaggtgggacttagcagagaatattgcaagtacttgggttgatctcttaaaaggcatgggacctcctccctcattcatcttgcaagcaagtgccatttcttgagaagtcatgtagaactcggtttggtagacttggacatctctctggcttctgaagagcctgaagctggcctggaccattcctgtccctttgttaccatactgtctctggagtgatggtgtccttccctgccccaccacgcatgctcagtgccttttggtttcaccttctctcgactggaccctttacctccccgacgtcaatttcactccctcttgggatttattaaatttgccctgacattttattttgggggggtctgaatattaaaggcctctcattcttgggaaa

SEQ ID NO: 551771 - DNA, 242 bp, Homo sapiens
  misc_feature (7)..(7): n is a, c, g, or t
  misc_feature (208)..(208): n is a, c, g, or t
tcggcanaggttaacaaatactttggacacagccagcccaagaaaaaaggagaaaaatctttcctccacataaatcatctattcaacattaaactcagcactgaaataaaagctctgtttgcctagctccccaaacctcttcagatagaacgtcttaaagtggagaacacctctttcaaccagtggctttgacggagcattaaaaaancctttgaactgtaacattttctgcttttctaaaa

SEQ ID NO: 551772 - DNA, 416 bp, Homo sapiens
aaaaggggggaaaaaaaaaaaaaaattttttaaaaattttttttttaaaaaaaaggttttttaaaaaaaaaaaaaaaaaaatggttttttttctcccggaaaaaaaaaaattttttttttcctcttttttggggggggggtcaaccctccctcccttttttgggaaaaaataaaaagggcccccccctttaaaaaaagggggggtccccccctgtggcccccacccggagaaaaaaaaaaaaaatatgataaaaaattcccgggggctttaaaaatttggcgcccccccgggaggacccccccacaaaagagagttgagaaacttcccctgctctggaggcgcccccccctcaaaatattttaaggcgcccccccccttttcttaaaaaaattcccccccaaagttttttaaaaaa

SEQ ID NO: 551773 - DNA, 198 bp, Homo sapiens
aatatggcacactagctgttaggacttcaaccccctcgagtggggagggagcgctgagacacagcagaggcagagagcccaccctaacaggggattccaggagaactggcagcagaccaatcctctacctccacctgtcatcagaaccatggggaagcaagccaggaaagagggacgtggcgaggttctggtgccgat

SEQ ID NO: 551774 - DNA, 84 bp, Homo sapiens
ggtcccctttcagcaataaaagcttccccttgatatccatccctttgtagtttgaacaaatatatttatatgatatgtaaaaaa

SEQ ID NO: 551775 - DNA, 281 bp, Homo sapiens
actggtccacccatggtgtccagcctagctccgctacgagtgtgagggccagtgcaaccgcctagccctcatctggccctgcacgtgaattcctccccactgcattcattccacgaggcatttatttgatgcatctacgtgtgtgccatgatgcaagagcagacagtgggatacactgggcaaggagcattccagggctgagggaacagccagtgcaaacgttgggagatgcgggtccagtgaagaaggagcagaggagaccaggagttgaggcgactgcg

SEQ ID NO: 551776 - DNA, 880 bp, Homo sapiens
ggtgttcactaaaaaaaaccgtttgtttctttagtgggtcttcaccctccttataagaagtgtgtgggtctcaggcaaaaattaacttcgtggtgcaatgttattaatctttgtttaccgttaagtccagcgtgtggggacacccagtggagttctccttgctacgccaccaaacaaaagagaagggtgatgcatccagagctggttcatctacgtcactgccaaaaagacaagtgtccccgcacgttccattgtgaacttcaggatgtttcacacatcttgttgagtgccttcaccctctgtgtgagaagtaagccttagcgcccccaccttatgcataagaacgttctgtgtaaagacattgtcaccggaggggtcgtacctaaagcttattccgccccgtggtcctataccgtccgggtctgtacaagattggagagagactttcgatggtgttcacacccaagacaatgagaggggtttgcacgctaatattacccccacgtggacgactccacgttatgtcctctaagaaacacaccgttttgttcaaggaatgacgtgttactccccgtctgcgagggacatatgagtagccacgcgcatgacacgctctctccaactagattcctttcatctagtcacacactgaaggagtactggagggtcaccccccacacgcctgtttgagtaaagtccacgttgtgtcattatgttgttatcttcttcacaagaggggagcaccccatgggtagttttattcatgatctattcgctgtatttcattaggtaagacagtaatccactctttgattgtttatcaggtgagagccattgttgttctagtgaccacgcctcacaacggccccaacaatagaaa

SEQ ID NO: 551777 - DNA, 771 bp, Homo sapiens
  misc_feature (446)..(446): n is a, c, g, or t
  misc_feature (515)..(515): n is a, c, g, or t
  misc_feature (759)..(759): n is a, c, g, or t
tcgccggaatctcgcatcattaattggtttcattattctgcctagtaagctcctctacttttagtattagcatctctgcacactcattacttttctccaagttcttcattgagcccttggattttctgtaaatggaaagttatgtctaaaagcacagttagattcaggttgaaattttggcaagactaatagttgatactttatacttcttattcacggcattaggaggtgcataatgtctggtgatcctgcttttagtgatgctaggatgactagccatgtgcatgattgtattttcctcatggtttagctctatttatgatgattgccctgaatcacttatttcattaagagttgcaaatggccatttttctgattcttttattccttctaaatttagtgcctggaattacagtgtaatgaaggtctcatcactcggatggttnggttaccaaaaatgcaatttagtattttagcaaaaatacagtgggaaggataggacatatctgattgtngattttttttttttggagacagagtctgggcttggtaacccaggctgggagtggggggggcatgatctgggctcatggcagcctcggtcttcggggttcaaatgattctcctgcgtcagcctcccgagtagctgggattacagacacacgccaacacacgggctaattttggtatcctcagtagagacggggtctcaccatgttggccaggctggttccgaactcctgacctcaaatgatctgnttgcctcgggct

SEQ ID NO: 551778 - DNA, 311 bp, Homo sapiens
acatcactagcggaggaaatcatcacattgtattgtccctacatcgctatcagaactaaacgccatcaatctcaatctacgtccgtggactatcaagcacagagctataatcatgcgtacctgtgactgtgcgaccaacagacgtcacagatacttacatatcacattacagttgctgcaggttgctctaaatatcttctatgctcatcacaacttcaaaaccatggttgtcattaggcccaatgctagatcttatttaatacattgaatcacgcagcacatttaccacaatttttaaagtattttgctat

SEQ ID NO: 551779 - DNA, 166 bp, Homo sapiens
tggtccacatacatacccagtcttacaaaggagctgctgtgtcatatgaaacatgcatattatgagaaaaatagtatttcgtgtgctgtctgcttgagtatcgatctggagatgcaagttaaccgaaggtgctctgccaatccatcagcgtgagaaaaaaaaacca

SEQ ID NO: 551780 - DNA, 149 bp, Homo sapiens
  misc_feature (140)..(140): n is a, c, g, or t
actctagaggagcgagctgatacacccaaatctttatttaaaagccgaaatatcagccttctctctctctttggctatttgaaaggtagtcttcaattgggcaggcaactggtttctctctccaaatagtaacaggtggngtggtatag

SEQ ID NO: 551781 - DNA, 274 bp, Homo sapiens
atcagcgcaacagctcgtagactagggcgcggccccgagtgataccaaccaagcagcagtgattggagggagtactgactattgagacagcatctttggggtgcccaagggccacggcaggcttaccaacagctgctgaatgttgtcctcgggtgacatcggaaatcatggtgctcctccgagcctggagcacgggcagggcagcccgagtggccccaccagcaacactcacgatgcactgggtgggaggggaagagagaaggtccctaaccgc

SEQ ID NO: 551782 - DNA, 300 bp, Homo sapiens
  misc_feature (30)..(30): n is a, c, g, or t
  misc_feature (36)..(36): n is a, c, g, or t
  misc_feature (56)..(56): n is a, c, g, or t
  misc_feature (78)..(78): n is a, c, g, or t
  misc_feature (83)..(83): n is a, c, g, or t
  misc_feature (130)..(130): n is a, c, g, or t
  misc_feature (146)..(146): n is a, c, g, or t
  misc_feature (264)..(264): n is a, c, g, or t
  misc_feature (266)..(266): n is a, c, g, or t
aaggtggtgagaaaaattatgtttttattngctttntggtaatattatgtaggccntggatcaaggaattagcatttngtatnatggacatatttttattaagtgttatttgccaattatggaaatgtcnttggtttttccttagntcataggtaatagatgcagaaatatagtatttaaggaatccgcatccagcataagatggatttgcatccagaaaaacattacatatcagtttgaagcaccaagcatgtgtaatatggntntaaacaatataataaatgcataatgttaagcttt

SEQ ID NO: 551783 - DNA, 350 bp, Homo sapiens
  misc_feature (344)..(344): n is a, c, g, or t
cattcctattattttatggttattataagtgtaccaggactctaaaagaaacttgtttgtataatgctattctatccaaggtatgtagcccaggaaataaccaacttgatgcgtgttatgacccattttaagcctcccatgatcacagtttttaaaatacaattaaggactggtccttttctaggtgacacaagaaaggtaatagctagaacagaagaaagaggggtccccaaaaatgtaaccttaaaatttgacacttgtgccactattgatagtaagcagcatggatgaggatgtggttctctaaattggaaaaaaaagttacacagtaaaaaaaaataacnactaaa

SEQ ID NO: 551784 - DNA, 347 bp, Homo sapiens
  misc_feature (99)..(99): n is a, c, g, or t
  misc_feature (104)..(104): n is a, c, g, or t
gtgtctctgggcgacctagaggatcccaagctccaacaagacaaagtaagaggaaatattaagagacggctgagctcgcacacaatagaaaactctctnggcantataaataatctcagaaagaaggaaaatagaaggcaccagccaaagattactgggttggaaccaagggattggcaaagacaaaaaaggtgacggaggagaaagttgtaagggagaagggccacggaaaggagaagctttcatcctcgtccctccagatagacctttgccatccccagcaaccttctgcaatcactccaaggtttgccaagaagaaaatcttgggaggggaaaagaacgccaaa

SEQ ID NO: 551785 - DNA, 101 bp, Homo sapiens
acggagtgctgtgcttctgttcttctgattttcgacagcgacatcagaaccttccacagtcattttagtctacgtcctgaaatcgttcactcccagcccgg

SEQ ID NO: 551786 - DNA, 263 bp, Homo sapiens
  misc_feature (90)..(90): n is a, c, g, or t
ctagtacttctgagctctgtaatgtccgcggtcgagtacgcgtatcgatggcgcagttgaggtggcgcatatgatctaggctataaatantcggagtatacgtagctggtaatgttaacaacggtacctctagaactatagtagcatgcgcaaattaaagcgctgatatcgatcgcgcgcagatctgtcatgatgatcattgcaattggatccatatattagggcggggttataattacctcaggtcgaggtcccatggccat

SEQ ID NO: 551787 - DNA, 100 bp, Homo sapiens
acaaaatgtagggttataataatgttaacatggacatgtgttatttaattctgtattgtttcttatatttgtagtaaaatattgaacaattaaaaaaaaa

SEQ ID NO: 551788 - DNA, 267 bp, Homo sapiens
ccttgagcgatgaagctcagccacagcccattgagctgcccacttccaactcttccatcctattttaactcaaaccattccttagggcacagggagcagaaattcagctggttacataaagcaaataattcacaattgagaaaggagacacttcctagggcacactctgaattttgggggggggggagagaaggggggggggaatagttatccttacccactgaaaccaggttgctgaaattctccaacatcacttctttgtataaa

SEQ ID NO: 551789 - DNA, 109 bp, Homo sapiens
tgtcactcccggtagatagtagcagtgcgatatagcagtgcgataatagcagtgcgatatagcgagtgcgataatagcgagtgcgatgatagcgaggtgcggataatag

SEQ ID NO: 551790 - DNA, 443 bp, Homo sapiens
  misc_feature (69)..(69): n is a, c, g, or t
gttcaagatccctcctttaccatcatatcatggggccaccaatggttttgaacctaggagtaccccgantaggggggactatttttcaattcctacatacttcccccattattcttagaaccaggggacctgggactccttgaggttgacaatggagtagtattcccgattgaagcccccattggtataataattacatcccaagaggtttggcattcatgaggggtccccccattgggtttaaaaacagatgcaattccgggaggtttaaaccaaaccattttccccgttacacgaccgggggtatactagggtcaatgttttgaaatttgtggagcaaaccacagtttcaggcccttggtcctagaattaattcccctaaaaatttttgaaatggggccggtttttaccctatggccccccttttaccccttttagggcca

SEQ ID NO: 551791 - DNA, 241 bp, Homo sapiens
atggcagataatgcattgattttattttaatggcatgatctatgtcatcaccgtaggccattatgtacagacaacgtggggaggttcatttcttggtctcttcctccttggataaggtcttgatgatcaacactccttcttggcctggaggcgctcttcacggcgcttgcgtgcttccttggtcttagacctgcgggcctcagcctggtcagccaggagcttcttgcgggccttatctgcg

SEQ ID NO: 551792 - DNA, 883 bp, Homo sapiens
ggccatcttctgttttgtgtgtgcggagaagttgtaggtttatgatggattagtgtgttaaaacacgtcctccaggggtaagggcggtaaggactctaacgcttttcccacatatgtgttgatacaccatagtggggttaacatggaattattggccgccgtattcctggtgtctctgaattcaccagcttcagatagaggtttaagttagacattgcaggtggaaaaaagctatctctgttggttccacacccaaatcaggagctggagactaattctattggctcttagtcactggaactgattaattctgactttctgtcactaagcacttggtatttgccatctccattctgagcacccaacggttaacacgaatgtcccctagaactctgctgtgtgtcacccctaaacccgtctaaatcttcccgaccaaagccaatggcatttatggatttaagtcattagattttccactgaccttaagtaatccctcttgagttgattatatcatccagtatttgatatcttaaataggaggtaggatcttctgtgttaagactcttatttgtaccctataattaaagtaaaatgtttttctatgagtatccccttgttttcccttcttaaagtgttactccaaaccatcttgttataatgaaatctatcttgggaaattagaaagacaacaatggccaggtatttactgttctgtttgccatcatttagactcacacttaagtattttgtagttttacattcctttttaaccccttcagtgggagcaatgtcacgcttttctccccagttgtatgttaagtctattctaatatgtactcaccatccagttataaacatgtaataaacctggaaattaagttta

SEQ ID NO: 551793 - DNA, 772 bp, Homo sapiens
  misc_feature (50)..(50): n is a, c, g, or t
  misc_feature (145)..(145): n is a, c, g, or t
  misc_feature (451)..(451): n is a, c, g, or t
  misc_feature (459)..(459): n is a, c, g, or t
  misc_feature (478)..(478): n is a, c, g, or t
  misc_feature (588)..(588): n is a, c, g, or t
  misc_feature (652)..(652): n is a, c, g, or t
  misc_feature (657)..(657): n is a, c, g, or t
  misc_feature (721)..(721): n is a, c, g, or t
  misc_feature (730)..(730): n is a, c, g, or t
  misc_feature (761)..(761): n is a, c, g, or t
  misc_feature (763)..(763): n is a, c, g, or t
ggaccactatctttaactaatggcgaggagggcccgttcgttttaaaatnagagtatcatccggtatgcgaacgttgctctcgaggcagttaacgcacccaactactgacttgattacccttcctgtaacttatataacttctgnacccagatccccttaccacatgtttttaaaatttttagcggtaggggggcgtcgagacccaacccctcattggtacgtagcaaattttttttttgttgcgccgttttgaccctaccggaactgctattaaataataggttgcaatgcataacgtgcctttttgcttcatccataaatagccgacttgcaggaatattgaatactgccccgtctctggaagaggtctaatacatagatgggcccttgccacaaagggcacacccctttccttagctggttttgttttttgagccatgttgggtaggngccctttnccccccaagcggaaatcgnggcccctgaacaaaaaatcagcttatgcccggatggatactccggagggcccggctcgattaagcaccgttaatccacggatcgtggttttgtatcaaaaattccctcanccaaatctttcgggaatagcgcaagagaaacattaaaccatttcaaataagggacgcccgcganaaggntcctttcaaataaaacccggaaattccggggggtctcctttgcgatagacggggttatactttngtaatcagnggagttcaactccttgtttcagccgcccccncnagtattttg

SEQ ID NO: 551794 - DNA, 309 bp, Homo sapiens
  misc_feature (91)..(91): n is a, c, g, or t
  misc_feature (116)..(116): n is a, c, g, or t
  misc_feature (157)..(157): n is a, c, g, or t
  misc_feature (184)..(184): n is a, c, g, or t
  misc_feature (195)..(197): n is a, c, g, or t
  misc_feature (201)..(201): n is a, c, g, or t
  misc_feature (206)..(206): n is a, c, g, or t
  misc_feature (229)..(229): n is a, c, g, or t
gagaaggcgatcccatcaaggagggctcgtcgtcggagaagattggggggctcgcgctgaggaaaaatcgtcgctcggtcggtaagctgcngcagcccttggcaattcgctttttntacgtaggtctctctcgcgcgcacattcgtgcttttccccnctcgccctccgtcgcacacgcacgtcnccagccacgtnnnctcncgagntcgcatcgctcagcgcgctctgntctcctcagcctcctcatctgggggagtggaatagtatcctccaggttttcaattaaagggataattttttcacgaccgg

SEQ ID NO: 551795 - DNA, 393 bp, Homo sapiens
ggtcgacgctgaggcacaagaatcccttgaacccagtgggtgaaggttgagaggttgcagtgagctgagatcacaccactgcactccagcctgggtgagagagtgagactctgtctcggcgggagggcagggaggcggggtggagactgaaatctaaaacacaaaactaaaaaaccctggtgacaaactaagcaatatcatcccgaacataggaataggcaaagatttcatgacaaaagacaccagaagcaaccacaacaaaagcaagaattgacaagtaggatctaattaaacttcagagcttatgcacagcaagagaaactatcaacatagtaaacagaaaattcaaagaatgggagaacatgtttgtaaactgtgcatctgacaaaggtc

SEQ ID NO: 551796 - DNA, 163 bp, Homo sapiens
  misc_feature (83)..(83): n is a, c, g, or t
tggtcgaggtttgggaaatggtcttggcctgctgcctcgtgaagagtatcaaaagtggtctacgaggtaatgtaggggtctgntctcctcagcctcctcatctgggggagtggaatagtatcctccaggttttcaattaaagggataattttttcacgaccgg

SEQ ID NO: 551797 - DNA, 1430 bp, Homo sapiens
  misc_feature (528)..(528): n is a, c, g, or t
  misc_feature (616)..(616): n is a, c, g, or t
ggttttggaggtcagctctccagtccattgtctcgtctattgctaatgtctgaacggtacactagcgtgtatcaatttaacgcgtctgcgtatgtctctgtctgtggtcgagtttatggtactgggtacatgggtcaggccgatgatatgtaatcatggatgcgcagctgcggcgtgctgatgagatgtattgcgcaaatgctgttgctagtaggttagaactaggtgcagggtgcgtgtgtaggcgagttggagaggcggattggacgttaggtggtagttccgcgtgagaactggtagtgaaggggaaggggggttcagaatgaagcatagaaggccatatgcatatggctgggaagatctgataggtcctctggaggtccttatactcatgcgtatgacgtatgatgcatgagagaccccttgagaaggaccccgaacgtagatcctgtgaggggtatggcgaagtatgactaatagagttccagcgtaatcccacctttgcgagaccgacaggtgtagctccgnagggttaaagatcacctaggatatgggcatgtaaattattacgagacgaactccctacgaaggagacatcttagaaagtgggcgaccnaagaactcttgacggacaaattattcccctagtggggaccctatggggcccctgacgacttcggttcttatggaacaagaactctagtacctactttagcgcacagtacattttgcaattggtcttgggattccccgccttgtggtcaccaagctttccaataggttattccgtaatgcaccaacgtatgccggttgtgtccccatgtggcctgtggtccacgctaaatgggtgcgcgcaagggattaggaaggaatttgggcaacatacttggcgcgcaattcctggccacatatgggttgtgggtaccgaagataatagagcacaagttggctaatacttatgggggcacgttgggaaaaacctaggcgaggggaggtgaaacgacaccaggtgaggtaatccctgcccgaaggaattctaacgggggaggtaacagcgcatagtaaaccggttttgcaataaacccccttgtgttaccacgttgaagagaggagacccaaaccggccaaattgcacgaaggaacagcggaacaaatatagggatgcccaaactgataatagaaagcgcttcaagaatgaggccctatgtgccgttccctgccagattccgtggagccagaatgtggcaagagggccagtgaaatggcccccttgtgggacaagttccacacaaacgagaagccagcggggccacatgtcaaaggggacagcgcgttatggacgggacagcggcgtgtaaggggctcaacaacaggatgtgatcccaacgaactggagtccattaggggggagagacacacgctgtaacgaa

SEQ ID NO: 551798 - DNA, 250 bp, Homo sapiens
  misc_feature (17)..(17): n is a, c, g, or t
  misc_feature (77)..(77): n is a, c, g, or t
  misc_feature (116)..(116): n is a, c, g, or t
  misc_feature (118)..(118): n is a, c, g, or t
  misc_feature (133)..(133): n is a, c, g, or t
  misc_feature (163)..(163): n is a, c, g, or t
  misc_feature (196)..(196): n is a, c, g, or t
tccgtgggtagggaganactgaactagataacgtgctcagttcaaatcagagactattttaatatggttataggcantataacgggcttcactcgtgtgctttcctatgccttagnangtctgcacaggtttnccagaggtctgctctacgacactgtaaaanggaaatagaaggatagatcagagctgtgaaaanctccacgttcttaacgtttgcccgccacacagacggtattcaccacagtacggg

SEQ ID NO: 551799 - DNA, 873 bp, Homo sapiens
ggcggagtatggcgtgcctgctgcaaactgtgcctctgtggcctgggggctgatgcagtccccgtggagtgcctgagtgcatctgttggaccgtgcgaggagaatgaaaaaaaatatcggccagaggagaggaactaacctgaacattcttcctccctaccttatagaggggagtggtcatctacactaaagcaaatgtgttatggctgctgtccgtgcgaagagaccacgcaaacaggctttgtgttccattatcacacggaagaaaattttccttgacccttctaggtgctttttatattcatctcaaaacacaaagattctgaactcaggacttggcaagtgtctctatgtctgtctccatagatgtggggtagtccttgcgtatccttttagcccagttacttttcccgtgatttcggaaactgtgggcatatcgaacgttcgtctaccaaagagttaacgctccgagtgatttgtggacatggaaaaaggcacacattatgcttagaagtgttacgtgccttctcaaagttcaacgcacagagggagactcactaagtgattccagattatccgtgctagacatactccagtgaagaacagcacgcacagctcactatggtgtctctattggctgtcatgcttcaatttataaaacgaccatcatctttgcaaagcacgagaggcctgcagtttcgatttggaaacacacggtggcctaaggtggtgggcattgtgtgcaagtacatttaccatctacgacaggcaggacagacttattgacagttagccaagttacttgacttgaacatccaggggtctaacataacaaagtgtctttccaagtattcacgcacctacccatgacta

SEQ ID NO: 551800 - DNA, 423 bp, Homo sapiens
  misc_feature (6)..(6): n is a, c, g, or t
  misc_feature (11)..(11): n is a, c, g, or t
  misc_feature (19)..(19): n is a, c, g, or t
  misc_feature (22)..(22): n is a, c, g, or t
  misc_feature (32)..(32): n is a, c, g, or t
  misc_feature (40)..(40): n is a, c, g, or t
  misc_feature (48)..(48): n is a, c, g, or t
  misc_feature (52)..(52): n is a, c, g, or t
  misc_feature (61)..(61): n is a, c, g, or t
  misc_feature (63)..(64): n is a, c, g, or t
  misc_feature (75)..(75): n is a, c, g, or t
  misc_feature (78)..(78): n is a, c, g, or t
  misc_feature (85)..(85): n is a, c, g, or t
  misc_feature (106)..(106): n is a, c, g, or t
  misc_feature (115)..(115): n is a, c, g, or t
  misc_feature (128)..(128): n is a, c, g, or t
  misc_feature (155)..(155): n is a, c, g, or t
  misc_feature (159)..(160): n is a, c, g, or t
  misc_feature (201)..(201): n is a, c, g, or t
  misc_feature (258)..(258): n is a, c, g, or t
  misc_feature (288)..(289): n is a, c, g, or t
  misc_feature (294)..(294): n is a, c, g, or t
  misc_feature (317)..(317): n is a, c, g, or t
  misc_feature (328)..(328): n is a, c, g, or t
  misc_feature (335)..(335): n is a, c, g, or t
  misc_feature (349)..(349): n is a, c, g, or t
  misc_feature (351)..(351): n is a, c, g, or t
  misc_feature (360)..(360): n is a, c, g, or t
  misc_feature (364)..(365): n is a, c, g, or t
  misc_feature (372)..(372): n is a, c, g, or t
  misc_feature (383)..(383): n is a, c, g, or t
  misc_feature (385)..(385): n is a, c, g, or t
  misc_feature (399)..(400): n is a, c, g, or t
  misc_feature (423)..(423): n is a, c, g, or t
tcagcnttaangaaggggntanaaagggttantttgggcntaggaaantttnccaaggcancnnaagtaacacanccnaaccccncaatgggacaaaattttaaantccaaaggngagggctttaaanaaaacttgtatattacgaaaccgttantttnntggttttacatctagcaacagatctcttttaaagaaggggncatttactagtaaatatgtctaccacgtaatggtctagttgtttttattgttttttnttgaattccccccccctttttaagtgttgnnaactntaagtatcccagccccttaaggngttaaaaaacnctaaaangttccctccttctntnttttacctntttnntcccccncaaaatttccngncaggaaagaacacnngttaaaaggaatggttgtctttn

SEQ ID NO: 551801 - DNA, 601 bp, Homo sapiens
  misc_feature (589)..(589): n is a, c, g, or t
aaaaatccacacagcttctcttggtttctctggcccgaaaatccaacgttggtccaagaaggctctggcgtgtgccaggcactcgctgatcatctggtcttagggggtcgcctctaagccatttgatcccgttccaggaacgaaaaaggcagcggtgatgactgcttcttttatcgtctccctccagccatgcaggacggtctccttttccctgttctcctgagcctaccctcttatgggaaattctcagtcttcctttccaaaggacagcccgctaggctacctcatagaaacctgcaaacctcaggcctcaggcaagatatccgccctaagcgccttgtctttttttcaattcagtctggccacagtaccaactagataacgggtccaaatggcccgcaaatggaacattcgactttacagttttacctgacttaagcaattatttccgacgactggagaaatggggagagattccttatgtccttctgtccaggcctttttgcactcagatcacagcccgacctctgctgttcttgcttacctgtctctcctccattcttccaccttgatcgcgttctcctcccanccttactcttct

SEQ ID NO: 551802 - DNA, 177 bp, Homo sapiens
  misc_feature (63)..(63): n is a, c, g, or t
  misc_feature (66)..(66): n is a, c, g, or t
cgcagttctccttcaaggatctcaacttccggatgttcgatgtgggcgggcagactcggagcnaangaagtggatccactgcttcgagggcgtgacctgcatcatcttcatcgcggcgctgagcgtaccagacatggtgctagtggaggacgacgaagtgaaccgcatgcacgagag

SEQ ID NO: 551803 - DNA, 310 bp, Homo sapiens
agctgcagcatttcggttaatcagcagtaagcttacatatctagagaaacaacatagtggaaaacgaaaaaaaaaaaaacagaaaaatctacgggtaatttcccaatagctttgaatattcacagcagcgcttaataacttgagagaaagacgggcaacactgaaagccacttcggctttctaaccccagttccttaaatctggacatctggtacaatttggtgaaattccagactgtcaggcttaaggggttaataaaattagttggcatcagtgtagtcattgagtgagggggagatataagccaagg

SEQ ID NO: 551804 - DNA, 229 bp, Homo sapiens
tttttaaaaatttccttgggccggtattgggttcttaaacggtattgggggtttggttggaccggcggggttttttttccccagaatgggaggggttaccggggacccttaaaaagttataaatttgggttggttgggaatgccttttaataagtttttggggcccccagcccttaaatattaaggttccccccttccggcaggtttgaaataaaggttggttttttca

SEQ ID NO: 551805 - DNA, 345 bp, Homo sapiens
  misc_feature (286)..(286): n is a, c, g, or t
ataaccaaaagagaggccaggcgcagttgctgacacctgtaatcccggcactttgggagaccaaggcgggcagatcacgaggtcaggatatcaagactagcctggccaacatgatgaaaccccgtctctgctaaaaatagaaacaattagccgagtgtggtggcgggtgcctgttagtcccagctgctggggaggctgaggcaggagaatggcatgaacccaggaggtggagcttgcagtgagccgagatcgcgccactgcacttccagcctgggcacagtagcgnagacttccgttcttcaaaaattaaataaattaaataaattaatcctaattactttttaa

SEQ ID NO: 551806 - DNA, 390 bp, Homo sapiens
tggttggtgagtggatgacaagcagaagcagttatgatgacacggtgatatatccaagcataattggcacatttgtcaacattggtccatttctagaccatccttaaagaaatatcatattgtggggtcacaccatcctcacggtatgtccgaatatagcaaccatgccatctggattcatgtttgtcaccaagtcagaagaactggtagttatcgaaattagcacggatgtgctagatttgtactgcagcccctgtcatacaaggttttactcttactggtctctgtacttcaagtgtcccttggatggatttcatgtaatcttggatgtacttcttgtaggctctcttttgtgaaacttgttccctgcaggtgatggttcatgacatt

SEQ ID NO: 551807 - DNA, 634 bp, Homo sapiens
gggtgttcgatccagtcatcaaaggcaaacgggaaatccgggccgaagatggtgatgggtttcttgccatcgcccgggtggcgattgggcttgctgagggtgctggacggaatgctcatggctgaccttactgacggctcggcgggaggagggcccgttgagtataggaaaagatggcagccagtttagggaacgttacgcgcgttaataagacgcaatctgtcgtcggattgcgctagttttagtcaatgtgacgagctaagtggtcagattggttgtccgcgatccaatttgttactgaggatgatcgaggtggtggttttctccacgccgtcgacactgccgatctggtccagcaattggtccagttgctccggcgaatcggtgcgcagccaagccacgtaatcgaactccccactcaccgcgcacagctgctgcacttgcgccatggcgctcagcctgcgcaacacctctttgccggagcggggttgcacggtaatgcccacgtaagcctgcaaaccaccatccgcaacgcgctggcccaggcgcacgccgtaaccggtgatgacctgggtttctccagggggaactgaatgagccggtacgagtcgaatcggaacagggcaagtgttcg

SEQ ID NO: 551808 - DNA, 131 bp, Homo sapiens
gacaaggccatgctttacaagtgctgcagctcactgatttcatcctcagataccgccctgtgcccaccacgaagtatgtgcgacaagcctggcagaaggcagacatcaatactcatgtaacagcctggtgt

SEQ ID NO: 551809 - DNA, 322 bp, Homo sapiens
tttttttgagacagcgtcacactccatcccatgctggagtgcagtgacgcgatcatggctcactgcagcctcaaacccctggactcaagggatcctcccacttcagcctcccaagtaactgagaccacaaacatgcaataccatgcccagctaattttttatttttcttggtagagatggagtctccctatgttgcccaggctggtctcgaactcctgggctcaagaaatcctcccacctccgcctctcaaaatgctgggatacaggcatgagcaccatgccctgttgctcctattcctttttgtttgttttttggtcgacg

SEQ ID NO: 551810 - DNA, 131 bp, Homo sapiens
ggatccccggcctcttctgtggctcatagtggtggctctttgcgtggctcattgggtggcccttagtggggcacctggggatagaagtatgtagtttctcagcaactcattacagtctgtcacaccacgcg

SEQ ID NO: 551811 - DNA, 244 bp, Homo sapiens
  misc_feature (33)..(34): n is a, c, g, or t
ctgtactctaatctatcaggatgtcttctcgtnnaaggagatgggcctttgggaggtaaaggataaaatgaatgagtctgtcatgattcactattctagaactggcatgacctttactgtgttagctcttggaatgttcttgaaattttagactttcttggtaaacaaatgatatgtccttatcatggtataaaagctgttatgtgcaacagtgtggagattcctggtctggatagattagaga

SEQ ID NO: 551812 - DNA, 475 bp, Homo sapiens
tgaaaccccattccatatgttaaatcggcggcggggggcttagtcttcatgttccctgggcgtcccctcgggccctgtccatcttgtgaccatgtgtcctgagggcgagtcacactgtgtcttgagtctgctgtaaggtgttcagtctactcaaggggtcatcatggtaagctctatccccgggcatcctccgcccatccccacacacactggatggatccccccccgccttgccctttgaaaacctcctgaccttgtctttcctataatccccccaaactcctagggcaaaatggaagctgccttaaatggggaaaccattggtccaaagctataaaacctgaataaagctgaagctggatttaaaagccctggtgcatatgagccaaaagggccaaaagctctaaataatgaactaacctgccactcgtataaatataaatatatataaatatattaaaatcagactgttcta

SEQ ID NO: 551813 - DNA, 232 bp, Homo sapiens
  misc_feature (173)..(173): n is a, c, g, or t
ctaattggttcttcgatgacgcctcccgaccccacccttgggggagggggtctcagcgcccttgggatcccccacatctgctgccatcccccatcgcagtgtttttctcagcaccccctcgtggttttctcccaacaacccctttccgggtctccagccaccgacagcagtgncctcacgccctgggatgggaggatcacagcgccccctccgtcatcgaagaaccaattag

SEQ ID NO: 551814 - DNA, 309 bp, Homo sapiens
ctggcaacatctgtttaaattaaaaatataggccgggcacggtggctctcgcctgttatccctgcactttggtaggctgaggcagacagatcacgaggtcaagagggcaagatcttcttgtccttcgtcctgcaaccccgtttccactaatatttcccatgtaaactgggtggggtgcccggcgccggtggtgcctactacttggtttttttagacacaggccctctttatcatggccggggtgggttgcagtgagccaatattgcccccctgcactccagcctggtgacagagcgagactcggtctca

SEQ ID NO: 551815 - DNA, 137 bp, Homo sapiens
  misc_feature (48)..(48): n is a, c, g, or t
  misc_feature (62)..(62): n is a, c, g, or t
cagctattgtgacagaagaaattgcagacttgttttgttcatcctgtncgtaaggggtcagngctcttggtttggtcttttcaatgaataggacttatgttactggtgtccagctgaatttctcttggggtattaag

SEQ ID NO: 551816 - DNA, 1098 bp, Homo sapiens
gcggagcgcggcggcaagatggcagcgcaaatatccaacgaagaggaagtttgtcgctgtagtggcatcttcagaagctggaagctgaactgagtttctctactcgggagtctggctgaagatggctagctctggagttgaggtgcgaggttacgaccgagagccatggacagaaatcgattatcttagtccaagccgagaacagcagaatgttcttggtggagaagggccggctggattcgggaacttgactgctggtagtttcagacgaggttgggctttccagaagggcagtgtagacgctttcatgctgaaaaggtgggccactagaggtctgtgtgccattgacccgaggcaggagtctcgtgcgttacagaacctcctaggagcggcttgactagtagcgagtagaggcctgacttatggtgtgctagcggttcatcactggagagtggggccgaaggctgcgagggttgtggtgctctgggagaaactccggagggacagcaggtgctcaattgccatttagagttcggtggaatgggctgaatgcactccacgagtgggcacgatcccatggtatagagcttacttaccgttgcaccacatggctgatgccgtccactgctgtgagctcaggaagagggcgtggtagcttggggccgtacatagggctgcaatgaatcgaattgctggcaccttggagggaagaccgaatattggggtataggaattcgggcccgtgaagcagaaggccggcgagaactttggacgcagcggtagaagcaattgagtgggaaagcctcggaagcatgaatggataggatcccttgggaccattcaagaacgccacgaggacgaactaggaaacaacggaacgggaaaggcgaatacgccagtgaagttccgggagctgaccaatgcccaccaaagccaaggtccgacaagggagcaagagaaccatggggacattcgttggagcaagagacggggattaccaagggaaggtacagggcgagggtgagcgtcaccaaaaacgaacccatttcctggaagattggagtaccatagaagagaaatccaaacagaaggaaacca

SEQ ID NO: 551817 - DNA, 120 bp, Homo sapiens
atgatggagtctcccgctgtctccaactggagtgcagtggtgggatctccactgcgagcttttgtgccatgttgaggagtctgagaggcatttaggaagtgtagaggtaatccgtgaggg

SEQ ID NO: 551818 - DNA, 968 bp, Homo sapiens
aaagatattggccttggagggatgaagaactgccaaagtgtgtggtgcatgtgagaaggtgcgtggagatcggtgctgtgcagaccccaaggcggaaagtgaagtggcgaacctccgcctggagcttgtggatgcagtgagcgaaagtaccggggtgccgaggagcagctccggagctaccagagtgagctggaggccctcagtgaggcgaggcccccagggtgtgaagtcaaagatggtgactaaggaagtcattaatgtacaagactgacccctgagatggagaaggagcttcagcggctcagggagagagatctgtggacaagaccagactgatctgaaaggtgtgatttaggagatctaccagctgaaaaaaggaaatccaggccctgaaagagaccaaaccccaggtccagaccaaagaggtggtccaggaggatcctccaattccaagaagaccctcaaaccaacggagtgagtgtggcgtctctgagtggcaaagctctcagaggagcagaacgaaacaagtggatctggagacgggaaatgagccccccatgaatgagcaagatctgcccggaaagaggaggatgctctcgcgggttgaaaggaacagggttggtgcacgcagggaggtggtcaggtatagggatgagcccagggcttgtgtgggctaaggcgaggccgccctttttcggaggagcatcgatgtggaggctgcggggaggaattgacaagtctgctgggcaagaagcttgcgtgcgactgtgaggcgccgtgcgccaccgaagctttaatcgggcagctttgagggagcctaaaagggcgtagcgtgaggcccacatgtgaggtccggcggaggtacggggtgaagcacggtgcaacacttgacaggagaactactccgtgaagtgacccaacccaggggtcttaagaccgatacggcaaattcttccacaggtgaagcg

SEQ ID NO: 551819 - DNA, 267 bp, Homo sapiens
ctcggacctcttcttcacggggtcatcccatggtctcatgtgatgatgacgctgaggtgctctgcaggctgtgcttctcagtggctcccaccagatacccgatggtcctgttgatttgctgaatcatcaacttcctgttctctgcctctggcctgaatcgatgtcccatgttatctggctctctgtagtacagagtcacaaagtcaaattcttccttggtgaaccagttcaatacggtatcgatgttctccctccactatgcacgct

SEQ ID NO: 551820 - DNA, 220 bp, Homo sapiens
tgctgatccttattgtcagtgggaagctgagtcgaggaggtagtggttcaccagattaacaaggcctttatgaattcaggacatgccatgcccattcgctccttgacttttccccgtgactcccagctccttgtcactgcttcagatgataggctacatcaaagatctatgactgtacaacatacccaattttggctgggcacacgtgacaagcggcctg

SEQ ID NO: 551821 - DNA, 422 bp, Homo sapiens
gctagatgactatatcgattgagttcacatgtatacctttgcaaagactgcattcacaactatgtattggcactttagaggttatcagtatacaagcctgagtaacaaaacttagtcatccaatgtccaggctagattagtattaaaattatgtagatcagtaattcagcacaatgctggaacacattactcacatttgtctataatagaccctttactgaatcaatggaatctttaattagataagcaagtctaaggggagagaccttatataaaaaaagctcctatatactgaatatattatgagccctgattatgaagtgagggacaaggcttttctttttgaaatacatgatggaggacatagatctgtggtagccattcatgctacataatttagcattttattgttaatatgttag

SEQ ID NO: 551822 - DNA, 817 bp, Homo sapiens
ctgggtgttaatcggccgagggcgacagtgcacgcagctactaggtgtggcggcgacccttgccccgggttccctgtggctacctgtggcgctggcctgcccccgcgccgcagtgcctgggaccccgtgtgtgccagaccccgaggacctcctgacccctgccggtgtgcatgctgtgtgacctgctgctacgctggtgctaagcatgttctgctgctgttactgtgctgcctgcctcctggggtgtgtcccctgtgttctgttatggccgtctgcctgtgagcagctgctgtggatgcttggatggcctgaagaactgcgaatggtacccgatgcctggctgaccatgcaggagtcgctgctgggtgaatgcagctggcctgaagagcagaatgctgtctgtggaagatgtggatggcagcacatctgcaaaatgtgcattgtgccaagatgccacaagatagatttgtgaacttgtgcatgcagcatgcatgctggtgatgaacttgggatgaatgtgcccagtgctgacaaaggatgatgtgatgtgggccctgactgcaggcttgagtgcccatggagctcctgggctaccatgtggacccaatggagtgccctgcttccagtgagcttgctccaggacctagagaagaagtgagctgcaatgcgcctcagaggaggaaaaacatgaaacggaagaaggagggcgcgagctgctgcattggctgcagctgtggctcaaggaccagcagcctctggggcaccagctcctgatggctttgtccttcccataaaggctgtaccttgcagtaccctt

SEQ ID NO: 551823 - DNA, 546 bp, Homo sapiens
ttattcatgatatagggagaggcattcgggggctctaagaaagttcttgtggtgttctgtggagagaatgattaacgtgtccggggaaagagtcccttggtgtgtgcctgcaccacccacgtgccttccttcagcacctttaggtggatttgtatgccagtggttaacccattgccttattcatattagcatggtcatgccccacccatacacgtcataggagaaaaaagggggggttctttttgatttctagtggagatttctttgaccgcgggaggactaaaggggacttaatgttactaaggttaaagccgggccattttccatttaaaaatattttttaagaggggagagggcgtttagccttttttaaaaactccctttatattacatttggacccatgatactttaatcagaaggttagccttgaaattgtgaacttttggaaatgttattagggaagtttgcaactaaactaaacctggaaaattatgatggttggattcaaaagattaatgaaaaataaacatttttgtccccctgga

SEQ ID NO: 551824 - DNA, 551 bp, Homo sapiens
  misc_feature (3)..(3): n is a, c, g, or t
  misc_feature (68)..(68): n is a, c, g, or t
  misc_feature (89)..(89): n is a, c, g, or t
  misc_feature (155)..(155): n is a, c, g, or t
  misc_feature (160)..(161): n is a, c, g, or t
  misc_feature (209)..(209): n is a, c, g, or t
  misc_feature (222)..(222): n is a, c, g, or t
  misc_feature (241)..(241): n is a, c, g, or t
  misc_feature (268)..(268): n is a, c, g, or t
  misc_feature (273)..(273): n is a, c, g, or t
  misc_feature (278)..(278): n is a, c, g, or t
  misc_feature (295)..(295): n is a, c, g, or t
  misc_feature (304)..(304): n is a, c, g, or t
  misc_feature (317)..(317): n is a, c, g, or t
  misc_feature (375)..(375): n is a, c, g, or t
  misc_feature (377)..(377): n is a, c, g, or t
  misc_feature (380)..(380): n is a, c, g, or t
  misc_feature (390)..(390): n is a, c, g, or t
  misc_feature (399)..(399): n is a, c, g, or t
  misc_feature (407)..(407): n is a, c, g, or t
  misc_feature (417)..(417): n is a, c, g, or t
  misc_feature (439)..(439): n is a, c, g, or t
  misc_feature (475)..(475): n is a, c, g, or t
  misc_feature (548)..(548): n is a, c, g, or t
tcncatacagtcgaagatggattcataaatttagaaaacaaggatgaccaaagaagcagctgagtgtnctagacaaaccaacgataggngggagttggggaggacgaacaatttaagcagcagagaagctcccagcaaacaggaacagtctacanagatnngacagcaaacaagcatcccgaagaagataagcacattttatggcacangccaggcccattntcttgatggatctcttggnaccacactccattctgcgttacacttnctagntaaanttcaggtgttctaagtntcagtaacnctccttacttggntttttccttacttagtcttatggttgtgccttctcaatgtcctattgtctaatatttnanggncagatagttntactgcagntattaatnctcttccttnacgtcagctattctttttaccntgttttgacaagccatgcccattgccgaatactttntattttgcccttccccttgttgaatgcttggttcaccaaagtttgtaatttttgttccattaagctgccacangcc

SEQ ID NO: 551825 - DNA, 330 bp, Homo sapiens
ggccgttctacgttctccccattgctgagcgctccgcgggcgcgatgaactgggagctgctgctgtggatgctggtgctgtgcgcgctgctcctgctcttggtgcagctgctgcgcttcctgaggtgcctgaccggccacctgacgctactattggccgcgtgtcagggacgacgccctgactgggcgctgactgatatggtggtgtgggtgactggctgcctcgagtggcaattggtgaggagctggcttaccagttgtctaaactacgagtttctcttgtgctgtctgccagtaaaattggatcagctggacccgggtgcgaggaaga

SEQ ID NO: 551826 - DNA, 234 bp, Homo sapiens
ctccctagtgtatctactaaacatacaaaactagccggagtatggtggtacatgcctgtaatcccagctactcaggaggctgagacaggagaatcacttcaacctgggaggtggaggttgctggtgagctgagatcgtgccactgcactccagcctgggcaacaagagcaaaaatccctctcaaaaaaaaaaagtaaatgaccctcgttttacagataggatacagtagggaga

SEQ ID NO: 551827 - DNA, 147 bp, Homo sapiens
  misc_feature (1)..(1): n is a, c, g, or t
ncgatggttacgaatccataggaaccatgaggttgccggttcggtccctggccttgctcagtgggttaaggattggcgttgctgtgagctgtggtgtaggccgcagacgcagcatggatcccacgttgctgtggctctggcgtaggc

SEQ ID NO: 551828 - DNA, 974 bp, Homo sapiens
gcactacatatgagcagcctaaccctgacttccctaatttccccccatcgcttatcagcctcgttgaccctaacaaaaaaacactcattgcctccattatgtaaagatccatggtcagatccacctttataatcgagtcatcgtctccgcctaggaaggaatattcagtgtgccttcaacaccgaagcaagttcattgatcgtccgaacatgacactggaaccacgcaaccctagacgaacccgagcatcgtcctctaagcttcacaactcagcactacgttcatccgataatattcatcccttgtggccagttgttcggttacgatggctccagtcataggaacttctcatctgatggatatactagacacctcgagacccaagacgattagatcagttctcattccagagatactctatcgtctatctatcgccataaattaaccattgacttcaactctttcaagttatcgcgcgtaaacgaacactattcacaatactgatatcagtcggacttgagaagaggcggtaggtaagtatatagtcctttcgtgtggctcaggtcaagattgaagtgtatacgggcgcctgaacgcaggactgccaaagcgaccatgcagccacaatgtcaaagggcgaagtcgcgtaaataccatacgcctgctatgtccgaggtcgactcattcaggctgtgtcaaatcgcgtccgaccgttatatggcactgagtgtatactcccttagcaacgtcgcaaatctacagtgatgaacccgcatgcagaacacacatttagcgcacttcgtacaaaacggcttaaattcccaaaagcacctgcaaggccccgaccgttaccttaaggccacttccctaccctaaggcagccatggcagggacaaattcaatgacccaatctaggagtcctacgaagcccatggaaagttacaccatcaagtgcaataggaaagggtaccccg

SEQ ID NO: 551829 - DNA, 1140 bp, Homo sapiens
agaaattgcaccacagatatatgggttaaggtgggtgcggcatgctatttggacgagagttccccactgacaggaccttctggtggtctgggatgccttgtatgcaagacggcctcagcctgggtttagtacgattatatcttcgatagaccatgatatcctttacactccgagatgctattgactctctagataactaccagacctgatctcgagcgcttctgatgcattaacccagttcatcggggatgtacacatcactgattcttaaggctctgtatccgttagagatccacaagagaaagtccaagaccagttgactatactcaaattccatccaaaatctagattcattacaaagcacgaggagcgagaccgtcatgaactcaaagccggaccaagtgccaaaggtgcatccccatgcaatatcaaataaggtcatctcaatcagcctgcatatacatatctaggcacagcaaagtcagataaaccaccagcaataggcctccaaggcacagagcaaggatgggaccatgtaaccgtggcaggcaaaagccaagacaccagatagacagtcgctccacgtcatggtcgggtacagtacaacataccaagggaaacactcaacgccaagcaggcccacccaagagaaccagtacaccatatggcgaacacaggccaaccaggcaggcacgaaggacgggacatgcacttagcacagatcaagaaaaaggccactggccctggataggcccacagctaacgaacagccacacagagggcctacaacgcatcacgtaaaacagacaccactgtcgagacttcccacatcgagcaccacaagcgcgattgacacgcacgcatacaggcaccccattgggcaagcgggaacacggaaagaacacccatgatcaacgcatgaggcacctcccgcacccaaaaaccatttccaaaaccattggccgataacaaaacaacccgacaaacgaaaatcccagtagacaagaaggaccaaacaggatgcacaacaaacggcataacagacgggacatacagcaagcacagacacacaaaaacacaaaacacggagcacaggaaaagcacaacacacacttcatggaacaacgcaagagcaacatg

SEQ ID NO: 551830 - DNA, 638 bp, Homo sapiens
aacaactcaggcaaaataaaattcctgttaattgtgggacaccattgtttcacacatacttcaaacaggccaaaaaaaataaacagcaacttcatagacgaaaaaaggagaaaaaaaagaaacctttcatcttgggcctttttaacgcatctcatacaaaccaactacttatagtacagctaagtacatacacaaaaaagttactggaatgctcggaataagatggtcttcctgtggtcattttggctttttttacaaggtttttttcctccttgtgagcattataatgaacatggtcacaccacaagtaaacgtcagaagtaggacagagaacgccccgaaggctgggttagggtcatccgagatcattaacacaagggctgaccctaacaatatgtccacaaaattataacgctggtccaataaacaaatacaacacaaattcccttttgaaagtcacttttaagaaaacaaagcaggggccttggacagtcatgggtccttttttcctcccctgtttgcaaattctcatggttggggtacgcgtgcgtggaacagcgcgtgtcatctgcgggtgggcactgcccacggtggccggcgggccctctctactcgaaggtgcccccgttaccattctg

SEQ ID NO: 551831 - DNA, 630 bp, Homo sapiens
  misc_feature (9)..(10): n is a, c, g, or t
tgttttgcnnttattcttaaataagcaagcaaaacctgcacattggattcacgtgagatgataatgaaaacttttagtttaagagtgaagggttaagtaacctaacagagctttgatgttatagctgcattaaagaaggtgattgtcaatattacagaaaacaaaaatggattgcccctccaaggaccaaacagattcaaggagcatcatttaagctaagaagagacctaagtgatgaaactagctgtaagaatgtaacaggggttgtgtttgaaatatttatattcccatcggtgtgtttagtcctagaaaattgctagcagcagtcttcttcacagtgccttgggaaaagacatttcaagaggaaacttgataattttaaactcttttccccctttaccgtcatctatcctctatctgtatcaagctcactgcggatcctgctgtaaaactggtgggtagctgggctgtccattaccaccacagctacatcttctgtttctttgaatagaaagcaccacagtgttttgcacttgcctccagtaaagtgccctgggaagggagctgggcagtgtttgtggacgagagactgtaacgatggctaataaaagctgcgggtctaaaaaaaaa

SEQ ID NO: 551832 - DNA, 185 bp, Homo sapiens
  misc_feature (166)..(166): n is a, c, g, or t
  misc_feature (174)..(174): n is a, c, g, or t
tagaggatccccgtactgtggtgtacctgtcttaccccgtttttcccccctccccaaaagctgcaggaaatagaaagctacggaatgtaccttccaggccagaagcaaaacattgaggatggccagcaaagggcaggggccatttctcattctggggtgatgatgnggtgtgtntctcctccttc

SEQ ID NO: 551833 - DNA, 253 bp, Homo sapiens
gggttcacgccattctcctgcctcagcctccggagtggctgggactacaggtgcatgccaccgcctggttaattttttgtattttttagtagagacggggtttcaccgtgttggccaggatgctctcaatctcctgacctcgtgatccacccgccttggcctcccaaagtgctgggattacaggagtgagccactgcgccctggccaactatgtgtaatactcttaagtgaggtgatctgaggtgatcttctg

SEQ ID NO: 551834 - DNA, 1165 bp, Homo sapiens
gggttaccaggcactacttatcaatgtagtagactcagcagtatctatatcatgcaaattgtaaatgtagagtagaatgtaattgtaacgtagaatgttagaaccaaagcatcttcagaagttattatctgcctatacccagatctcctgactgatttagaggatcttttctttgtatacccattacagacttcacaggagacaagggttgtggtggtggtatacagaggacagacccttagtcatcccaagagcactttagatgcttgatacccatatctactacatatcacacccagccacagatcatcataaggccagagacatcttattctctagctcaggcattattagacaggataagatccatggacatacagacaggatctggtgaaagtgaccaaggtactctaggcacacagaagttactactagtcaggaatacccacccgcagtgcttccaaataacaaggtaactagtcatagttgatactcatatgtatcctcttagaccactaggtatcaatcctaaagtcattcaaagataccaacaggcaataagaaaccaccatgtagtacaactcaacataaactaccctagaactatcattacaacgaaagaagataaagatcagaagctaccagggtcatggtaaagaaagagagcttattaacgcgcagaccacccttgaaacaaaagatgcaagcgaactcagcaatacaagaaaaagaacgcccaaacaacaaaacaacgaataaaaaaaagaaaacacaagagccataagcacccatcacacaccagcaaacagagccaacaaaaacacgcccccaacagatacaaacataacaaaaaagatacacatagaacaaatataagacgaaaatagcaaaaacgaataaaaaacaacaaagaaaaaggcaaaaacaagaaaaaaaaaacaaacacacaaaaagaccacactcacaactcaaatatcaacataaacactacatcataattcacgcacaaacaacaactaaaatacaataatgataacactatgtatcacaatactcccataaaatacaaactacacacctaacaacactaacccatattatatcttcctcacgaccacccaccaatcatcacaaatcaaaccactccacaccctaaaccaccaaa

SEQ ID NO: 551835 - DNA, 183 bp, Homo sapiens
caaatgctttcatacatctcaggtggggggacaaaaaggggggaggggggggcacgaaggctcatcattcaaaataaaacaaaataaaaaagtatgagggcgaagataaaaaaagtttggcataacataattaacacgaaagcaaggctatcacctcccgggaggggagcccaaggggtaccg

SEQ ID NO: 551836 - DNA, 411 bp, Homo sapiens
  misc_feature (168)..(168): n is a, c, g, or t
cgcgacatgggcctgcaggagatggccgggcagctgcagcggccacgcaccagggcctgcactttatagaccagcaccggcgtggcttatcgcgagggtcacaaacgttgagtggctgctggatgctctgtacgggaaggtctgacggatgagcagtaccaggcagtngcgccgagcccaccaacccaagcaagatgcggaagctcttcagtttcacaccagcctggaactggacctgcaaggaattgcttcttcaggcactaagggagttccaatcctaacttgttgaagaacttggaacggacttaagcttctttcccagaaaaattcgggtcaacccttgcaaatcccaccaaatcatcctgaatctgatctttttatacacaatatacgaaaagccagcttgaaaaa

SEQ ID NO: 551837 - DNA, 102 bp, Homo sapiens
agataacccggacgacaataacccggatgataataacccggacgacaagtacacccggacgacaagtaacccggacgtacaataacccggacgtacaataac

SEQ ID NO: 551838 - DNA, 121 bp, Homo sapiens
cttcgtcgttcatgctggggttggtgagcgagaactgctaactcccgaacaaggctgtaaggtctgggaggctcaggagctggttgtatagcttctcgggcacgacgctgaggatcaaaag

SEQ ID NO: 551839 - DNA, 571 bp, Homo sapiens
ctgcctacaatccaatccaggttcccaaatcgcccgcacatccaaaagcgcctgtagcccgcccgaaccgagtaatgcgacctattactcctaaaccgcgcgcctatgcgacgtatagccacgctaggtgccacgaacggttatggcgcgataataggatgtttatatttgcgggcgtgaagggaatgcgatggggctgtaatgttgcggtattgtaaagccgccatcgtatggataatgtatctttagcgagggcgtaattgcataattcgtagctatgtgttcgctaaggagtgatcggagctgggagcgcgttgagacgggttagcccctttggcgtatagttgttatccggttgggagcgattagtttggatgacgtagaatgttgttttgtttatgttcagtctatattgcctaaagtccgatgtcgggtgtgtccgcgttctttgtcgacggacgttcgtaaccgttcgaggagggtgggttgaatggcttagtggtggaactggataaagagatgcctattcggtgactcgtgtgtcagatgccctaatcgtgcgaaggcggat

SEQ ID NO: 551840 - DNA, 166 bp, Homo sapiens
actctatgaggatccccttgcaggaaatgggctggaacctggtgggaagtgcacaaggttggcttgctttggtgacaaggggaagggtccaggcagaatgtctcaaaccgttcaaccgggagtctatattgtccttgacctatgggaggaggaggtctctagtttg

SEQ ID NO: 551841 - DNA, 449 bp, Homo sapiens
ccagagcacccccaaggctggcttgggagcaaatggctctggcttctttttgttgttgtgccgtttgtgatactccagtgtcaaaaagccagtgaaaaaaataaggagcagagtcctcctggccttcgaggcggccaacttccctttccattaaagaaaaaaaaaaaatgcttccccccacaaagactgtgcattcaatcccttaatggaactcgaggtggagcttatgaaatttgtgtccaaagtgcggaatttttaacgtgccatggcaacaggtagtggcagtacccccaggcttcgaaagtcaaaaatgcctgcagatccatcccatgtcccgatttgtgaaatatggggaaaaaaaagctctagctgaatggatttgtgggtcaggaaaaaaaaaagttgagtgttgcccaactgtatgccaactaataaaacttttttgaaga

SEQ ID NO: 551842 - DNA, 156 bp, Homo sapiens
ggaggcgtctagaggatccctaccctcagtaccaggtgcctttaaggacgagttaagaagccccgcgcgacagacacacacacacacacagcacaaaacacagcgaggtaaagtgtaggtaacactctgggtacaagtgtaggggggagaagtgca

SEQ ID NO: 551843 - DNA, 156 bp, Homo sapiens
gtcccaggttgtgctgtccaggttgtgctggtccaggtgtgctggattacaggcatagccacggccagccactctcctgttttaaatcctttgattttccccccattgctttcaggcaggaaaagactttatacaacttataaagaccccctggga

SEQ ID NO: 551844 - DNA, 1535 bp, Homo sapiens
tctaattttataattttcgggggcccttagtttcatggagaattttttttttttggaaattggcaggggtctctcattattgtttcccaagaacatagagtgtgcaggtggattatttcacaggcgccgtttatagcgcactatacaacctttaaacctccgtggctcaagcaatttcctcctgtgccctcagccttgggacgatagcgtggaattattcaagttgcccgcaaccagcgcctgtggttcgtggcccaaaaataatttctccatagtcgagttcgtgtaccagtgttatacagtgttgggctcttttcccctcacagtagcgagacagagtctattttctcctatctcttcgaggtaggggtctcagagcctcccaatgtgaaccccttttactgtgtacaacgagcctgttgcagtatttgggtgttcaccaggtttagaaaaagggggtgcccccctgtgagatcttaacaattttgtctgtgacacacaggatataactacaggggctcacaggtcttcatataggccagagtgtctgttcattatttataattccacagtctcacattgttgtcccccgagagagctcgtgacgcattgcgagaacaatacacaagtagtggccccccgcgggataaaccccaccctttctgtgcacaagtaccccccaaagggtgttatacaaaacgtcgcttccgttgggccccccggtgggaagaaatgatccccacgaggtgagacacaaatgtcccgcggaatactagtggggagcacgagacctcgatgactgttgagtgatgagactcaacatggccgcccgccgggtgtcacatcaaagacctatcctttatctacacaagcatcgctgtgtgcaaggtcttcacccctttgaaagggggagtaatagcacgacagcccgcggggaaatataagcacatcccggtgaaagatgtcagcaaaaaggcgctccaccagcagtggggttccccacatcaggagaagaggcgccactgtaggttacatacaggggttgaagaacaaagctcaccgttagtaggctggtgttccccacgcgacaactatttggttagtgcgcagtaaaccaggagtgggtgtggtctctataagaagtatacacagcggcggcggggaacttactatgaagaccccaaatctttttcgcggaggggcatatctttatccgggagcgatcatcaagtgagcactgacacggtgccaccccttcatataaggaagggagaaattccccgggcagcggtggcacaaaggtaacaaggccctattggggctggacccgagttataaacaacacagatcgcggcgagcactactgtgtcaccaggtggcgcccgggcaaaaaacgggtcctcctcaacacgggaccacgctatataagagacccacccgaggggatcactaccgagacgcgaggagcagggaacaacactcaaccaggagcgcctatcatgagagaggggaaccactgtggaaaaacaaggcca

SEQ ID NO: 551845 - DNA, 180 bp, Homo sapiens
gcaagagagaccataagcaaccgccaggagacctgagcaagccaggagacctgagcaagccaggagacctgagcaagccaggagacctgagctagcctggagagctgatcaagacaggagatcctgatgcaagccaggatacctgatcaagccagggaggactgagcaggcagggtgttt

SEQ ID NO: 551846 - DNA, 968 bp, Homo sapiens
gtgggggagagtgctggcactgcatcaattgcagctgatggatatcctgtttgcaaatcccaatgatttttgttggagagaatattctggaacagagtgagaacctgcacaacgctgaccaggcactgcgtgtccgtggctgcatcctaatctctggtggaacgaatggatgaagaatttaccaaaataatgcagaaagtacggatgcctcagctcccaagagatacgtggagcacttgaaggatgaggcccaggtgtgtgccatcatcgcatgcgtgtgcagcgctacctggtaggagaagggcaactaccgaggaggtctgccagcatctacctgcttgcgcatccttgcgcacctacatacaagtgtgattacataggccatatcagcgacagttgaccccgcctgagggctcctctaagtctgagcatgaccaggcagaagatgtagggctgaggactcggcttgtgtttgatggaagagactgtgcaagtactattctacagccaaggaccgcaggagaccggatccgcacatgtgccatcctctgccatatctaccaccgatggtctgcattcgcgctggtaccagggcccgggacctcatggtcatgagccacttgcaggacaacattcagcatgcagaccggcagtgcagatcctttacagagcgtacccagggtgccgctgggcgtctgtggcttccgtcaagggctgcacgatgacgctcgactacgcctgtggacatccagtcgagtggctgggcgaggagttctgtgccaaggctgtgtgggcggctgaggaggcacaagagtgggaagtggccgccgatggtccttcccttggatagctgggccggggggtggtcccggggtggcggctgggtcctattgggcctataggagcccggtgtaggtccccgtgtgggggcaactctggcccctcggcttgtccagaggccccaaggg

SEQ ID NO: 551847 - DNA, 161 bp, Homo sapiens
accacttctgcctatagcctagctcagcccaccatttctcagtccctatgcagctacacacttctaccttgcccctcccaacatagcccactctggaatccagtatccataaactattacctagtccaactaagcagacactacatccccagtctaatagg

SEQ ID NO: 551848 - DNA, 140 bp, Homo sapiens
gactcgtgcgtcactgcccagtcttcttcgtcgtatcgtggtggtgcctgggccgacttggtctctgtagaccaggaggaattcggtcttccagcatggtgatgaagaacaacgatcttgatatttggcctctttgaaga

SEQ ID NO: 551849 - DNA, 347 bp, Homo sapiens
  misc_feature (162)..(162): n is a, c, g, or t
ccaggaggtgctgacctttgggtctgtggtttactgtgatgtactgatgacaaagactgtcacagcatcttagaacgggggaggcacagcttccaagaaatgatgcaaaactggtggcgcaaacagaggccaccaagtggcaacaatgggcagggcatttcnctttgttggctggtggtcacggacaacttcgtggtctcaagtttcccgaatgagctatgctaagacaatttaccgagaaagcaaaataatgccatgcaaaacagcgatgacaaatgcacttgtgggtatccgatgcaaagtgtgcagttcccgccttgtccagctaatttgtgtggagccaaata

SEQ ID NO: 551850 - DNA, 206 bp, Homo sapiens
cgttccgcgcacggcctggcggtgttcgacgtctgagcacctgcccacccacggcggcagcctgcgcgtgtatgcccagcggctcgacaccggcaagcacgatgtgacggcggaggttgcgcgcacgctggacgaggagcaacaggccggcatgaccggcgcggccttctacgagcgcttccagcagcaggccgatgcgcatcaag

SEQ ID NO: 551851 - DNA, 557 bp, Homo sapiens
  misc_feature (222)..(222): n is a, c, g, or t
  misc_feature (267)..(267): n is a, c, g, or t
  misc_feature (318)..(318): n is a, c, g, or t
tggtggaaacggggtatacattttttatactcaggctaaaagtgcaggggcatgatctgggcttgctgcagtttgtgacctcaaccaagagttcagaatggatcctggtcccaagatcgagcctcccaaggaagcgtgggcacgacgtgtgacagggagtcgatccacgttcgtggcataatttgtggcatatttttctccttagaatggggtttatcaccnatgtgttttgcccaaggtttgggcctgcgaaatctgccacagtgntctacagaggcgaatacacaccgcggctctaacgaggtctaccacaaaganggcgccgcggggacatctaaatgaggcctatgaagcccaccaatatcgcgtcgcttaatttaccagtgtttaagaagatggtggtctcattctggtcaccccaatgggagtgtagcagtgtgatcacagcttagtggacccttgaatttctgggacttaagtgatcctcctgcctcagctcccgagtagcagggaccacaggcacacaccaactaagtgaggctagcttaaaaaaattt

SEQ ID NO: 551852 - DNA, 296 bp, Homo sapiens
  misc_feature (28)..(28): n is a, c, g, or t
  misc_feature (211)..(211): n is a, c, g, or t
tttggttggcgatttccagtgtgtaagnaggttcctcaagtataatgctgaaatgctgtctagtatttcctaagcacaagagggctatgatgtgccttttggagaaaatacacgttagataagcttctttcaggcttgagttatggtgtcattggccatgagttcaatgctactgaatcaacaatatgtattaaataaggtgtcgttaagnagaaatacacataaaacaaggttatgtattgacaaaaatattgcagccatgcctgggcaacatagccagacctcatctctactag

SEQ ID NO: 551853 - DNA, 104 bp, Homo sapiens
cgccaatcaaccagtcgtacagccataaaactcttcaccaaagagccctaaaacccgccacatctaccatcaccctctacatcaccgccccggtgttgttgggc

SEQ ID NO: 551854 - DNA, 348 bp, Homo sapiens
tcgggtaccgtatctctaacattacatgtttctattctattcttttgattcaaatctagttttcagcctgtaatcctagcactttgtaagcacaaggggggaagactgcatgaggccaggagttcgagaccagcctgtacaacatagaaagacctcatctccaatggaaaaaaaaaagtctaattttcctttattcataaaatgtagtctaaacatatttgagacttatgtaatgcaggccttaccctacattgtattcaccatttatttcctaactgaaacaagactgggaaggaggtatacataaataaaaccaaagaaatacccccaactctaatgttagagata

SEQ ID NO: 551855 - DNA, 376 bp, Homo sapiens
ggcacgggttttgtccctattgcccgcctcacagaggaagctccacacttatttgtggctcgtgctcctcggtgctctgacctttcactttgtataccctgtggaaatgagcacaggagggacgcgacgcggctgtggttaatttggggtaaagacccctctggtccccggcgagtacccggtcaggtgtcggcccccgcgttcgggctctctcaccctggcggagaacccccttcaacggcagaaagcctctgcacagcaccgcgcacgggaggtgccggtctctcgcacccccgaacctgctctcattcccaaagaggagagcgctggccgcgtcttgaaccggggtcgcctacctcccccccccaccccccct

SEQ ID NO: 551856 - DNA, 723 bp, Homo sapiens
  misc_feature (458)..(459): n is a, c, g, or t
  misc_feature (466)..(466): n is a, c, g, or t
  misc_feature (477)..(477): n is a, c, g, or t
  misc_feature (481)..(481): n is a, c, g, or t
  misc_feature (483)..(483): n is a, c, g, or t
  misc_feature (485)..(485): n is a, c, g, or t
  misc_feature (498)..(498): n is a, c, g, or t
  misc_feature (512)..(512): n is a, c, g, or t
  misc_feature (516)..(516): n is a, c, g, or t
  misc_feature (523)..(523): n is a, c, g, or t
  misc_feature (567)..(567): n is a, c, g, or t
  misc_feature (575)..(575): n is a, c, g, or t
  misc_feature (578)..(578): n is a, c, g, or t
  misc_feature (652)..(652): n is a, c, g, or t
gcatcctggttgttgctgtgtcctgatagcccccccgcagggcctgcacctgtgtgcccaccccacccacagcggccttctgccattccgacctcgtcatcagggcccagattcgtggggacacccgaagtccacccgacccccttatacccgcgttatgagatccagatggcccagatgtataaagggttcccaacccttaggggattcccctgacatcccggttcgtcttacaccccccgcccatggagagtgtctccgggatacttcccaccaggtccccaccaaccgccagcgaggagtttctccattgctgggaaactgccaggatggactcttgccacaatccactacctgccagattttgtggctccctggaaccagcctgagcttagctcagcgccggggcttcacccagacctacactgttggctgtgaggaatgcaccagtgtttccnngtttatncatcccctgcnaacngnanagtggcactcatngcttgtggacggancagntcctccnaggctctgaaaagggcttccagtcccgtcaccttgcctgcctgnctcggganccngggctgtgcacctggcagtcctgcggtcccagatagcctgaatcctgcccggagtggaagctgaagcctgcacngtgtcccccctgttcccccatccccatcttttttcccggaccaatgaaataaagagttaccaccccagcca

SEQ ID NO: 551857 - DNA, 444 bp, Homo sapiens
  misc_feature (179)..(180): n is a, c, g, or t
  misc_feature (187)..(187): n is a, c, g, or t
  misc_feature (198)..(198): n is a, c, g, or t
  misc_feature (202)..(202): n is a, c, g, or t
  misc_feature (204)..(204): n is a, c, g, or t
  misc_feature (206)..(206): n is a, c, g, or t
  misc_feature (219)..(219): n is a, c, g, or t
  misc_feature (233)..(233): n is a, c, g, or t
  misc_feature (237)..(237): n is a, c, g, or t
  misc_feature (244)..(244): n is a, c, g, or t
  misc_feature (288)..(288): n is a, c, g, or t
  misc_feature (296)..(296): n is a, c, g, or t
  misc_feature (299)..(299): n is a, c, g, or t
  misc_feature (373)..(373): n is a, c, g, or t
ccagtcgacatcaccttcaatgggtaaggcactttcgtgcatatgtactttggtggtgtgagagcaagtctcccgagtgggtcagtgttgaaagatgagtagaggaaagttctgctccagggcagatgcacggagaagccgtcagagatgtctccctcctgccttccagcgtgtttccnngtttatncatcccctgcnaacngnanagtggcactcatngcttgtggacggancagntcctccnaggctctgaaaagggcttccagtcccgtcaccttgcctgcctgnctcggganccngggctgtgcacctggcagtcctgcggtcccagatagcctgaatcctgcccggagtggaagctgaagcctgcacngtgtcccccctgttcccccatccccatcttttttcccggaccaatgaaataaagagttaccaccccagcca

SEQ ID NO: 551858 - DNA, 206 bp, Homo sapiens
tttttctgacccaccttatgttctgatccaccgtggggggcctaagtacttctgatcgatgcccagcccgtgcacggtgtgagcgccggtagcggcccccgtgcgctgccgggcccgtggtcttcccggtagtcgggttgctttgcggaacttgcagcccaatagcgtggtggtaaactccactctaacggctaaagtaccaggca

SEQ ID NO: 551859 - DNA, 963 bp, Homo sapiens
cagatgcgcttttctcagaaggtggaagaaagtttgagagatctgtgctcaggatcaatgtgttttgatagagcggtgcctggtaaccatcacatctgcgagatccgtgggtcctggcaagattgttacagtgactgggaatccaagaacctggtactagcacctgtctgagggatcatgtcatctctgtggaataagactgtcgtcatggtgtcactcgcgcctctgaaacactatgcgagttggtctatgcgcaatgcagaaaaaggacttggttgatgtttacatgtggtgtagctatcaatgggcatgaaatacctagtttgcagtacagtgtccgtgatcctgaattgcaatgaggccactctggtatgttttacgtgactcgacttctggaaagaacttttcgtagtcacactttgtgggtggaacgtgatatttatactcagaattgtgtcacttgacaaagggaacagattacgataatcttgcagacgcgcgttgaaaactaatgcatgggtatttcagacccggtgctcgaccaattatcttgcctccaaaattctgagcatatgggaattataacattccttgactggatggcccaacgtttccgtctggcttgatgcaagatgtcgatggatcataacctttactggatcgccagattatgtcggatgcttaacccctcaactccatttgaggtgacagtgccgtagtcataagtaaaaggaaaaggttccagctattcggtgttaagcttgcttgttcaagggatttctcaacgtagagactctcgatcaggttctagagctggaacgggcttcttaaatttttaaactgcgcagggggggccaacgcattgtggcccctgggacgggttgagggccctttatgaacatttgtctggtgccaaggagattacaactctcgacaggggtgggggaccgttggaccgaaagg

SEQ ID NO: 551860 - DNA, 228 bp, Homo sapiens
  misc_feature (19)..(19): n is a, c, g, or t
aggctctacaagacgctancttccacctatcatagaagagcttatcaccgtttcatgatcacgccctcataatcacttttccgttatctgcttcctagtcctgatatgccccttttcctaacactcacaagcaaaacctaactaatactaacatctcacgacgctcagcgaaatagaaaccgtctgacactaatcctgcccgccatcatcctagctcctttcattctg

SEQ ID NO: 551861 - DNA, 264 bp, Homo sapiens
  misc_feature (18)..(18): n is a, c, g, or t
  misc_feature (31)..(31): n is a, c, g, or t
  misc_feature (79)..(79): n is a, c, g, or t
  misc_feature (95)..(95): n is a, c, g, or t
  misc_feature (101)..(101): n is a, c, g, or t
caggcggtcagtaggcgnggaggtgaggtanaatataaacgcattagagtaaatgatccgggcgagatcatgtatacgnatgacgtgggtggggnaagggnttattattaaggatataaatggccgtggtggcaatgcattaaataagggaggtggcagcagggtgagtgtaaaagtaatatgaagagtggtggtggcgcggcgggcgggccgtcgcgcgcgcgtgtggacccacatccgcgtcaagcccatagaggttattat

SEQ ID NO: 551862 - DNA, 478 bp, Homo sapiens
  misc_feature (27)..(27): n is a, c, g, or t
  misc_feature (76)..(76): n is a, c, g, or t
  misc_feature (173)..(173): n is a, c, g, or t
  misc_feature (197)..(197): n is a, c, g, or t
  misc_feature (262)..(262): n is a, c, g, or t
  misc_feature (265)..(265): n is a, c, g, or t
  misc_feature (267)..(267): n is a, c, g, or t
  misc_feature (276)..(276): n is a, c, g, or t
  misc_feature (328)..(329): n is a, c, g, or t
  misc_feature (337)..(338): n is a, c, g, or t
  misc_feature (349)..(349): n is a, c, g, or t
  misc_feature (352)..(355): n is a, c, g, or t
  misc_feature (367)..(367): n is a, c, g, or t
  misc_feature (467)..(467): n is a, c, g, or t
ccccactcaggagtgagacccagtggncaataagctctgggacagacgaatgggcgccctcctccttccttctgtngggctggagtgagtggaggagagtgactcagctcctgggctcaggcagggtctgagagagggccaggatggtctcgagttcttggcagctgaggaangtagctgggcacgggtagtaacancagcgaggggcgggccagggtggccagagcccggggccaggaatgtgcagctgaggtcaattttnccngngtcctcccnactcggggtcgggcggcgggaaggagggtggccgtggcgggggtggaggttnnttcccaannctcagagcttnttnnnnttcacccacttntaggtgccctcatactggaaacccactctcttcatcagctcgtctgcctccgtggggcctcggctgccataaatataggggatgggcttaggcttctccngcacaatctgg

SEQ ID NO: 551863 - DNA, 719 bp, Homo sapiens
cagacgtcggggggggaggagccagcatgaccgatcgctgcgtacgctactatatactgaggggcccaagatgggacccctacccttattgagacccacatacacgtctatttgaccacatgttcaggctcgctctgctgccggaggatgtggctcatgggataggcgtgggcagatgtccaagatacgtgcgacccctggcccccgactgcatcgtgagccgacaactgtcagggcccgactacaatcagcgcgctcacacggcaactgatctaaggggtctcggacatccgggacactgccgctcgatggcgactgtccatggatgtgaccacttaccccctgacgagatgacagtgaaaccaacgattgagtgctggacatcaccgactaggactatgagcggcaagacgagcatagcttcatatcccattgtttcacgcggatatacactgctgaccccgatgtggtagccgaccagtttgcttctgcctgggcgctgaaggcacactgacacgagacggccttatgcctaatgtatgcacgcaggacatctcaccgtactatgcacctgcgaagaatgggtccaacttgtgtgcccagatgctgaatatacgctggactgtacacttgtatagtgtctttaaacattatctttctatgttaacaaaggagaagatcactgtaaagaatgatgtgaggggggtcggcacaggtgt

SEQ ID NO: 551864 - DNA, 153 bp, Homo sapiens
gacataatcaaaagagctatatttaaaaagatcccgaacagcttagaggttttttttttgaagaaaagggccgaaggcccccgctgcgcccaaccccaggtctgtttttggggcgcagggtttaacaccaaaaaaattgtatctgggcccccc

SEQ ID NO: 551865 - DNA, 426 bp, Homo sapiens
  misc_feature (134)..(134): n is a, c, g, or t
cagaagcggtgatagcgcccagggacgaggttgtgcgctcgcgcgggcacggaggcactgccggtgctagaccgagacaactaccggaccacgggcagcaccgtaggcttgcttctgctgccgatactgcatgntactgatggcgactggagctgtgcagggctgagagacagaggagaggcccacagactcgcgaagaggagtgccactcttacgcaactggacaagagcacccatgagaggcatcccaggtcacgatcggcgatcactgcctgcagctaggcacagcgaggatgtccaagtcagcgcccatactgaaaggaactagctgagaccagacggacaagttaaggacctgaagttaaactgttatggtgagaagaacctggttggcctcgacccactcgagcacacttgagagaccgc

SEQ ID NO: 551866 - DNA, 202 bp, Homo sapiens
gggcagaacaccaattttattataaatatcaagatcctaccgggggtttatgggcccgcatatgccttcagttatgttaaaatagctgatcatctttccggacattctgaacatttctcaatttcaaagggctggccacaccaaagcattagccctggctttaaactccgttacagaaaggaattacctactctggaaaggg

SEQ ID NO: 551867 - DNA, 1020 bp, Homo sapiens
  misc_feature (535)..(535): n is a, c, g, or t
  misc_feature (594)..(594): n is a, c, g, or t
  misc_feature (744)..(744): n is a, c, g, or t
  misc_feature (860)..(860): n is a, c, g, or t
gcggatgggcgacatttcaatctccattgagagaataggtaaaactgaaggcagaaggctgggtgcggtggctcacgcgcataatcctagacactttgggaggccgaggcaggtggatcatgaggtcaggagttcgagaccagcctggacaagatggtgaaaccccgtctctgctaaaaaatacaaaaattagccaggtgcatggcgggcacctgtaatcccagctactcgggaggctaagacaggagaatcgcttgaacctgggaggcagaggttgcagtgaaccgagattgcgccactgcactccagcctgggcaacagagcaagactgtatcaaaaaaaagaaacaacatacagtgtgtgagcctggcttaagtgccctgtccttgggtgcccagagccagacttaagaggtaacacccttagcaggcacgttcctttcaccctgtggtgtggaatttgtatgtgatgtattttttctttttccaaaaatggggtggactttggaacagcaaatatttaatcggagcaaatnccccttgccagaatcctgctagcttgttcaccttggaggttctttgcccaaaaatactnaccacatactgaaaactaaatgtgctaagtcacccacagagtataaaggaggtcttgattaggatttggagcagggggtttgtttacctgtttttgatgaatatacagtgtcaatgtactcaccctgtgatgagccttaaagggccctgnccgcattccagattctggagtaagcaaacaagggaggggatttgttggggatggtggctcagcctgctgctgttagcattctccttgaaatggattttggaggaagaaaaaagagntagggaggtagagaaggtctaaaggtgtaagatgggctggtatagatgaaagaggtgctaatgtgcatgtgttatggggaagatgtggttcaggaattagagttgctgatggagtagaagagagaaggtggggagaaaataatttagggaatgttttaga

SEQ ID NO: 551868 - DNA, 430 bp, Homo sapiens
cgctatatgtctcgacgtaaaagcgcttggtattagttaatctctaaggattgggagagctggaagaaaaagatctagctatgttagtagagattcttcacagacgcagattttcccacacaaaggatggctttgcagggccatttcaagatatggcagaaaaacgtgtttgggggtaaaatatttggattttcttccttgtgtggtagtgttatgccagagtcagattggaaagtaagtcacgatatatagaattaaataaaacccatctgatgagaatgtatagtttgtagggcacaactctccagaccccttagacaggaatctgggcaagattaaaaaatagagcttagtcctctcctcaaaaggacagacacaagagtacccggccttaaagaggaggctagagagagagagatcagcgtagaaa

SEQ ID NO: 551869 - DNA, 340 bp, Homo sapiens
gaaattttttttacccttagttgcgcgcacaggaaaagactgttatcttgggagctattccaggtctctaaactctcttcctgcgccttgtccttgtgtacctcggctaggcttaacctttcttgaagtagcgttgatcgccttcggataccattcgtgtattattttagaataaaaaatactatgaataagtatgcaaccttcttaatgattaaagcccgtaatcttctttaacgacaaccaagaataaccaattagaaaatcaaccaaaactagaagaaagatcagatactcaaatgagatcaaattcaaaaaaaaagaaaccggaacaacatgtcaa

SEQ ID NO: 551870 - DNA, 147 bp, Homo sapiens
  misc_feature (19)..(19): n is a, c, g, or t
cggacctttgatgagcccntctctctagacaattcccctccccattaatctcatcactatttgctttatttctacagtgattctactgctggaagttcttctgtcccaggaagagataccattctttacaggagaggggctctcaaa

SEQ ID NO: 551871 - DNA, 393 bp, Homo sapiens
cagcaattgttcgctactggacagatatcatttgttaatccatggctaaaaagttttaatgaagcttctattactctattattcgagtttacagtttgctatctacttaggatttttacgtttcttttaattagtattactttcgagttgtctttgtttcactttgatatcggggttatactaatcccttaatatgcttttcaggtatacttctattttctgtgtctcttaaacaggctctgtggcattataattattgttgctgaaaggcccttatatacaccagaaccactgtttatgaacttgaattatgcaatttggaaattatatcattcaaatatttcaattttttggctttttgtactatatgtgtaatactaggaaatcttaatt

SEQ ID NO: 551872 - DNA, 832 bp, Homo sapiens
gcggcggcggcggccgggacaatggcggagtgcgacggccgcggggacagcgatgtcagccaacgcccggagcgcagtccccgaaggatgataatgaagataattcgcatgatggtgacccagccatccataaggtggcgaatgggctcaggagatagttctaggagttgtgaaactttcagagtcaagatcttggtacatagttacgtatccagcaaaaaacttgatagagtagcaaatggcctaccatgatgacgacatggtagaatactatatgcttcaagaacaagtcagtgaagtatttgggtgtgacctcctttaaaaggaaatatccagatgtagagcgacgagatgtgtctcacaaggagaaactctacctgagagagctatatgtcattactgaacgctcagtgcgctctagggcttaacagcattgcgcagtgatgaaggtgatagagtttaatgataaaacgaatatccagtcaagcatgctgagtattctgtgattctacaaggacagaagaagcgtcaacgaattacagaccattataaagagtattcccaagatgcgacatacagaatactcagaaagtagaagccagtaaagtgcctgaagtctatcaatgacaagctgacacaagaaagcagcagaagttaatagcacacttaaaacccgggtaactgcaatggaagaagagaaggaggtgtattgggaacttgcagtacacaatgtgataccagggtagctacaagggaaagttaaaacggtgtgggccagacagagaggatcaaggtcagttcgtacccagtggcccacaccccggacagtccg

SEQ ID NO: 551873 - DNA, 256 bp, Homo sapiens
  misc_feature (63)..(63): n is a, c, g, or t
  misc_feature (93)..(93): n is a, c, g, or t
  misc_feature (108)..(108): n is a, c, g, or t
  misc_feature (196)..(196): n is a, c, g, or t
  misc_feature (217)..(217): n is a, c, g, or t
  misc_feature (223)..(223): n is a, c, g, or t
  misc_feature (252)..(252): n is a, c, g, or t
cccatcccttgctactcttactaatgcattctgccctctagccaccagaatacttgctttctnctggaggtagcaaagctttcaagccttttnctcacactgtttctnctgcatagaacacctttggcaactttcttcaccaagcaaatatcttttttaatgtccagttttaatgtaaccttctctgggtagtctngactcacttatactgaaatantccttnccttaatgtgatccctcagcaccttgtgnaata

SEQ ID NO: 551874 - DNA, 800 bp, Homo sapiens
gccaaaacgagctgggcgcccgcggtccgggtgcagcctccacaatccgtaccatattcaacggcctctgtgacatcataatgttggatgtcatatctaagagttacttacaagaatgtgcctaattggatagaatctggtacgatgctgctgacaagacattgcccaatggggtggtagtgatgaagcagccaaaggtgcgataccttaacggaacacggaacacgtgaagggctgacccaattccagtatgtctctccgacgcgggacaaggtagacgagagtctctcagttacttgacagaacaatatatcgtcgccagaacaggtaaaacctaacggaaactgtatcgacaaagaagtcccccgtatacaccatccgttgcgaacattatgtccttagagggacatgactttccagtaaaggggaaggaaaccacccattataggcgtttggaggaacacttttaatctgggatatgagcaccacttgtatccccgtttgagcatttccttcgatcccacacaccagccaagagaacaagctgtgtagtacgatttggagaaacgccccaaggaccaatattgtcgagggcaatggcaaacggaggggacaatttcgaccagacaagcttgcaccacttttaataggaacagggtataggcattccaaagagaacaagaaaacatttggctttcattcaccccagaaggaaatagaaagcagactttcgaacttcgagccgccttggttggcaccgaagaattcgaacatagcgccattcgaggcggggcccacag

SEQ ID NO: 551875 - DNA, 205 bp, Homo sapiens
cttggccatcatctcgcatcgtgggctggggcctcttaggtgtagcaacaggaagtcatgtcctgcgtgccggcgttctgactggttgcctcatcgggtgatgatagccagaggtggggatccgtgtggttacgaagacagctctactctctgattcgttctgtggctgcgcctgttctgcttcaggagcattagtagggagcat

SEQ ID NO: 551876 - DNA, 291 bp, Homo sapiens
ctacctcctactgggaccacagagaacgcccagcgggacgcgtgagagagtacctaaaaactgacggacgccaaggtgggggaggatgcctgcgtcatagacaccctgactcatgaccacgtccagcagcttcctgacagagttcatcaaggtacatcaagactagtcaaggttgtgctcttggaagacctggcttagcaggtaggcctatgcattccggacaccatacatcgcatactggacctgctggctgaggggactcatcccggtttgattgacgaccggggcaag

SEQ ID NO: 551877 - DNA, 1031 bp, Homo sapiens
gcgaggtgtgaggtgaacaagtgcagtccgctgtctcgaaggggcctgtgtggtcaacaaggcaggatgtggggatgtcacctgcaagctgcatcggatggccgggtgggccccagctgtctgacctgcgtcgtgccagctgcagcaatggccggctcctgtaccatgaacagcgaaaatgatgcctgagtgccagtgctcgcactccacatgacagggccccggtgtgaggagcacgtcttcaggcagtcagcagccaggacactatcgcctccatcctaatccgtctgctgctcgctgcctgctgctgcgcttctggtggctcgcgccacgctggtacttctagtgtataatgcgtgctgcactccacaggaggcctaaggggccttccacgcactaacggcactgacgcacacgcgggccactgacacgtgccacgattggaaaaccccccaccctacacagatcgccacgaaggcgcgaccagcctcgcattgatcgtgcggcacgccctaactgcgcccggctcgcccttttgcccctggcacgcctgaaccaagcctcacctaaactttccacaaatccccgcgtgtcatgcctccacctcctacaccggcggggcccacatgcccacgctccgccacgcctcccctgggcttagccaacggcaccgaagcacacgccgagaacccccctgcgccccgggcggcccctgaagcgcaccgaagcaccaccgccgaaccccccttgccgccactagcgcggcccctgccccccggtccccacattgtacccccgccgacaacgccccttaccactgccccccccttcctctcagcaccgcaacactaccccttcccagccctagcacacacccctttccaccaccacgtccaacgccccctttccccactgtctccccccggcctcagagactgcaccgttacactatcgccacaaatctgacacacgaaatttaccacgcttatcaatttcttctgaaacaacaccggaacaccccgcccctcccc

SEQ ID NO: 551878 - DNA, 336 bp, Homo sapiens
ctagattatcaaactcacaaccataaccatcaggagacgcattcttcaaggtcacttccaaagactctaccgtcttgtcgttaaagacgacatcaaatccaagcattttgaaggtaggcaaccattattcatcagaccctactgctcacaaacaactttgcagcccattgagactttgacaaatcatgccccacgaggtgagacccaacagcatcaagctgctgcaatttaaccatcactgttactccagaccttcaaaccacagacatatcaacgtaggccacatgtaagcagtcagtacctggcatgccaactgtccccagaagacagtactac

SEQ ID NO: 551879 - DNA, 410 bp, Homo sapiens
acaccatgatgtctaattatattgctttcacttgtggcaactgaagtacatccctatatcatacatggatacttgggttacagatctgcttgtacacttcagacagggcatcatttctagcctttatagaatatacatgcttcccacgtttcagagaataaggcttattttcttcaatcttgcacaatctttgcattcttgttttctaaattatttttttactatcgaatggtcttgggcatttattattccttcctttccacatctgctgtgcatcgtcccccgatgtttaagactttgatttttcttggaaagccttggttgaacatatattcctgggctggtgttaatcttcttggacgaatcaaatgagcctcatgtatgtcataatgcttattaaaaatgtgtcg

SEQ ID NO: 551880 - DNA, 724 bp, Homo sapiens
ggtgcgggtgcctgggaatttgctgaggaggtgatcgtaggaagcttcagaaggacctgtagggtctgatccaggcggcatgaggagaaggtggcctggctacgacaagctggagaagatcaagatgcggatgcacgacaggagcgtggagcgacctgctggtggacctggaacacctatgcgctcatgagcagcgtgctaactcgtggatgcatagaagcgataacgaatgtttgaccagctcctggcgcgaggagaagaccatctctggcaattatgcagaggagctgtgacctgtggctgaggcggaggtcctgagtagaaggagaccaaggggtctgtcgctgggccgggccctgtggatgaacgctcatggtcgccagaaaggcgcgatgtggatcggctcaacaatgcagttccgctcgtgcggatggtggaccttatgagctccaaggatgatgtgggcatcgagtgtcctaggagactgtgagacagtccacatgcgggtcctagaagtcagcacgtggaggagatgaaagacgcagctggaagagttggcggatgaccgtgtaggtccaccgaagaatgctcattgcatgcaggttgccagggctcaacgctggatcgtgcctgtaacgggccagcttctacgcggagatctgccttggtcgcgaagagttgagcgtcgagatgaacgaactctgatgcggtcaagaaccatgtg

SEQ ID NO: 551881 - DNA, 459 bp, Homo sapiens
ctacccccattaccacagtcttgactaatatagttatgtaagccttgaaattgaggagaataattcctcttatttgtctttttttcaaaattgttccagctattctgattcctttgacttgccattataaatttgagaatggtctttgctatctcttaaaaaaaaacttactggaaatttgataggaatgagtctttctcattccaagctagtggagtttctactttttgaacatcctcaaaaaccttgtgggtctcctctgtatttcacagggatttcacaggggacaagagggccctccatagatcttacctgtgcggttctgtttctattcctggcttttgctgagagggttgaggggattcatgagtgacaggcttaaatctcttcaaagagctttctgtgtgaatggatactctcaccttttaattcttccagcatactagcaaaacattgacc

SEQ ID NO: 551882 - DNA, 1012 bp, Homo sapiens
  misc_feature (11)..(11): n is a, c, g, or t
  misc_feature (65)..(66): n is a, c, g, or t
  misc_feature (72)..(72): n is a, c, g, or t
  misc_feature (121)..(121): n is a, c, g, or t
  misc_feature (411)..(411): n is a, c, g, or t
  misc_feature (433)..(433): n is a, c, g, or t
  misc_feature (436)..(436): n is a, c, g, or t
  misc_feature (442)..(442): n is a, c, g, or t
  misc_feature (464)..(464): n is a, c, g, or t
  misc_feature (466)..(467): n is a, c, g, or t
  misc_feature (477)..(477): n is a, c, g, or t
  misc_feature (495)..(495): n is a, c, g, or t
  misc_feature (502)..(502): n is a, c, g, or t
  misc_feature (506)..(506): n is a, c, g, or t
  misc_feature (516)..(516): n is a, c, g, or t
  misc_feature (529)..(529): n is a, c, g, or t
  misc_feature (531)..(531): n is a, c, g, or t
  misc_feature (584)..(584): n is a, c, g, or t
  misc_feature (593)..(593): n is a, c, g, or t
  misc_feature (617)..(617): n is a, c, g, or t
  misc_feature (665)..(665): n is a, c, g, or t
  misc_feature (776)..(776): n is a, c, g, or t
  misc_feature (936)..(940): n is a, c, g, or t
  misc_feature (944)..(945): n is a, c, g, or t
  misc_feature (947)..(948): n is a, c, g, or t
  misc_feature (953)..(953): n is a, c, g, or t
  misc_feature (956)..(957): n is a, c, g, or t
  misc_feature (959)..(959): n is a, c, g, or t
  misc_feature (961)..(961): n is a, c, g, or t
tttctgttcanaagttatagtgacattgctcttgcgtaaaaaatgcctgcttcccaatactttgnntgcatntaagacattcttaacagggcggcagtctagtgttgaaagttttattttnccatttttcttttaagtaaattttttttaaaaaattctgatttagggctaggtgtggtggctcaggcctgtaatcctggcactttgggaggccaaggtgggaagatcgcttgaggccaagagttcaagaccagcctgggcaacatagcgagacccctatctgtattaaaaaaaaatctgatttaattcttttatttatcataaggggtttaattcctgaagtaaaggtttgcacctattaaacttaaaactgccaaatgatttttgttcttttatgtgcgtgataaaaanacaaagaatggtgtggccaccnccnccctcncaagctagggcagcaggtagcncnncccagccccngagcccagcccccccccnagtggtnccgnacaaaaaacnacatggccctccncnccctgggggtggaaagggagggatgaattggggtgatagaaccctggtgaatncagagtaanctttctttagaaaactggtgtttnctaaagaaacaggataggagtttagagaaggcaccaaagctttcactntggtttggcaccagtttctaaccatctgttttttctaccctagctatcttttattggtaaaatataaatgtataattatgtttgtagagctttaccaaggagtttccctcnttttttgtttgttgattagcaaatttttgattctccattttccaaaagtaagagactccagcatggccttctgtttgcccgcgcagtaaagtaacttccatataaaatggtatttgaaagtgagagttcatgacgacagaccgttttccatttcatctgnnnnncatnngnngaccnacnncngngcgggcccggtctgtttatagatgtgtataataaatcgggggattagcttc

SEQ ID NO: 551883 - DNA, 1090 bp, Homo sapiens
  misc_feature (11)..(11): n is a, c, g, or t
  misc_feature (65)..(66): n is a, c, g, or t
  misc_feature (72)..(72): n is a, c, g, or t
  misc_feature (121)..(121): n is a, c, g, or t
  misc_feature (662)..(662): n is a, c, g, or t
  misc_feature (671)..(671): n is a, c, g, or t
  misc_feature (695)..(695): n is a, c, g, or t
  misc_feature (743)..(743): n is a, c, g, or t
  misc_feature (854)..(854): n is a, c, g, or t
  misc_feature (1014)..(1018): n is a, c, g, or t
  misc_feature (1022)..(1023): n is a, c, g, or t
  misc_feature (1025)..(1026): n is a, c, g, or t
  misc_feature (1031)..(1031): n is a, c, g, or t
  misc_feature (1034)..(1035): n is a, c, g, or t
  misc_feature (1037)..(1037): n is a, c, g, or t
  misc_feature (1039)..(1039): n is a, c, g, or t
tttctgttcanaagttatagtgacattgctcttgcgtaaaaaatgcctgcttcccaatactttgnntgcatntaagacattcttaacagggcggcagtctagtgttgaaagttttattttnccatttttcttttaagtaaattttttttaaaaaattctgatttagggctaggtgtggtggctcaggcctgtaatcctggcactttgggaggccaaggtgggaagatcgcttgaggccaagagttcaagaccagcctgggcaacatagcgagacccctatctgtattaaaaaaaaatctgatttaattcttttatttatcataaggggtttaattcctgaagtaaaggtttgcaccgtaattaagagcttcaagagatctgccctaatagtggaattcttgttcgtctcctttgatactggtgtcgtagattacaagaagtagcacaaggacaatggtgtggaccagcctcactgcccttgtacaacgctacgggcacgacagagtagctacgtttcccaagcctccatgagccacatgcaccctttaccccaatgtgagtgtacctggatcaatagcaatctatcactggccctctatcagatgtctttgcgggagtaggaaagggagggatgaattggggtgatagaaccctggtgaatncagagtaanctttctttagaaaactggtgtttnctaaagaaacaggataggagtttagagaaggcaccaaagctttcactntggtttggcaccagtttctaaccatctgttttttctaccctagctatcttttattggtaaaatataaatgtataattatgtttgtagagctttaccaaggagtttccctcnttttttgtttgttgattagcaaatttttgattctccattttccaaaagtaagagactccagcatggccttctgtttgcccgcgcagtaaagtaacttccatataaaatggtatttgaaagtgagagttcatgacgacagaccgttttccatttcatctgnnnnncatnngnngaccnacnncngngcgggcccggtctgtttatagatgtgtataataaatcgggggattagcttc

SEQ ID NO: 551884 - DNA, 121 bp, Homo sapiens
aatgatgcgccatcggccgccacatatcccaccttataagtcccccaacttgagatgtatgaaggctataggtctccctgggagtgggtggaggcagccaagggctatacctgtacactga

SEQ ID NO: 551885 - DNA, 112 bp, Homo sapiens
taattaaaataagtgctggtcaacctaaataactaagcaaacatgaaccaattgtgttatgaaatcaaattacttatatttatattttgtattattttaatagcttattttt

SEQ ID NO: 551886 - DNA, 135 bp, Homo sapiens
ggccgcactcttcaggtggttgtgtctagtgtcttgaatccccatcatggtccatctcgcataaacgccatgatttaaagcctacataggcttatttacaagacctttcagcttctaggaatcattcatcctcag

SEQ ID NO: 551887 - DNA, 124 bp, Homo sapiens
aaattccataagatattactatatcttcagttacaggacaaaataccacagaaaggagtgtactttgcaagaaatgtagttcatcttaaggtttccaaatactttatgaaggctaatgcagcag

SEQ ID NO: 551888 - DNA, 321 bp, Homo sapiens
tttttggggcccccttttcaaaaacaattataaccccgggtcccctctttttagggcctggatttgcttatagagccggaagaataaagccccccacttttccctagcccggctaatcatggaagggggtcccggcttcaaggaacttgagttttaattttttttttttcttggcagagtaatgtaaaatttaaatggggaaagatatttaatatttaaaactaagctttaaaaagaaccccgctatccttgctatgttttttgatgcaaagactatgatgttaataaaagaaaggacagaaaacccttggccttcaaaga

SEQ ID NO: 551889 - DNA, 513 bp, Homo sapiens
gagtggtgtcacttctctaaaaagggggtggaaggtatagacttcaaacatccatctctgctatatctttctctcctgggttagcttatagaccaagctgccatgttaacagggccatggtaacaaggagctgaggatggctcatggtagtagtatgatgaatcttataactgaacctcacaagaattaagtaaaatcaattgactcccaacttaaatataatttggagctccttatcttactaagtgaattggccaaggaaaattagctccacccaatgttcaatcactttgtcatcctttcttacaagactgttaggtatgatgggtttctcttcaaagtttaacttccttgttctttgttcttaaggtcaacttcctcataccttcccactcctaattacccattctgtaaacatttctcccaccaatcccaacctgtaacccgcatttgttccttatctggaaaagtctccctcgctcgtggcaactgctcttcccactcccgtaccag

SEQ ID NO: 551890 - DNA, 196 bp, Homo sapiens
ccttagtgcaatgtggacatagtggtagatgccattgtgagaactattgtttcagctgggcatggtggctcactcctgtaatccccacactttaggaggctgacgtgggcggatcacgaggtcaggaaatcgaggccatactggctaacacagtaaaaccccatctctactaaaaaatacaaaaaaaactagccag

SEQ ID NO: 551891 - DNA, 192 bp, Homo sapiens
atgacaatgtcgacatctgcaacctcagtgagtaagctcagtgcctgccatgtcccaagacaagtccttgttggatggggagggcccccagtgcagtagggggccaagacgtggccttcagcctgaagcttcctcccagtgaaaggggcctggccgcgcccaggacaggacgggcaaacaggatggactcag

SEQ ID NO: 551892 - DNA, 653 bp, Homo sapiens
aagcaggctggtacgcccccgcgttatgggatattggctatcggtatgtggtggagtgctactcttcaggaggaaggcctgctcggtggcctagcttgctggtgtcggtgaccagcaagggaccttgtgacgtgcatgaggaaagtggaggaagggcagcctggagccaagagcatcttcgtagcatgatggagactggcagagcgatgtgggcaaggtactgcatgcctccttgcagagctgttctgcacaagggagagaacagcctggggcccaagagacagaaagttggattccatggtgatgatttgcacatcaagctgctcaactgtggattgtttttgttacttttccttttaaatccggttcgtagtgtgtttgctctgtcagcatgtgacgaatttacagcagcatttggtactatgtaaaagttaagaggcctagttgtaccctggggtcaacagaaataccccagaaagtacatactgaactgaataccagaaagacaagttcaccagcagaaagagaactgcactatcaaaacaccacaataagatggtcacagtaaccataaaccaagaaggaagatatcaatgcctgccagaaaggaaggcccaatgaaatgaatgaacaatcagccggaaggaagccct

SEQ ID NO: 551893 - DNA, 438 bp, Homo sapiens
  misc_feature (57)..(57): n is a, c, g, or t
cagctgaaggaggcagcacattgctgaggattcagaccgcaaatatgaagaggtggncaggaagctggtgatcctggagagagagctggagcgctcggaggagagggctgagggtggccgagagccgagcccagacagcgtggaggaggaacttctgaaccatggaccaggccctcaagtgtcctgattggctcagaggaggagtattccaccaaatgaagataaatatgaagaggagatcaaacttgttggaggagaagctgaaggaggctgagacccgagcagagtttgccgagaggtctgtggcaaagttggagaaaaccatcgatgacctagaagagacctttggcagtgccaaggaggagaacgtcgagattcaccagagcttggaccagaccctgctggaactcaacaacctgtgagggccaagcccaaccc

SEQ ID NO: 551894 - DNA, 779 bp, Homo sapiens
  misc_feature (46)..(46): n is a, c, g, or t
  misc_feature (137)..(137): n is a, c, g, or t
gggtgtctccttcacttcgccctccagctgctggatgctggagccncgaacgcgatgcgtcgcaatgcgtgttcagcagctagcggagcggtggcgggggccccctcaggaaaccacagattccctcttcccgcggnctcgccatggcgaccacggacagacttggcgcgtcaatgtgtattcctccatcatatgctgacttggcaaagctgcagagatattttcaacaaaggatttggtttgggttggtgaaactggatgtgaaaaccaaagtcttgcagtggcgtggaattttcaacgtccggttcatctaatacagacactggtaaagttactgggacttggagaccaaatacaagtggtgtgagtatggtctgactttcacagagaaagtggaacacgtgataacactctgggaaccagaaaattcgcggaaattttgcaaagcacccaagattttgtccaaggtttgaaactgacatttgatactaccttctcacaaaacaggaaagaaaagtggtaaaatcaagtcttcttacaagagggagtgtattaaacttggtctgttggatgtttgaacttttggattttttggtgtggaaccttgggaatgccagtgggtttcaaggctgtgctaagggataatgaggggcttggctttggttgggtaaccaaaatgaccttttggacagtggggcaaaatcgagaggttgacaagggaattaacttttgcagtgggctaaaggactggggaattccaggtacacataatgtcatga

SEQ ID NO: 551895 - DNA, 438 bp, Homo sapiens
gaattccggttctctggaagagaagtgctgtaacggctcaggaggtgctggagggcttcaacatggccatcggttgctggcgtcctctagtcatgactgggacgatgctgaggaggaggagagggagaataggaagaacaggcagcagaggaagaggcggaggaagatgaggaagaggaggaagaagaggaggaggaggaggaagaagagcctcagcagcgagggcagggagagaagtcagccacgccctcacggaagattctggaccctaacactggggagccagctcccgtgctgtcctccccacctcctgcagacgtctccaccttcctggcttttccctctccagagaagctgctgcgcctagggcccaagagctccgtgctgatagcccagcagactgacacgtctgaccccgagaaggtggtctctgccttc

SEQ ID NO: 551896 - DNA, 345 bp, Homo sapiens
tgtcccgaggactttaacccaaataaccctcactaaagctatactctttcaaatctatttgtattagtcgacacaagagtttacagcaaatgcaaactatacctatgtaggtacatgacacttgtctcactcgaaaataactgaaacagaactcaaagaattctcatatgggaaaattctacatctaaggccgggcacggtggctcacacctgtaatcccagcactttgggaggcttaggcggcagaatggcatgaacctgggagttggagcttggagtggagccaaggacgcaccacggaactccagcttggcagcctgggcaacaagagcgagactccgtctc

SEQ ID NO: 551897 - DNA, 183 bp, Homo sapiens
  misc_feature (24)..(24): n is a, c, g, or t
  misc_feature (120)..(120): n is a, c, g, or t
  misc_feature (123)..(124): n is a, c, g, or t
gctcggacgatcatcctggggacngtacatggtagtaacctattgatggcaattttgctgactgtggaagctgactcatccaaactccatgccagctgtcaacattcacgtatgaagtcntcnngtaattactattcgtccgaggggtaccgatgcctcgaagttctgtaactctgtggctca

SEQ ID NO: 551898 - DNA, 346 bp, Homo sapiens
agaagcagagacctattagcagatgctaaaatggggaagcaagagtcagcaggaaaacaacagctacagaaaggagaaacagtggaaaacaggagaagcagaggccatgaacagatgctgaaagaagggggaagtagggcagagacagcaaaagtgaaaacagcagcagcaaagagcagcaccggaaacacggacgacacgcagacgaccaaattacgcagatgctaaaactggggaacgcaagacgtcagcaggaaaaaacacagctacagacaccggagacaccatacggaccacaaggcgaacgcagacggccactgcctatttctggcggagagcaggggta

SEQ ID NO: 551899 - DNA, 219 bp, Homo sapiens
ctgcaggcggccgcaatagtgattaattcgcggccgcgtcgaccatgtcgcacttgttgaggaagacgatgatgtagggcacacccacctgacgcgccagcaggatgtgctcgcgggtttgcggcatggggccgtcggcggccgacacgaccaggatggcgccgtccatctgggcggcacccgtgatcatgttcttgacgtagtcagcgtggccgggca

SEQ ID NO: 551900 - DNA, 421 bp, Homo sapiens
  misc_feature (79)..(79): n is a, c, g, or t
  misc_feature (133)..(133): n is a, c, g, or t
  misc_feature (159)..(159): n is a, c, g, or t
ataagttaaggaataaaaaagaagccatggtgtccattaacgccccatttcccgccatggttgggtaataatgcctccnccgtaaaagatccaattccctagggggtaccccatgaacgatcaacccgaacgncccctatccgcctggaaggtcttgancttgaagatggttggacagtaggtaagagaattgtcacaggttcagagggcggcggttcaggtggtttcttttcggtatcctatgaggttcgtaggaatggtcaagaagcattcttaaaagcatttgatattgttaaagcacttcaaatagcagcacaacaaggtaaaacgctaatagcgcgctgcaagaacaggctcaagctttcaactttgagactgcactgcacgatttgtgcttgggcgccaaaatgagaccgtgttg

SEQ ID NO: 551901 - DNA, 449 bp, Homo sapiens
  misc_feature (69)..(69): n is a, c, g, or t
  misc_feature (446)..(446): n is a, c, g, or t
cactaggggaacagggccctgaacttcagcctggagggaaacctgcggggcagccggcactctggaggnacagacaggccacccggtgcagacaggagagggaggcagggggacagaacggaagacacctggggtggatggaaggtcagtgcccttgggcactggtatctgtcttccctgccacagctagatcaggcttctcaaccagttggctgtcagggccagagtgtactccgtaggcgccatggcagtccccatgaaatccaccaggtgtcaccaggcagcatacaggtaacaggcctggaaggtccccaacagcccagctggacatgctgagacactctggggctcctcattcagtgggacaaactgcaggacccagtgagggaaatgggaacataccaggccgagcagtatggctaaatccatttattccaaaatcaaangca

SEQ ID NO: 551902 - DNA, 453 bp, Homo sapiens
  misc_feature (2)..(2): n is a, c, g, or t
  misc_feature (74)..(75): n is a, c, g, or t
  misc_feature (349)..(349): n is a, c, g, or t
  misc_feature (401)..(401): n is a, c, g, or t
  misc_feature (451)..(451): n is a, c, g, or t
angtttacattagggttcattcactcttcgtgttgtacattctatgggttttgacaaatgtcataacatgtatnnataattatagaaatatgtagaagagttttattgctctaaaattcctctgtgctccatccattcatccctttcttctcccagtctcttgaaaccactgctactgttacggtctccatggttttgccttttccagaatgtcatatagttggaatcataccgtagaagccttttcagattggcttttttcgcttagtaatatgcattttaggtttctccatagcttttcatggctaaaataagctcaatttccttttaggtgctaatattccattgncctggatgtaccataagcttatttatctgcttatttacttgatggcatcctnggttgcttccaatattttgcagttattaataaaagctggctataaacagnaa

SEQ ID NO: 551903 - DNA, 559 bp, Homo sapiens
atcgatagcaccaaatgaagaatgggatcaaggggagacattaccttcccaaatggacatacagtagttaaaatgatttcggcaatgataataattagataattagattgtgactctgtaggcaagagacagaaaccggtctcagctaagtatattgggtagtgaaatgcgcttagttgtaaagggagtgtgttctcagcagttatatttcaaatgggttgaaaaaaattactggaataaaattgtgcatcggatgggtaaagttaagccagcaaaagggattgacctggggctccatgaaagccggcagtcctaagtcgtattctcaatcccagcatcaccattgtgcctccatcaacagattttaatgcaagccaatgcgtttagagtacaattccgtggtgaataacctttaaggttacatttgccttttccctgcttcttgcaaacagtgcgtaatccacaagcagatgggttggctgtagaggtgtacaacagccatttgtgccaggacagtgcggagagggaatatgagatctgtgtgctaatgagctgacgc

SEQ ID NO: 551904 - DNA, 709 bp, Homo sapiens
tttatgactctagatcaccaacttggtgtccatgaccatgcattccaggaatgggagcatctgtgacattcaatattggtggcctggtatgcccctatgagaggcttcatatataattattattaatctaatgaggaaatatcactgaaatctgtacttgacctgtgtaccaccaaatcaataattatgtcatgtgaacatgtgttagcttcattactgtaaaacacttgctttcctttcccaggtctgtttagtgtttatatatatccagagaaatatgataactttgaagatgcccagacactctagtttcaattagcaaacatactagctatttattactttaattagggctgaaataggaagccagtgtctcaaccatagtattgtctctttaagtcttttaaatatcactgatgtgtaaaaaggtcattatatccattctgtttttaaaatttaaaatatattgacttattgcccttcataggacaaagtaatatatgtgttggaattttaaaattgtgttgtcattggtaaatctgtcactgactatagcgaggtataaaagtacgcagttttcatgtccttgccttaaagagctctctagtctaacggtctagtagtaagagatctaaatgacatttatcatgttttcctgcagcaggtgctagtcaatcccaaaattcacgctgtccataataggtgctac

SEQ ID NO: 551905 - DNA, 118 bp, Homo sapiens
  misc_feature (58)..(58): n is a, c, g, or t
  misc_feature (90)..(90): n is a, c, g, or t
gcaaagactgtctcttttcacatattaaaaagaaaaataactaaaatctcacgtagtntaatcagctggctttctttggctttagtcatntcttagctgcttaaaagtttgtttcaag

SEQ ID NO: 551906 - DNA, 100 bp, Homo sapiens
actcccctcctgagctctctggtatgacatctctgtctctctctctgctctcaagctgtgtctactcatttgaacaaattgaattattagaggaaaatat

SEQ ID NO: 551907 - DNA, 339 bp, Homo sapiens
gtacccttctctaaacgtcaggcctggacttaaaagattttttaatacctccttcagtagtccaggggcggtcgtcacgcctgtaatcccagcactttgggaggccgaggcaggcggatcacaaggtcaacgagatcgagaccatcctggcctacatggtgaaaccctgtctgtaccataaatacaaaaatttattgggcttggtggtggacacactgtattccctgctactagggaggctgcggcaggagaattgcattgaactgggcggcggagatagattaagcctctactctacaacatgtgactgtacttgaaaaagtactcagtaataatttt

SEQ ID NO: 551908 - DNA, 516 bp, Homo sapiens
ttctttgattgagacagagtcttgatctgtcgccaggctggagtacaatggtgcgatctcagctcactgcaacctctgcctcctgggttcaagcaattctcatgcctcagcctcccgagtagctgggactacaggtgcatgccaccccgcctggctcattttttgttttagcagacacagggtttcactacgttggccaggctggtctcaaactcctgaccttgtgatccattcgcctcggcctcccaaagtgctgggattacaggtgtgagccaccgcgcccggcccaattttttgtattttcagtaggcagggtttcaccatgttagcgaggatggtctcaagctcctgaccttgtgatctgcccgcctcactctcccaaagtgctgggattacaggcgtgatccattgcacctggcctactgttggtgttttacacatttttttccagaattccactgttggacatgtgtcttaaggatatgtgaaaatgaatgcagagaaaagatgtttacc

SEQ ID NO: 551909 - DNA, 684 bp, Homo sapiens
  misc_feature (633)..(633): n is a, c, g, or t
  misc_feature (643)..(643): n is a, c, g, or t
agagttagagagagagatagagagagagtgagagagcgagagagagatctgttagagcagatgaatgacaaataaattaggggttgctattttcatgtcagataaaacagactgtaaaccaataatgatcaaaaagaacatatgatggcattacacaattataaaatattcaatccaacagaaagacttaactattctaaatatatatgcacccatcatccaagtacacgtatacataaaactggtttttcaagatctattaagagatttagataaccacacaataacattgggggacttgaaaaccccactgatggtattaggaagatcattgaagcataaaactaaccatgatattcaggacttaaatttgacacttgaccaattggacctaatagacgtctacagaacactccacacaatagaatatacattcttcatatatgcacacagcatatactataagattgaccaaatgctccaccataaagcaagtttcaacacattcatagaaattgaaatcatatgaactatattctcagtccacagtgcaatatagaaatcaatgccaagaatatctatcataaccatacaattgcatggtaacccgacaacttttcctgaatgactttngggttaagantgacacttaggcatacattaacaccatgaagcttgccagcc

SEQ ID NO: 551910 - DNA, 427 bp, Homo sapiens
ggaggctagattgtttcctggtactgtcactgccactggggctttgatttggaggaatggggcaggggactatctaagcgcttccatcctaaagccataatgaaaatatcttcctctcttccccaatcctatacaaaatactaagtggtttctttgctccacttcctaccccttagttaaataggggtggatcacccagccccatgccttttttatttataggtttttaaattatagactgcataacccagaggtttgatagttttaggacagacataggtaaaactagggtaaaggagaggaggctctttttaaagcagccggccgcctataaataacctggggaaaccaaagattttgcaataggggatcatccacacatactactcagagaggcagataaattccccctcctcggcaacagcac

SEQ ID NO: 551911 - DNA, 921 bp, Homo sapiens
gggtacagaatgaggtgcggacgtgctgtaggccggaatgtaaccgggtgtggcctctgtggatgaggacgaggatccgtgccggaaggaggatggtcctagaatgggttcccgatgtagagtacggacgcaaacggcgaggggagagtagcgacaaatgtcatggcctcgtgggctcgagattcccactccacaataaatcaaccggggtatttgagggtgctgggaagatacgaccaatttcggaagtatatttttgacgacgaggacaacctagatacataggagtaagccgggtgcataggtaagagtgaagtctcgtggggcaagggaagatgctgctgtacgaaaaatccgatacgcctagatcaggacgtaagggtagagacgatgctccgtagtgaaaagacgtagtgctggcaagttgaggaaaagacgaggttggcgctctggcaaggccccacggggaaggttgacagagaagctgttgtctatagtttgttgtaccatcgggtttggtaagaagaattgtccatgggatcattgtatctcccaggcatttcatctcttaccgtatgaagttccacttatcctagaatgttacacaagtgaggcttcactcgaatgtacatccggtcatagcaacctatcgcggtattaggaccgcactacaactgaggagaagcaaccacagtttgtggacctgcttcggatcctcgaaaagatgtgaaaccggacgaaggggagggcaccgacccatgcgtggtatggcgacagtggctgcacccaggatgtccaggaaagcaggcaggcacagacgtggaaacctcggcaagagaaagcccggggcccgagggtccaacagtcgagggactcggggcacacgggcaattgccgggcaagcagcaatcatcccgggcc

SEQ ID NO: 551912 - DNA, 255 bp, Homo sapiens
ttcgtgcctcatagtgtaggaccgtctcgtgactccaaaatcaggtatgaatctggggaccaggtggctgtgtacccagccaacgactctggtctcgttaaccagctgggcgaaatcctgggtggcgacctggacgtcatcatgtgtcgtgaacaatcttggatgaggagtcctaatcaagaagcagctcattcaccgtggcctacgttcctacacgcacggtcctcaccttactaactgaacacgagtgtacat

SEQ ID NO: 551913 - DNA, 134 bp, Homo sapiens
  misc_feature (62)..(63): n is a, c, g, or t
  misc_feature (71)..(71): n is a, c, g, or t
gtgatttagaggatcccgcatttgcgtccatcagctagccggatggtgactttgaagagatnnattggacngaggaaaaggagtatgagtttgatggctttgaagaagtggccctgcctgatgggagcaagatg

SEQ ID NO: 551914 - DNA, 298 bp, Homo sapiens
atcccaggaagccgcgtctggttgtttctgagccagggaggggagtcatgtgtgtgctgggcattgggcccgattgtgatggggcccgaggtggtgccgctggctgcctggtgcagggcccaggagtcacttgacttgtgccagtggcagccgactgcctggcctcgggaggcagcttctggcctggacttggagctggagagagcaggcagggtcctcgactcgggaacagaccgggacacggtgcctgggttggacatggcattgggtgttcacaatgctgccttgggtggctccc

SEQ ID NO: 551915 - DNA, 864 bp, Homo sapiens
  misc_feature (624)..(624): n is a, c, g, or t
atcatgagcatcatcacaaacatggacatcagcaccttgggagcagtgagctttcagaagaatcagacaaccaatggagcaccgaaatgctcctactcatcctgctcctccaggccttcatcaccagcataagcacaagggtcagcataggcagggtcatcgccagcagaacacgatgaatatgcctagtcgaagtgatagatgttactatgatgtgacaaaagaatgctctgtcgaaagagatgtataaatcaattactctgtagaattgtcccacagggttcagacgatgggctcctaggagctgatgctgccaatggtcgacattcgtgactactttgaaaacatacatgggtctgcagatcctcctgatctacgctgtaacacgaacacaacctctccattctgtactgttaggctgagcagggaacgttcggggcagaccgatgatagcattaagctggaagtctttgatcacgagatcgtttgccgtccaggctgtcctgagcaaaactaaagtcatggcagtcgtttataatccgcacgagaaagccaggtgccaggttttgactgctcgaagggaatcatggcataaataagtggagaatggatcttcaggacctnaaaggtatttgagagactagaaccaattagtccgcaatatgaagtctagacacacatttcattttcccatgcattttctattcaaactaccaaaactttacgatgaacgccaagaaaagtagaagccttagcattttgttgcaaaacccctgggggaggaagaatctaactgaacttggggtttccaggatttttaacattttttatggtcccttagaaaattttgactcaaaacccata

SEQ ID NO: 551916 - DNA, 411 bp, Homo sapiens
ccagcctggggaggcccacgctgtgaccaaccgggttgggggccagcgcaggtaacgtgagctgccccgtgagccagaccggaggcctggggtgcccagatcgatcatgcactgtcctcatgccacggctttggtggggttggtctaagccgcacggcaagtttttgtaaagattgaggactctcagtctggggcgtcccgccgcagcctttccaagcctgcgtccagcgagcgtcacagcacaacctgcaaaacggagctgggtgcagtggggctggcatggactttcatttcagagattcggtttttaagaagatgcagctaatgtgttcttttttttttccaatgatttgtaataacattttatgactggaaacttttttgtcaacactccaataaacattttgattt

SEQ ID NO: 551917 - DNA, 177 bp, Homo sapiens
  misc_feature (53)..(53): n is a, c, g, or t
atgaccgcaccactgcactccagcctgagcaacagagccagaccctgtctcanaaaaaaaaaaaaaaaaaaaaaaaattttttttttggcccaaacccggggcccccccctttaaaccccacctttttggggggtaaaaaaaaaaggcccctttgcccccggggtttaaaacccccg

SEQ ID NO: 551918 - DNA, 265 bp, Homo sapiens
tagagttacgcgggtgggtctgctggcttcactcactgtgctgtttcctttgagtggccgcttgggagctccgggcatgtgaaggagctgcaacatgagaactaatgaaccaaggcggctgccaccatggagggaacagaacgcaggctacaaccatgacgtctgcacagtgttagtacatgtcattgtggtttcgttctcactgtggttacaatttatttcctggagacacttaaaaacagtgtttgcatacccgctaaactcg

SEQ ID NO: 551919 - DNA, 433 bp, Homo sapiens
gctcgacctagaaatcgacaactgcacccgcctggggtatgacgcggtgattgtaggctagaacgataccgccttgcctgactgttcccatcacgaccttgagcatgcaaaaaacccggcgctggccaggacagcgtctacgcttcaggacggtgcacagcagacccggatcggcggcctacgcagcccgtccaacgcgacaggcacttcacttaacacagctgaaggataaggatctatggacgtatttctcggcagtatccagatgttcggcttcaacttcgcccctaacggttgggcgctctgcaacggccagttgctcaatatccagcagtacaatgcgttgttcgccttgttgggaacgacctacggtggcaatggcagcagagcttcggcctgcccaacctgcaaagccgcctgcccattgcccagg

SEQ ID NO: 551920 - DNA, 154 bp, Homo sapiens
acaaggaggcacagagaggtggattgagtggtataaggtcacgaaggtaatcggtgacagcttggcttgtgattttttttttaaaactactctccttcctgtgtaaaaaagaaacagcgtgacctcgtgttagcttctcgcttttcaaggccac

SEQ ID NO: 551921 - DNA, 372 bp, Homo sapiens
tacagctctacatgcactggccgtcgtgtacactaacatgcgtataccatgcactggccgttcgttgtccactaacaggctataaccatgcactggccgtcgattaccactaaccagtctatatccatgcatcagtccggcgctgtacactaacagctatccccctgcactaggccggcgttatccacaaggagccttaacgatgcattggctgtcggtctactcttatccgcaatggcctactgcaattggcgacccgtttatccagattacaattaatcagagtgagtctgacttagtcagtgatctacaccattactcaattcttagaaattagaaattgctgtagctgtcttcactataacttaacac

SEQ ID NO: 551922 - DNA, 897 bp, Homo sapiens
  misc_feature (828)..(828): n is a, c, g, or t
tctcgaggtttcttttttattttttttcccaaaaaatggatatttttttttattcaagaaagtgcaaataggaaaccaaaaagggacccccagtgctgggacaatatcatggttcacccctccccaacagaaacgagggggagagaggtgggccccttacaccctttatatgagtcagatccgtggcgccccctttgctcactcttgctgaagacatccaattgtgggacagggccccaccttctccctgtgtgacatgggggctacgtcggagacacccgagccttgcacagtgccacaagccctatctttcccaacaaaagagatatcatagcgtggtgcagcaggagactcatgggatgcccaagaacaccgtggacgagctaatcgagaagtgatagaacctctttcggtggctcgcttgtctaaaaccaaacgaacgacaattagaacagggatttgtccacacaacaactgggggaaccttttgagacaaaccaaaaaaaaccaaaaaacaacattgtgtccacacagaaaggcgtacgtctctggtgaggaaccaaagatagagaaaacatctatgtgggaacccacaataaaacacattgcgagtgagagcgcaagaagaaaggagaaagcaacagtgaacggcgtagtgataataacagtaacaaacaaggagcaaagaggagagaaagaagccataccttactggatataattggttggtcggcccaccaactactagacataggcacgcgcggctacaaaaccactcggtcatcgaatcttgcgcgagtacacagacaaaagtgtagagtgttatcnagggtgtcgactaagcaccacaaagccacacataatcagagttgtggttgccgcgcaccacacaggtgg

SEQ ID NO: 551923 - DNA, 582 bp, Homo sapiens
gagaatgacagcctagcaggtgcagctcagagaggttctgagacggccatgaatgatgaggttgcggcctttgtgaacaaaggtaagcagcatgagtaatcacgatgcccttccttgatctgccgccgaaaatacaagagcgcgttgtttgctcgattacggctgccgtcaagtacgaagtcccagcaaacattgtattggcagtagccgaacaagagggcggcaagccaggccaatgggtcaggaacacaaatggcacacatgatgtgggaccaatgcagttcaatacggcctatctggtcgagctacgtcaatatgggatcacgccacaagacgtagcacgaggtgggtgctattcctatgatctggctgcgtggcgtttgcgtggtcacttacgtaatgatcaaggtgacatttggacgcgggctgcgaattaccattcgcgtactccgcaatataatgctgtttatcgcacctctctcattaagcgtgccggtaagtgggaaaactggctcgtcgctcgctttcccacgtttgacaccatacaagcgagtaagccgggtatggcagctaatacgacac

SEQ ID NO: 551924 - DNA, 234 bp, Homo sapiens
tctacgacgactcctttacctggccattaatcaaatttgagcgagttgctcatattcatctggcaaatgagaataatccatttccgccacagttgcgccaattcagcagaacgattgacgtgcgcatttggtatattgtcagggggcgtttgatgagcaagcatggttgctcattgccattctgaaacctgaacctcataaactggctcgagataacaaccaaatgcataaatt

SEQ ID NO: 551925 - DNA, 1450 bp, Homo sapiens
cgcggtgatagatcagtctaaatatagtgacgtctgcggacctcgtaatcaaacttgttgtggcattggctcctcctggagaggacaacccccgccattgatgaagcttttaaagggccccttataattgggggaacatcacccacgttgcgttaagacgatatatgggatattatagggccacgcttgtcaaaacacgtaaatggtggcccttttagaagaaacccctgataggcccacaatgtgtccccgtggggcccaactgatgacgcccgggggaagcccccgcgaagtgaacttttttggaaaaaataccacgcgatgaggccttggcccaattttgtgtgggaaaagccccccccccgtttctttcatttagggagggaattgaaaaaggtgacactgttataaaaaaaatgggggttcgcacgatgggtggccaccacaggcgtaatacgaggaacctggcgctttggaacaactagtgtggctctgttaaaatttttcttgggtgtgttcccacataagagtttggcttcccgcacatataatccccgccgagatattttatagggctccccaacaggttttcacaaaagttgtttctccggtaaaaaatttgggcctctttttggaatccccacagagagaatatataggggagagaccccaaattcctttataaagcacacatattttcttttaaagcgcttcgggtaagggagtttgatcacacagagaagatcatatcatggagagttcgaaattgtgagaaaggggggagagaaaatgagaaagattttcgtgtgttttaaatgtgttataaatgtataaaggtagaaaaatgtagagttttccgcgggagaattggtcttgaaatatattgggtgcacaccctatgcgcacgagatagatggtaatttagacgtgtttgtgtgcacaatggtgtatattatattgggccttgagcacactttgttgagaggtatatttctaatggtagtaaaaaataataaataatggtagatattataaaataatagtatatgtggcaataaggagcacgagacttatgggagagtgttttgtgtttatagaggccacgcttataacacttctgagaagtgtttctataatggcactctaaactcttgtgttagaaggtatactgagaatagacttaaataatggtggggaaaccctctttggcgctggttcctctatgggcttacacacaatgtggcacctcgagatcgctgtttcactagtgaagaatatcccaaatggtagcacccacttaacgacggtgtctttgaaataataggcactgtgactcttataatttttctatatattgtgaaaccttggcatagtttcttgttttgttatataaaaaaattgtaaaagtttaatatttgactgaaatttaacgagcgaagatgagcaccca

SEQ ID NO: 551926 - DNA, 468 bp, Homo sapiens
cctactactactaaattcgcggccgcgtcgacgaaatctgcaagtgtgtctttaaaattcaactgcctgggctgggcgtggtggctcacgccagtagtcccagcactttgggaggccgaggcaggcggatcacctgaggtcaggagtttgagaccagcctgaccaacatggaggaaccctgtctctgctagaaatactgaaaattagccaggcgtggtggcggcaacctgtaatctcagctactcaggaggccgaggcaggagaatcgcttgaacccgggaggcggaggttgcagtgagccgagatcatgccattgtattccagcctgggtgacaagagcaaaactctgtttcaaaaaaaaaaaaagtccaagccgccggcaatttagtagtaagaggcgacccgggaattcccgaccggttccttggagcgttccaacttttcctatagggagttcgatttgaaact

SEQ ID NO: 551927 - DNA, 365 bp, Homo sapiens
tctggaggatgaggcagctgctcagtaagacacaaggtaacattgacgactcgctcattggtggaaatgcctacgctgaaggccgcgagggcgaaggtaccgaaagcacagtaaccactggagtcgatattgtcatgaaccatcacctgcaggaaacacgttgcacaaaagaagcctacaagaagtacatcagagagtacatgaaagcaatcaaagggatacttgtagaacagagaccagaaagagtaaaaccttttatgacaggtgctgcagaacaaatcaagcacatccttgctaatatcaaaaactaccagttctttattgttgaaaacatgaatacagatggcatgcttgctctattggac

SEQ ID NO: 551928 - DNA, 392 bp, Homo sapiens
  misc_feature (376)..(376): n is a, c, g, or t
  misc_feature (383)..(383): n is a, c, g, or t
ttaagaaaagaagcctgggcagagcacggtggctcacacctgtaattccagcactatgggagtccgaggcaggtggatcacctgaggtcaggagttcgagaccaccctggccaacacagtgaaaccccgtctctactataaatacaaaaacatcagctgggcgtggtggtgggcgcctgtagtcccagctacttgggaggatgaggcaggagaattgcttgaaccttggtggtggaggctgcagtgagctgagattatgccactgcactccagcctgggcaacagagtgagactctgtctcagaaaaaaaaaagaacctctagtataatgttctaagtacaggggataataagcatccttctctttcattcttaanctttcangggataaat

SEQ ID NO: 551929 - DNA, 251 bp, Homo sapiens
acactgatgatgttcatacctccttccagagaaatctatgttttcctcttgaggtgattcgttgtatgtcaatgttaatggcatggtatagaacatataagatgatcaagatatcattaaatgtcaaaactatgactctgttcagaaaaaaaattgtccaaagacaacatggccaaggagagagcatcttcattgacattgctttcagtatttatttctgtctctggatttgacttctgttctgttactta

SEQ ID NO: 551930 - DNA, 101 bp, Homo sapiens
tggtcgggtgcggggagccgggggccagagaactcaggaggctggagctccagcgtctgttttctagtctccggaagagcactcatcatttctggcccacc

SEQ ID NO: 551931 - DNA, 943 bp, Homo sapiens
  misc_feature (232)..(232): n is a, c, g, or t
  misc_feature (270)..(270): n is a, c, g, or t
  misc_feature (335)..(335): n is a, c, g, or t
  misc_feature (431)..(431): n is a, c, g, or t
  misc_feature (514)..(514): n is a, c, g, or t
aagtagcccctgttaaagatttgtggacctacgttgcaaggattataatatctaagatgaactatatgtatattacatatttatattacatgatcttacgtgccgcatgccattaagcgcgctaccaacacagcatcgatgacaatcccacctaggaccaacgtctagggcaatggccgtagcactagggttgggatcatttgaagtgtccatgcgaaggtttcgtagtaanccatgtcctagggcacaatggctgcgttggtaaatccnaccatcgactgaacttaatgtgagtaccagatgacattaaggccatcaactactgggtggaatgnctgctgaccatgtatagttcgtacagagtctaacgtatgtgcgaagtggtgtgaccgggcattgactatgaaatcgcgcgtagtaagtgtccagangaggttggcagatgacgttcccaagggggctcgacagccaccctggcatctgacgcatggggagtggtatgagtatcgagagnaacgtacctaatcgtgcaagagaatcgagagcagaatatagaaggaaaccaaaaacacacggacactatgtctattggggtgcaacaatcgcgccaactcttcgtaacatacactatataattatctacaaaattgtatgtcctggggggcagtaggtggggcaggaacagccggttaaagtcgtcagcttgactcagagggaggggctgcactttcgggggaagaaacttcggcgttgagaacccatgaggtgagggcgggatggctttcgcccgatggagcatgaagaatctgtggcgcagctgccactttccgcaggtctagggccaatagtacacaaagagtttctgtcgtcgagacactatagggggaaattataattaaaataggtgatacctttatgggtcaatttaaacctataaaaccag

SEQ ID NO: 551932 - DNA, 332 bp, Homo sapiens
tactatctccctacaaatctccttatactagcattcacagacacagaaccaatcatattaatatatcttcatatcgaaaccacacttatccccaccattggatatcatcacccgatgaggcaaacagccagaacgcctgaacgcaggcacatacttcctcatctacaccctagtaggctcccttcaccctacatcatcgcataataatgaatcaacacaaccaccacacagactacttattcgcatcatccctctactatttattaaccaaatcaacaacaaactcttcagctgattccccacactatacatccgaacccctaacaaaaccc

SEQ ID NO: 551933 - DNA, 104 bp, Homo sapiens
acgatgtgcacggatatctatgtgtggtggtgaatgattatccacgtcacgaaataaatataagctacctaattgtgcccctatttggtccttcccatatgcta

SEQ ID NO: 551934 - DNA, 428 bp, Homo sapiens
cccctacatgtatactcaagagaaatgaaaacgtgtccacacaaagacttatatgcaaatatttattgaaaccttattagcaatagccaaaaagtggaaacaacccagatggccatcagataataaatggatgagcaacatgtggtatagccatacaataaaaatattattggtggtaaaacggaaccaagtactgatacatgctagaacacggatggcccttgagaacattatgctacgggaaagaagccagacacaaaaagtcacgcattgtgtgatttcgtttctgtgaaatggccaaaataggcaaatgcatcgagacagaaagtgggtcagtggttgccaggggctagagaggatgggacatttgaaaggcgactaatgagtagtgttcccttgggggtaatgaaaatgctcctaaaattgat

SEQ ID NO: 551935 - DNA, 443 bp, Homo sapiens
  misc_feature (101)..(101): n is a, c, g, or t
taagcatatgggaattatttctatcctactgctcaaggtcatcgccaagatctgattttcaaaatccaaaaaattgcaaccttcaggcataaatgggctanggggccatgtgatgaggaatatgggcagcttttgtgatcttctcatgccgtataggggctgtcctggatatggcagaccctgattataaatcaataggcatttgagtgaggtaaaaagaaagcagttttattagggttatgtactattgtaggtctccccaagtttatgctgcttcccagagggtccacatttttctgtatgcactagaatatgatgaatgacacacacctgagaagttcacattaatggcattgtgctctctgttactgacaccatcaacatcgaaataaagcatgttcttctcttgtcaagaccactgtaaggagtgagactccgtctca

SEQ ID NO: 551936 - DNA, 1172 bp, Homo sapiens
ctgatgttattcacaccttggagagttgcaactgccacatacgaaattagtctcatagtgtagtgaacttcaaccccaaaattttaaaaatgtattccccccagttttaaattgccttcgaaatttaaaacaaaaaatttagcacttagctaccagaatccaaaaatacctagatttgtcggagaacttagttacatacatagaagacatgacatatggtttaccactgtgctgtgtgtaggatgttagaattatctgtcgctccgatcgttgtagggtgctttttcttaacatgtggttctacgttatactgatattgcttaatttccatcttccatgcaacctcagagctgaataaaccccttaaattggctgctggttcgaacaaagtctaaagggtttatccaggggtagtcaacctcgccaaatatctcacaatcgaaatcctctaaagtcacgcaagcattacattctctcgtgcattagaaatatttggcggaagcatcggctacaggacggcagggggattctacacaaactataaacagccaagttcttgcatacttcctaaggtgcatattcagtcaacatttcacagcgggatcgacacgtccacatgtacatctcaattcagccaccaagacttcaggcgcagctcacagcaaaatagcacaggaagtaacactttcacaaactccattacgataggtcgcacactagttgaccccttaggatcacttctgactatttcattgatcatgaccctctctcgtagaaaccacaactggctatgctcgttaacaaagctggaaaggctgaatctacaacacagtcactccacaacttaacgaaagtttactcgcacacagacttgccatttctttaagcacaccgcactatcagcataagacacgcggcgccagcgcgcacatcaaaaattctaccccccatatccgcccctcgacctctgggaacacctcctgccaccgcaacaccttcactgtggcccacctccgcacgcgcactaacgctccaaatcaacagcgtcacaccaactagttggggaagccaacaccagcaacataagcgccacgcccctcataccacgcattatcacgccccgagccgcatccagttttaggacgcacgccccaccacctcccacgctgccc

SEQ ID NO: 551937 - DNA, 1646 bp, Homo sapiens
  misc_feature (244)..(244): n is a, c, g, or t
ccagcgtcagtggcagtgatgtcacgattgagtgctccatctacagtacttgcctggaacgtagcacgaatagctgaacaagatcgtacatatctataacactagcagtctagtatcgcctgggaaccacaggatagtagttcctgatatagtggttacgagagaagtcgcctctccgcgaattctaggactcgctgtgcttcgcttacatagtcgcgagacaatttgagttgactcggaaggnatcattgcgtatgacgatggacctgtgtgtgtggcttggagaattggagtcgggcagcggcgtctgggatgtgggagctcctctaccagttgtgccatacagttggtgatcgccaatttggaggagtcagcaagatcccttggaacgtcatgagtctcactgggtgagtcgagctccattgacgggtcttggaggtgcggaccggcaacaatggaggaaatctcctcataatgacgctatctcttgctgcgtgttgctccgctgaggtgaatcgcatgccgcgcaaacagtggggacgtggaaccgccgcgatttgcctcggcaaggtaaggtttgaccgagcgtgcaggtggtactagagcctagcgaaatggtatagggcaagggcgtccctaagatagcttttgcacatagagatagcaattggcggtggcaagcgccgcgcaaggcgcaccccacattcgcgttccaagtcacattttgcaagaaccacgggtcacataatgccttgtcctgcatctgacagatcgagaccacaagccatagtgtgagccatgtgaaaccccacttgtctgtgaacagaacctggagagaagtgcccccaaggaatttcgaggggtgccataggtcctggagataccttcgggacctagaccccaaccaatttttgcacagaccggtcccgtggattgactgagggtaaaggtaaccctataatcacggttacttggttacttagccacatttggggggtggtgtggcgcggaggtttcacacatagaggagacacagggtacccattagttgggggagggaactacataggcgcccataattgtgacgtttaaaccaaagaaaattctttgtgtggcacacaaagaagtggccccgggttgggaagagtgacgcctcaagggtccttaaggaaggcccacgagaaaccactgggtatcgcccaaagtggctaaggaccggcacttgacatcaaagggagggctaagcctgagcaaaaaggggtacaatgggggggaaaaagccttgaagatggggcggggcgtcacacatcgacaaattgtgtgacaaccttatttacacacgtcaacgtaaagcaccacagtgcgcccccacagccgagcaaaccgggggacaggggggttaaccgagccaccagggctcaccctatcaggaaacaacacgctaagtgcacggggtgggaacaccactggtcacacggcacgacgtccgacacccacacaaaatcactccaacactggatcgcgagaacagctggcggaacacccagcagcggagacgatcagcatcgacaacggatccgatcatcagcagagccacacacgcgacctatcctagccaccgagaaataaacatctctctcctcctc

SEQ ID NO: 551938 - DNA, 791 bp, Homo sapiens
  misc_feature (1)..(1): n is a, c, g, or t
  misc_feature (212)..(212): n is a, c, g, or t
  misc_feature (283)..(283): n is a, c, g, or t
  misc_feature (319)..(319): n is a, c, g, or t
  misc_feature (357)..(357): n is a, c, g, or t
  misc_feature (362)..(362): n is a, c, g, or t
  misc_feature (391)..(391): n is a, c, g, or t
  misc_feature (503)..(503): n is a, c, g, or t
  misc_feature (558)..(558): n is a, c, g, or t
  misc_feature (561)..(561): n is a, c, g, or t
  misc_feature (564)..(564): n is a, c, g, or t
  misc_feature (567)..(567): n is a, c, g, or t
  misc_feature (573)..(573): n is a, c, g, or t
  misc_feature (592)..(592): n is a, c, g, or t
  misc_feature (641)..(641): n is a, c, g, or t
  misc_feature (646)..(646): n is a, c, g, or t
  misc_feature (652)..(652): n is a, c, g, or t
  misc_feature (654)..(654): n is a, c, g, or t
  misc_feature (664)..(664): n is a, c, g, or t
  misc_feature (697)..(697): n is a, c, g, or t
  misc_feature (728)..(728): n is a, c, g, or t
  misc_feature (746)..(746): n is a, c, g, or t
ngctatggttacagataacacacatctcaccctatattccgtgctttccatgcagtcccctaagcagactcagccaccctttccctccagtatcacttcttgtcttcctccttcattgtacttcttgccgtccttggtggcctggagagcgcccaggtgatgcccatagacatttcgaatggcttcattgttgggatccacacctgggaggntctctaggacactctgaagggactcggggtcctgcatcacgtcgtaatcatcctcctccttggctggctcngatgtgtccatagctgagctggcatcaatgtctgcngattccgcctggccaaactctgctccctgcagggacanctgcntggcataagcaatctgctcttcctcagtnatactgcttaggtcaggaagcccagttcggccaaactcttgcaggctgatggtcatcttcacgcagcgcgcatcgctctgagtctctttcaccttcagtcccagtcgtagcnatcccggcctcagcagcagaagccgcagccgcccgccgggcctcctcctcctgcngcnggngcngctctnccatgagaaacacgaaggnccaaggccagcgcaggatcagcactgggatctactccaaattcaaagtnactcngcaccnanacccagcatngcaccaccttcaccagcaaaaatcggagaactnatgagagcctcagccaaactgggcccaggangcactgttaccagatganaaccggttccatctttgccattaaacgtgtttacaaaggctgtaa

SEQ ID NO: 551939 - DNA, 307 bp, Homo sapiens
acggttattgtcattggacgcaaaaatatcgttgacggctaaatacgggggtggcaaagagtttgcgcccgcgttcagtggatacaagcagtataagtaggacaggcgacatctttagtaaataggacaggaaaaggaggacttatcaggatatcacacaaacaatggtacagaacaatgaatcggtttttttcgttggatgcgactcttataaggagagcccttccacttcaccaatacgcttggacgacctggatggaaatgacgatgtgtcggatcagggtttagctttcgacggggacgtagg

SEQ ID NO: 551940 - DNA, 193 bp, Homo sapiens
ggcacatgggtggacacggatctgctgggctctgcttaaacacacattgcagcttcaacttttctctttagtgttctgtttgcaactaatacttacccgagtcaagcatttgtgttcaatttcatttcaggggcttgggctgcctcgtggcgttccccacggtgcctggaggtgggccaaaggggaggtacaa

SEQ ID NO: 551941 - DNA, 386 bp, Homo sapiens
  misc_feature (105)..(105): n is a, c, g, or t
tggttgaactggcttcgtcagcagcgcctggcggtgtgggacgccggctggctgatggtgcacgcgggcgtgctgccgcagtgggacgcggcgcgcaccgtggcnctggccggtgagatcgaggccattctgcgcagccccgacctgggtgacttcctgacgcagatgtacggcaacgagcccgcgcgctgggacgacaccctcacaggcgtgagccgctggcgctgcgtggtcaacgcgctcacgcgcatgcgcttttgcacgcccgaaggcgagatggaatttgccaccaaagaaggtgcggggggggcgccccaaggcttcgtgccttggttcgaggtgcctgctcgtgccacccaaggcacgccggtggcgttcggacgctg

SEQ ID NO: 551942 - DNA, 156 bp, Homo sapiens
  misc_feature (91)..(91): n is a, c, g, or t
  misc_feature (134)..(134): n is a, c, g, or t
  misc_feature (149)..(149): n is a, c, g, or t
atactgacattcttacttcacaataatagttcccacaggctgctggatattggatgcgtggctcgaactgacgcggcattctttggggttntgccatgacctgcatagaaacaggaaggaaaaaagaagtcacnatgagatattcactngaaagat

SEQ ID NO: 551943 - DNA, 109 bp, Homo sapiens
gatttccgtgcatagtcgatctctagaggtatcccaacgatgggtcagtatgacaacaagtgtctttgtcagtaactgttacagtgctctagtacatctattggggctc

SEQ ID NO: 551944 - DNA, 485 bp, Homo sapiens
  misc_feature (63)..(63): n is a, c, g, or t
gggggccaagtatccccgtcccctttggttccaggtggcggggaccttgttcacctgccctgntgagtcccagggtgagcctcagtttccctcccttggggcttaggaaggggtcccccacccccaaatttgggttcacccctggtgggcaaaagggtagggagggggctgtggggatattggggcttcccaatgtaagcctggggattggtccccccttgttgtttaagggaaaggtttccagacccccaagccgggcaggggattttttttaattcccggccccccgcccccccttatcaaaggacccctttttggcaggttttttccccagggggccaaatttcctcaaggacccggggcccatattatttatcccccccgcaaagcccggcttgaacccttcctttgggaagggattggggtcccctttccccctcccccttcctatttccccaggggcccaataagggccaagggtttta

SEQ ID NO: 551945 - DNA, 410 bp, Homo sapiens
  misc_feature (10)..(10): n is a, c, g, or t
cgagacgtancagaatgtggaacactgagcaggacagctgacctgtctccttcacatagtccacgtcaccacaaatcacacaacagaaaggagaggagatattttgggttcaaaaaaagtaaaaagataatgtagctgcatttctttggttattttgagccccaaatatttcctcatctttttgtcgtcgctcatggatggtggtgacatggacttgttgatagaggacaggtcagctgtctttctcagtgatctacattctgaagttgtctgaaaatgtcttcatgattaacttcagcctaaacatatagccgggaacactgcagagacaatgctgtgagtttccaacctcagcccatctgcgggcacgagaaggtctagattcgtccatcaccattatgatatcagga

SEQ ID NO: 551946 - DNA, 149 bp, Homo sapiens
gatcccccccgtgtcccgccataacagtttcagaaaagaggagttggatttttataaaaattcagtgttgctttcagattttcacgttttaatatgtaaaacaacacagagaatttctgtgcccaagccatacagcacatccgtactgg

SEQ ID NO: 551947 - DNA, 458 bp, Homo sapiens
ccattattagaagatgaatcaacagaaccagactcacaaatgacacagatgttggaactatcacagagggacttaaaataattataattactatggggtctggtggggaagggtgggcaacttgcatgaacagatagggaattttggcagagacatggaaactaagagaaagtgaaatggggctggacgtggtggctcatgcctgtaataccagcactttgggaggccaaggcgggaggagcacatgagcacaggagtttgagaccagcctgggcaacatgagacctcatctgtactaaaaatacaaaaattagccaggtgttggtggtgtgtgcctgtagtcccagctactgcacaggctgaggcaggagaatcacttgaacctgggagggtgaggttgcagtgagctgagatggccccactacactccagcctgggcaacagagcatgactgtctc

SEQ ID NO: 551948 - DNA, 818 bp, Homo sapiens
  misc_feature (68)..(68): n is a, c, g, or t
  misc_feature (121)..(121): n is a, c, g, or t
  misc_feature (142)..(143): n is a, c, g, or t
tcccgggagctgcccgttgccctttgccttgtccgtccccggaaaagcttgggacccgggccctcagnattgaccaccgaaattttttttaacaacacgaggctgtggagttaagaggggntgggagtggaggacagcagcnngggccgacgggaccctatatttcgtgcttcccgccttccagacagatgaccatgccgtgtggcgttcacttggaggccagtaggcctctcgctcgcagtttaggaagctgacattcaagcacaggtgcactgtggccctgtgcagctttgtttgaacagggcagcttgcaggggtctccccttcgttgtgtcataccaccctgttttgagagcagcaactttttgtttgaggggcaacgcattgtgatatgaccgcagggtgaggggagactcccgggggcctttgggggttttagaccacaggagaccgggctttgaaaattcccgtgcgcccaccagggggccctccccacatacatgtgacacacgaccaaacagggcttgtgggcttctggggcctcagctatctccctgtgtgtggcccatatattacagacagagagtgaacagaaggagacagagaaaccagcgtgccaacagcgggttctatcgaacccgcgacccacaagagaggcgccgcaccacacgatgtggcgcccgcggtgcgaatgtgcggacaacgacaaaaaaccgcgggttgaaaagaaagaggggcggacccgcggggtctacagatccactgaggaagagcaagtttacataaacacggcgcccctgggggcaaaaacgaaaacc

SEQ ID NO: 551949 - DNA, 931 bp, Homo sapiens
  misc_feature (640)..(640): n is a, c, g, or t
tcggcagcggcgccgggcggagggggagagcgcgggcgggcggtcgggaagcgacgaggcgggcgggccagcgaggagcgcggggagaaaaggcgcgagcggcaggagggttcaggccgagacaccttgcaagtgccggggtgccaacgagccgcgcgtgtgcttcactgagtccgcctcgagggccacctgctcagtgtcgatgccgcgtgtgggaagaaggatgtccaccaggacgtccaggtctgccaaagcaggagtcatctttgccgtggggcggattgctgcgtgtacatcacgaatggccaccccaagtacaggattgggtggggggcaccgcgtgtacatggccgcgtcctggaatacctgacagcggagattcgtggagctggctggcaagtgggtgggagtagacaacaagaatgggacggggtcacacccgggacatcctgctggtgtgggcaatgatgaaagagctgaatcgagtgctaagaggagtcaccatagccgtgtgggttgtgttacccaatatcaccccgatgtttgctagcgaagaagcgggggatccaagggaaagtttggctgccatcatcacagcgcacccccagccgaggagggccaaggtctccattcccagaangaacgctgttcttagaagaggccgggagggagatatggggccggaaatcccaagaagacgcgggtgaagtctgtaaggggacgcatgggcgataggagaactgggggacacctgcgagcgggtcgagggtcctttccacaagaggcttttccttgggacaaggtgacctatcccggggaacgtagtaagccggttgaggggggcgtaaaacacacacagtgcgttggtaaagttgcttgaaccggttaaagggcgagtttgactgtgtatcaaaaaggctttattagggca

SEQ ID NO: 551950 - DNA, 499 bp, Homo sapiens
ttgtgtgcgcttttaatgccccaatgtccacctgaaggagggagaagggttttctgaagcagagtggggcagagagaatgggctcttatgtaacaaatgtttttgcccactacttctttcttggttatgttgtgggagcgaattttcctggtctaatatggccggccccaaagacatgggtataatccccggaggagccactcgcgacacggcttctaaatggtgcgtgcgcacgagggcctcgtgtgttatggtccagacgtgtttctctgcacggctttctgttgggtgcggggccccgtccctccgagtgtgctctccacgtgtgtttgtttccctccgtgcgtaatcacgtgggcggattctttttttcccgcccccaccttagtgggcacggcgtttgaccactttttcattggtccccacactgggggatttttcccccccaaattttttccacattttttccccacccccccccctcacaaaaaaggtttta

SEQ ID NO: 551951 - DNA, 524 bp, Homo sapiens
  misc_feature (162)..(162): n is a, c, g, or t
  misc_feature (233)..(233): n is a, c, g, or t
  misc_feature (244)..(244): n is a, c, g, or t
tgtgatgttatctgcaataccctagaaggatgttactcctaatatgtcacaggggtgtacacactttgatattatttgtcatctcatagagagatatgacttcaaatgtcacagtggatgttcacacatagtgtataccctgtgatattattcataatatcntagggagatgcaactcctgatatcacagtgtgtgtacccggtgtgtgtacacccttgatatgagtcgtganatccagggaanatatgactcctcatatcacacagtatgcacaccctgtgatatttttcatcatactttagggagatattgcttctaatatcacagtgggtgtaccccatgtgtgtgtactctgtgacagtatattctgtatcctaggaaggtattactcgtaatgacacaatgggtgttcaccctgtgatatcattcttatttgaccttgctgccttttttaacccatcctacaaaaggaatggaacagataagaagatattgagattagactgcgctgctgtgcggccgc

SEQ ID NO: 551952 - DNA, 944 bp, Homo sapiens
ggcggggggagctgcactcgcccgggcgtggcgcgtgggatcctggaagctgatgcagatgacatgcaaaaattgttaccgagccatgtgccagtatgaattgatacacaatgatcgaacaaaacctaagggactcaagtattgaggaattacttagcatagtggaaagacatatacagctagcgaaggggatgatccggaggcttgagcacgggggtgacaacgaggctcaccggatgaggactgcctagcattcaagaagagtgatattcctgcaagacagtagatgagcatccttatcagtggagactcctgaggatgacaggcacgtttgtcaagatatctcctgtcgtaggaagtgagctcgaaggttccttatgagatacaaaaaaggacgcacgcgacgttagtcgacctttgaacactacgaagacagtggtcaaaactgtggtaagcatgtagtaacacactcatgtagctgatacaaagatgtaaatcgggaggtgacgggcaaggcagtgccagttaagattcgggagtcagactccaggttgatgtaagaaagtagtaaaactgaaaatgagtgttactgaaattcctgtacactattggggtggacgatcaattgcgagacaaggttagtagcttgagctttttcaaagtcccgaaatggaggcggagagggtggaccggtggactatgacagaaagtcggaagtgcagtcattacgtgtgggggcttcgagggttgccagatttcgaacagaaagataccttttgttaaataagtggcgtgagaggtctgtttccataccggatacatggaaaggtacgaatttcaggacttgaggacaggttgaaggagggggtacaggtaaaggggggagagaaaaagggaagggggagaaaggtggttgaaaattgagaaaaagaaaaggggggagt

SEQ ID NO: 551953 - DNA, 913 bp, Homo sapiens
cgcccagtcccgcggggaccttcttggcgcgtcttcttgtgataaaacgcgggcaacgtgtgtgagatacatatccccgcccccttatgtgcctggttgcgcagaggacatcctgccttcccgccgtggggtatacctatggtgcaccccgcgtgtcgtccgcccctcctttgggggggggtaacaacatggctcgtctcattccttccgttgcgggtggcaacagcgcacccgatcgtccctttcccgggatgtacgccgcctcgctaccagttttatacacgggagggtccagtcatcctgggaggccaatgacacacggccaacgcagggggtcgctcacacacacacacgggtcaagtctccgacccccgggaatatgacactctctcctgatggggtcctcaacccccccccccccttctccccccgggggagtttgtcccgtgatagagttgcgtcctccctcaatggcatcgacgctcgcccccctaacagcgggtgtattccctcggggagccccaccagtcggtccggcgcgtccttcttcgcccaggcaccaccctggcgagtccccctccccttttgggggcatctggtggtcccgggtgtcttcccaccacagagctgcgcgttgctcgcatccgccgaccccggcagctccccccgtcgtggctgtcctcccctggggctcctacaggtttgtgggcccccctcctcctggcggtctgctgtatacccatcgtctcgcgcgcacacccgccctaatgctccccccgggggtgatgacagaccacgtttgcggtcgttctccgtcggtcgtttacaggagcaggtggggtggggcttgtccaaagcgcgtcatagcaacttctttggcgcccgaaaaaatccgaaaccaaacaaacataca

SEQ ID NO: 551954 - DNA, 231 bp, Homo sapiens
ccaatgtatttcaagtcagtgaccagaaaaatcccaccccttgccctttccccaaaggaccttttctgtacatgacacttttttgttgttttttgtttggggttttaccatcgtccggacttttccatttgtcttcccgggcgcccttcgccgccaaatctttttaaatcgcagcttctagcaagccccccaccccaatcaacctttatgcttttttcttaaaaaaaaaaa

SEQ ID NO: 551955 - DNA, 196 bp, Homo sapiens
tacagtcggtaccgattacgctcctagacggggtctagatttcaactcagagctcgtgtatgattcaaatacatgctccggtctctgtggtgttacagattgctcattggcctggggacttgtcatggacccttgcctcggatgcgtgttcccagatttcactttaggatgaggagattaactggaatcgactttg

SEQ ID NO: 551956 - DNA, 109 bp, Homo sapiens
gttactctagaggaccccgaaggcgcacgatggccgtcctcgagggccggtcagtgcagtgacagtctgggggtggcagcatgagggagatggggtagtgtggatgttg

SEQ ID NO: 551957 - DNA, 461 bp, Homo sapiens
atctcctcgaatcgcggttctcatgtgcaggctgcttgaatctgactcaggtatcgccgctcggctcccaaagtgctggatacaggtgtgagcacgacccggcagtgcttctattttaatctgaactttggaaacactttctactttaaggcacaggatcaggataagaacccacatgtacgagctaacagagctgcacttcaaatttactaagttaatttaattttcccttcattggcttggctcaaggtagaaaagtacaatttcccttttcttagataaactgattattaaaactgaaaattaacgttttgacaactcaagagtgtctgacatcgctgggatcctggagtgctgagtgtggcctcgatggtgacttcactcctccacatctgggaggcacttcagtgcctcgaaaatcacccccttttttaaaaagagaactggagcgcagctactgg

SEQ ID NO: 551958 - DNA, 151 bp, Homo sapiens
cctctcccaacatggcgcgcctcagcagaaaagaagaataagaagggggaagactatctccctaacagacctttcctcgcctgagggatgggggtacctggtggaggaggcacctatgtttccaaaccaggtaagctggctctgtgaaccg

SEQ ID NO: 551959 - DNA, 246 bp, Homo sapiens
  misc_feature (92)..(92): n is a, c, g, or t
  misc_feature (149)..(149): n is a, c, g, or t
  misc_feature (157)..(157): n is a, c, g, or t
  misc_feature (213)..(213): n is a, c, g, or t
acgtattctgggccaagcagccttcgacctgacgctcgtgatgccggtcgccgacagtctggcgcgcattttttcggccgcatgcagaggcncgcgtgtgctggtgcttgatctcgacaacaccctctgggcggcgtggtcggtgacgnggcgtcangtctggtcgtgggcgagggcggcgcggcggcgaggcttaccgggcgtcagcgcgtnctcgactgagagcgcgcgtcgtgctgcgttgtc

SEQ ID NO: 551960 - DNA, 315 bp, Homo sapiens
gaatctgacctgtcctggtccgccgcgctgggcattgaacgccccgcagctgctcaggcacctgccccgccatcaatgaagtgccccaccggccctgggaaggacacccctgcagcgggagcctacaggctgtgccattgtcttggggacatagctcaccaggccgtgatattacgggcgcaagccatctgcctcgagttgccacagagcttgtagaacgtgggcgtcaggtccggctactaaaacgtctcctgcctcagggccacaagcttggcgctgccggtgcctcctcctcctcccgctatccgtcgggta

SEQ ID NO: 551961 - DNA, 167 bp, Homo sapiens
gcgttactctctgcgccagattcctcacaaagttaagaaagtgaggcggcacggtggctcacacctgtaatcccagcactttgggaggacaaggcgggcagatcacctgaggtctggagttcaagaccagcctggcaacacggtgaaaccccatctctactaaaaat

SEQ ID NO: 551962 - DNA, 316 bp, Homo sapiens
tctctgtcacccaggctggagtgaagtagcatgatcttggctcactgcaacctccacctcccaggttcaagcaattcttgtgtctcagcctcaaagtagttgggattacaggcatgcagtaccacacccagctaatttttttttttttttcctgtagagacagggtttcaacatgttggccaggctgatttcaaactcctggcctcaagtaattcatttgcctcagcctcccaaagtgctgggattacaggcatgagccaccatgcccagccaactgtaagttttttgtaggtgctctttaccaatccatttattc

SEQ ID NO: 551963 - DNA, 86 bp, Homo sapiens
taaaaaggggcaaaggatttatgggttcgataatcttttaaaaaaataagaggagggagtaaaattaaagatgaaagaggattttt

SEQ ID NO: 551964 - DNA, 1706 bp, Homo sapiens
  misc_feature (1626)..(1626): n is a, c, g, or t
ggggcgcccctcccccagcctcgttgccgccttgcagtttgatctcagagtgctgtgctagcaatcagcgagattccgtgggcataggaccctctgagccaggtgtgggatatagtctcgtggtgtgccgtttcttaagctggtctgaaaagcgcaatattcgggtgggagtgacccgattttccaggtgcaaattgagcatgacccagaattagaaaaagaaagccctggcttgaaaaccagtccaattgatgaaagtgaggtgcaaacagcaactgatagtccctctgttaaacctaatgagcttgaagaagaaagtactcccagcattcaaacagaaactttggtacagcaggaagagccttgtgaggaagaagctgaaaaagcaacatgtgattctgactttgctgttgaaactttggagcttgaaactcaaggagaggaggtcaaagaagaaattcctcttgtagcatccgcttcagtcagtattgaacaattcactgaaaatgccgaggagtgtgctttaaatcagcagatgtttaacagtgacttggagaagaaaggggcagaaattattaaccctaaaacagcattgttaccatctgacagtgtgtttgcagaagaaaggaacctcaaaggaattctagaagaatctccatctgaagcagaagatttcatttctggaattacacagactatggtagaagctgtagctgaagtagaaaaaaatgaaactgtttcggaaatattgccatcaacttgtattgtgacgttagtaccaggaattcccactggggatgagaagacagtggacaaaaagaatatttctgaaaaaaaaggtaacatggatgaaaaggaggagaaggaatttaatactaaggaaaccagaatggatcttcaaataggaacagagaaggctgaaaagaatgaaggtaggatggatgcagaaaaggtggaaaagatggcagcaatgaaagaaaagcctgcagaaaacactttattcaaggcatacccaaataaaggagtgggtcaggctaataagcctgatgaaactagtaaaactagtattctggctgtatcagatgtatctagcagtaaaccaagcatcaaggctgttatagtctcttctcctaaggcaaaagctacagtttcaaaaactgaaaatcagaaaagttttccaaaatctgtgcccagagatcaaataaatgctgaaaagaaactttcagccaaggaatttggtctgcttaaacccacaagtgccaggtcaggcttggcagaaagcagcagtaaattcaaacctactcagagcagtcttaccagaggaggcagtggaaggatctcagccctgcaaggcaagctttctaaactggattacagagatataacaaaacaatctcaggaaacagaggctagaccttccatcatgaaacgggatgacagcaacaataaggtgaggagggtaggaagaatggcacagtgtgtctttgaagtgattagctccgctgctgtagctatgtagtaggagatgtaattttgtttcatactttcatctcctcactctaccccggaagctcccatttccttttcttaaatgattccattgtttaagccagtagacattcagantattaaactcaagttcataatttattgacatgtttgaaaagcattatttggatacaatttggaaataactgtggtttaaa

SEQ ID NO: 551965 - DNA, 788 bp, Homo sapiens
cagctaggtagtggagcgccgctgcttaccatgggtgcaggagacagccggagtcgctgggggagctccgctgccgccggacgcccgtgaccatgtggagagctgctggctcgcgctagtgcgccgctcctgcgggtgcccttggtcagacttcctgggcactcctccccggccagtgccggcgtaaagacactgctcccagtaccaagttttgaagatgtctccattcctgaaaaacccaagcttagattctattgaatagggcacctacttgtgccaaatatgtaagaatgagaacctaaaaaatttaagtgacatacggggaccttccactgaagtctacggagtttacagaaggcacttttgcaatcttggcattgggctggtggcatacctgcattgtgggccactttgaacatgatgcgcctgacaatcaagcctgctctagtggatccctcaagaacatgtttgtccatactggcgagtatccagcccctttcatgcccatcactctgcaaaagtgttgggcatcgcatggggggcaggcaaagtgtgctattgaccacttagggttgacaccttgtgaaaggctgtgccgcctgtgtttgtacgacgcatcggagtggagcgctagtagagagttgtgacatgaatgttgcagagggttctcctttgaccagcgttgcccacaagtttgcccttcgcagcgacggctgtgagccgcgggactctagagaagatgcgaaccagatcacgaggaagtgagaacctaacaaaccagaacccct

SEQ ID NO: 551966 - DNA, 1396 bp, Homo sapiens
ggggcgcccctcccccagcctcgttgccgccttgcagtttgatctcagagtgctgtgctagcaatcagcgagattccgtgggcataggaccctctgagccaggtgtgggatatagtctcgtggtgtgccgtttcttaagctggtctgaaaagcgcaatattcgggtgggagtgacccgattttccaggtgcaaattgagcatgacccagaattagaaaaagaaagccctggcttgaaaaccagtccaattgatgaaagtgaggtgcaaacagcaactgatagtccctctgttaaacctaatgagcttgaagaagaaagtactcccagcattcaaacagaaactttggtacagcaggaagagccttgtgaggaagaagctgaaaaagcaacatgtgattctgactttgctgttgaaactttggagcttgaaactcaaggagaggaggtcaaagaagaaattcctcttgtagcatccgcttcagtcagtattgaacaattcactgaaaatgccgaggagtgtgctttaaatcagcagatgtttaacagtgacttggagaagaaaggggcagaaattattaaccctaaaacagcattgttaccatctgacagtgtgtttgcagaagaaaggaacctcaaaggaattctagaagaatctccatctgaagcagaagatttcatttctggaattacacagactatggtagaagctgtagctgaagtagaaaaaaatgaaactgtttcggaaatattgccatcaacttgtattgtgacgttagtaccaggaattcccactggggatgagaagacagtggacaaaaagaatatttctgaaaaaaaaggtaacatggatgaaaaggaggagaaggaatttaatactaaggaaaccagaatggatcttcaaataggaacagagaaggctgaaaagaatgaaggtaggatggatgcagaaaaggtggaaaagatggcagcaatgaaagaaaagcctgcagaaaacactttattcaaggcatacccaaataaaggagtgggtcaggctaataagcctgatgaaactagtaaaactagtattctggctgtatcagatgtatctagcagtaaaccaagcatcaaggctgttatagtctcttctcctaaggcaaaagctacagtttcaaaaactgaaaatcagaaaagttttccaaaatctgtgcccagagatcaaataaatgctgaaaagaaactttcagccaaggaatttggtctgcttaaacccacaagtgccaggtcaggcttggcagaaagcagcagtaaattcaaacctactcagagcagtcttaccagaggaggcaggaggatctcttgagcctaggagtttgagaccagcctgggaaacatagtgagaccccatcgctacagg

SEQ ID NO: 551967 - DNA, 112 bp, Homo sapiens
tgcttatcacacagtctgctgtacaaatgtcacctgcagtcggagtaattctcatcgcgttcctgaacctctagttaaagtgaacccaatagtaaataaacatttctggcca

SEQ ID NO: 551968 - DNA, 753 bp, Homo sapiens
  misc_feature (489)..(489): n is a, c, g, or t
  misc_feature (626)..(626): n is a, c, g, or t
  misc_feature (746)..(746): n is a, c, g, or t
gtgtgccttgctctgtctgccggggaggagctatactcaggggtggcagcagacctcatgggacgagactttaccatctttcgcagcctacggcaacgtccaagtctccgaacagagccacacgactcccgctggctcaatggtgagagggctgatgggttagtggatagaggtcgtcaccctcccacagggcaggtgccaagctaggctcatatagtatgtgagcagaggcgtgtgccaggtcttaccacataccctccttaatcaggcactcgcgtcacagagacagatcagacaggtatgaccgtgacctctatgagtgcacagatcacatacatgataagatcaagcacagtgagcttgaggccagagagagacaagggaggagggcaataggacactggctggctcgagggagttgcgcaaaggaagcctgtaggctgaggtgagcatgagctaatttcccagcacatgacagctagccggcanaatttatgcgatgagcattgcaggcagagggagcattccatgcagagggagctactagtgcagaggccctgatgcacgacatgcaaaggaatgacttgcagagctagcagtggggggcctcgactgtcaggggccanatgcatttattctatgaggcatgggggctgtggcaatggcttgcacctgtaaccccacactatgggaggctgggcagacagattgcttgacacaagagtttatcccctgcgctcctggcnggcccct

SEQ ID NO: 551969 - DNA, 863 bp, Homo sapiens
  misc_feature (331)..(331): n is a, c, g, or t
tggctgtaacatgtgtttattggatgatgagtccagtgctcctgctgaagccctgtgtgggggaggggccacagagcgaaatggggctgtaagggaatgcttgaagtggtttgcctcctgtgatgtcgggctctggagctctccagactatggcgatggtgcatggggtgatgtgccctcggtgcacacatgcctggccgcccatgtccaccctgtgcccatgattggatgtggctggccggtggcccgtgcacatgtgcactgtgccaggtgtggtgctctccacactctcacgcgcaacaaccctctgatacctgtgagagacctccanagtgtgcgcgtgtctctcccacgaaactctccaaacccagtgtgggcgaatatttagacctataagtgtgcaaacatttataaaatttctcagagacagtgtggtgacgtgggtggggtgaaacacacccagagatgctctggggtgggaggggcttgtgcggaaaactcttctctgcgagaaacacacaagaggggcacaagacacggagtgaaaaaggccctccagaaaaacacccaagagagagacaccgagcgaggcggggtgttgacacacacaggaccaccgaaaacgcatgcgagaaggggttggtttgagggagcaccggggcgggctccatatccccccctgcagtggagaacagtggaacggcctcaatggcctcttgtgggggaacatagcaattgtgtagagcttagcgcgttggggtgtgtgctacaaaacgcgggtatcccaggcagctggccaagggggagggtgttgtgccccattgtgcaacataattttggggattgattccgcccctgggttg

SEQ ID NO: 551970 - DNA, 337 bp, Homo sapiens
caacaggacatccattctataagcctatgcgagtcccctagagagaggcatgtactgatatataaatattatataatatatacatgagacatactgacagaatctgtaagactaataaaatgtaagaaaaggttaaaaaaagaataggtaaatagacaagaagtatttatagtttaaccatatagctttattgccttcctaggggataaaacaattcctatccttatatatatgtgtaagtacagcctgaagtgtagggggccttagaacttgaaagcagacagggtctccttgccctggactaggccttccctagactgagtggggctcagcatag

SEQ ID NO: 551971 - DNA, 739 bp, Homo sapiens
  misc_feature (651)..(651): n is a, c, g, or t
  misc_feature (664)..(665): n is a, c, g, or t
  misc_feature (697)..(697): n is a, c, g, or t
  misc_feature (719)..(719): n is a, c, g, or t
  misc_feature (727)..(727): n is a, c, g, or t
ctttggctgcccgtggtcgactctcgaggatcccctcatcttgggcctgtgttatccaagaagatctccccaaatcatggaattacatggaaatttaaaaactttctcctgaatgacttttgggtatgatgaaattaaggctgaaattaaaaaaaattttttgaaataaatgaaaacagagatacaacataccaaaatctctggaatacagcaaaagcagtggtaagagggaagtttatagcactaaatacctacttcgaaaagttagaaagatgtaaaattaacactctaacataacacctggtggaactagaagaacaagaacaaaatcccaaaactagcagaagaaaagaaataactaaaatcagtgcagaactaacaaaattgaggcccaaaaatccacatgaagaataagtgaaaccaaaaattggttttttgaacagataaacaagatcgatagacaactagctagactaaaaaagaaaaaaaagagagaaaatccaaataagcacaatcagaaatgacaaaggcgacattacaactgatcccacagaagtacaaaagatcctctgagactattatgaacacctctatgcacacaaactagaaaatctagaagaaatggataaattcctggaaacacacaatctnccaggatccaccnnggaagaaattggaacccttagccgaaccaatncccaagttccagaattggaccngtaatggnaaaaatcttccc

SEQ ID NO: 551972 - DNA, 537 bp, Homo sapiens
  misc_feature (85)..(85): n is a, c, g, or t
  misc_feature (141)..(141): n is a, c, g, or t
  misc_feature (151)..(151): n is a, c, g, or t
ctcttttggtttttccccattgtgacacttctgttcgaccattgtagtagtactttttccccgaagagctaatatgctcagaccngtcatctgcagaatcataaggtgcatctgaagttttgcttgggttattgcttggantagaagaatntgatttgactatgaagagcactgtggttgtgtgaattttcttgtggagagtaactggtcccaccatccctctatctaactctgtgagtatgcacatttttggccttactgtgacttgtggtgtctctgtatttgtattcaggactatcagatatgcagcagcagttcatggagtggtgaaggatctaaggccgtctcgcatcttttcatgtggtgtgatagccgccacatggggtgattctgccatgaatagttcagtgcgtgtaaaacatcaccccgctggtaaggttgctagtcccccgtgcggttgcggcagccatccctgagttttggatgtatcatcgcacacagtgcgagccaggaaaggcctgtgagtgtgagtagggg

SEQ ID NO: 551973 - DNA, 1291 bp, Homo sapiens
gaagcagtggtatcaacgcagagtgcccattacggccgggacacgtgcctacgacccgccgggcgcctgcgcggtagcatcgcggagtcggtgctttagtacgccgctggcacctttactctcgccggcgcgcgaacccgtttgagctcggtatcctagtgcacacgccttgcaagcgacggcgccatgagtctgacttccagttccagcgtacgagttgaatggatcgcagcagttaccatgtgctgctgggacagctgcaatgtggttatctagcttacaaaagattttatgttaacagatcatcgaaataaagctatgataaaccttcacatccagaaagacaacccaagatagtacatgctttgtgacatggaggattgggagataaagctgtgtactgccgttgtgtggaggtccaaaaagttcccattctgtgatggggctcacacaaaacataacgaagagactggagacaatgtgggccctctgatcatcaagaaaacagaaacttaaatggacaccttttgatgctgcaaatcagcttgtcgtgaagttacctgatttgtttaattagaatgactaccacctctgtctgattcaccttcgctggattctaaaatgtggtatattgcaaactgcagttttcacatttatggcattggtcttgtggaaacatcgtggttgcccattttgtttaaacaaaaaaaaaaaaaaaaagggaaaaaccaacctcagggccggggggtaattggggtctggtaagggatccatttctttaaaatacggacatatagacgtggtacccttatattagaatataagtggtatctggaagtccaccaatatttaaatttattctcaaaattaacaaaaacaaaaaacaacaaaaaaacaaaaaaaaaaaaaaaaaaaaaaacaaaacaaaaaaaaaaacaaaaaaaaaaaaaaaagaaacaaaaaaaaaaaaaaagagaggggggcgcgcgcgagcaaaaaacgttactcactccgcgagggggcgaccaccataagacgcaggcccgcccaccgcagtcatgagtcggaaaaaaggggcaccgcaccacccaaaaaggggggaactgaattaacactaacagcaggacagagcgcagcggggctgcgtcataaacaaacaacgaaccgggaggaagaggaaaagcaacagcgaccaccgcagcgaaaagacgtcagtcgctcagggagaaaaccccaaccacatggttgggcatggtgggaaacatgtcgtgagccgacgaccaccataaaa

SEQ ID NO: 551974 - DNA, 928 bp, Homo sapiens
gcttgtggagctcggcgccggaggagacgcacgcagtctgacattagtcgttctccgcatcgactgtttacacgagcgtctccagagcacttctctctcctgctgcacagaatggcaagatctgtataggaaaaagctcattgacaccagtgtgcggaagagaaaggaatatagcttcgcaaaagctaataaatgatacagctgtagatgaggattgtatggaccaaagattgggtgatgtgacagtgttgcatatatagacatatctaggtgagtagttctactgaaggcctttggatgaaactttgcgtgcgttggtgggatgtttgtaggaaggataagccttgaatggagaaatagatgcgatctgtcagcatgggagctctatttctctcatgacaccgtaaaattgtggccagagttacaagattcattctagtgaccgcccaatgtctagagatttgtaagtggtaaacatgcagtgagtctcgttcgagtcagagaagggggagaggtcgggcctcgaagttcttggttgccagcgagacaagtgctttacatgtcgttcaaagattgcagttaattgcctcagtatcgatcgaatgtacaagtgcctgcatgtggcgatcataaatctgtaggttttccacacgccagtgggacattgctctactgttatgttgaccatggaaaactacagtggaattacccaaaaacaccgcgtggatgtggagagtggatgtaactctgggatatctgctaagaattgtcgctagcttatgggtgaaaaacttggcattcatcccaggaagtgcatggatggattttgggggaacatgggactcaagtgtggtgtgtggaggtgggggtgatgttggagtgtgtctctccaggaattgaattccgaatggggactggaatgatagtg

SEQ ID NO: 551975 - DNA, 753 bp, Homo sapiens
cattacatgaaaaattttagacactaaatagcaagtcctactgatgttagatgcagtttcatttctgtaacattattttcttcttagatgcttggtagaataatttactttcagaatcatcctgacacattctgacatttaagtagtttgattttacatgatatattatcctttaaaaaaataggacaaatgccaaatgcctgtatcaacttcagtgtttacagcacagaattattaattaaatttagttcttcatttgaaaaataagtttgctggactctgccagttggagtgtggattaatttaatgtagtttgaaatataggaattaccaaatccagttaagtttttattatgctatttctatgtcttgaggcatacacccctgtttagagattttttttctctccaggctaagatttctgttcttttttatttagccttcttgggcatgttgcaaatattctacctagttatgttttccaggtctattgtagtagagccaattcttcattttctctgcttctcacctgttttttgtctatttatttgtgtataaagatgtctacaggacaatgaacaagtaacacctcaaaataccaccttgaaaaggaaaatgcaacaaattcttttctgcacctgaagcttttaattctttaatccaccatggaatgtttgcttaattacatattttattatgcattaactgaaaatatgtactttaggtttccccaatgatatgaaagctgtattg

SEQ ID NO: 551976 - DNA, 439 bp, Homo sapiens
aaaacctgtttccatttccttctatattaactaaagtcagtttgagcaactattaaaggaagttaaaattctcttgtgttttgtctacctgtgggaactataaccagacctcagtggaaacaggaaatgtacaataagtcccccttttatgactgtaagtgaatatattttatggtgtttgcaatagcctcttgtaggagaaacaagtaaattaaatttttacatatttctaaatagcctctgctgaataataacctgttttgtatatttagcaccttttcataaaaacagcttgtgtctgcactgtaggtagcagttaatcaactgtgatattgaaatgaagagaaaagacgcatttgacactgagcatgtgaaaggttatatgcaatggggtttcccactgagcaaattagacaacaaagatctagtttttgagcca

SEQ ID NO: 551977 - DNA, 1356 bp, Homo sapiens
gaagcagtggtatcaacgcagagtgcccattacggccgggacacgtgcctacgacccgccgggcgcctgcgcggtagcatcgcggagtcggtgctttagtacgccgctggcacctttactctcgccggcgcgcgaacccgtttgagctcggtatcctagtgcacacgccttgccaaagccgaggggccgccccattggaggtcctgactttcccaagttccccacgcgttcacggcaggttggaattgcgattcgccaggcacaggtttacccatttttgctggctgggggacccactcttggccaacattgggggtttaatcctaagcttttaaccaaaaagggactttgtatggttaacgaggcatcatcgaaataaagctatgataaaccttcacatccagaaagacaacccaagatagtacatgctttgtgacatggaggattgggagataaagctgtgtactgccgttgtgtggaggtccaaaaagttcccattctgtgatggggctcacacaaaacataacgaagagactggagacaatgtgggccctctgatcatcaagaaaacagaaacttaaatggacaccttttgatgctgcaaatcagcttgtcgtgaagttacctgatttgtttaattagaatgactaccacctctgtctgattcaccttcgctggattctaaaatgtggtatattgcaaactgcagttttcacatttatggcattggtcttgtggaaacatcgtggttgcccattttgtttaaacaaaaaaaaaaaaaaaaagggaaaaaccaacctcagggccggggggtaattggggtctggtaagggatccatttctttaaaatacggacatatagacgtggtacccttatattagaatataagtggtatctggaagtccaccaatatttaaatttattctcaaaattaacaaaaacaaaaaacaacaaaaaaacaaaaaaaaaaaaaaaaaaaaaaacaaaacaaaaaaaaaaacaaaaaaaaaaaaaaaagaaacaaaaaaaaaaaaaaagagaggggggcgcgcgcgagcaaaaaacgttactcactccgcgagggggcgaccaccataagacgcaggcccgcccaccgcagtcatgagtcggaaaaaaggggcaccgcaccacccaaaaaggggggaactgaattaacactaacagcaggacagagcgcagcggggctgcgtcataaacaaacaacgaaccgggaggaagaggaaaagcaacagcgaccaccgcagcgaaaagacgtcagtcgctcagggagaaaaccccaaccacatggttgggcatggtgggaaacatgtcgtgagccgacgaccaccataaaa

SEQ ID NO: 551978 - DNA, 182 bp, Homo sapiens
  misc_feature (21)..(21): n is a, c, g, or t
caattttttaaaaaaggtgtngggccccccctggttagggggggacccttccaggcaggaaccggctcccccccctttgcccggtaaggggggcccaaaaaagcattaccccccctcggggggtggggttgggggggtcccggcccctggggtgggtttcaggtatgaaaacataaaattga

SEQ ID NO: 551979 - DNA, 197 bp, Homo sapiens
ggtggtggtgttatatggtgatgatgatggtgatgtgatgggcattgggggcaggaaacaggtttacactgggaatggggctgagtgggaacaggacaactggtttggatatctgccagcagagaggtggtggtagcttggacaagtgtggtagcaggaaagagggcagagagagatgtgagagatctttaagaggg

SEQ ID NO: 551980 - DNA, 772 bp, Homo sapiens
agaggatgtatggaaatgcctggatgtccaggcagaggtctgctgcaggggcaaagccctcatggagaagctctgctagggcagtgcagaaaggaaatgtggggtcatatcccccacacagaatccccactggcacaccacctaatggagctgtgagaaaagggccaccatgtccagaccctagaatggtagatccaccaacagcttgcaaagtgcacctggaaaagctgcagacgctctatgccagcccatgaaggcagccaggaggggggggtttaccctgcaatgccacagaggtagagctacccaaggctgtgggagcccacctctcgcatcagtgtgacatggatgtgaaacatggagtcaaaggggatcattttagaactttaaggtttaatgactgccctatggatttggacttgcatggggcctgtggtccctttgtttggccagtgtctcctatttggaacgggtgtatttgcccaatgcctgtgccccagtgtatctaggaatgtaactaactttggctgtgttgaattttgcaggctttataggtggaagaagacttgtctgtgtctcaagaacacttttgggactggggacttttgaggctaaatgcttggaatggagtaacgacttggggggggactgttgggcagggtatgattgggcttttggaaatgtggggacctggaatttggggaggcccaggggtggattaaatggttgtgaatcccatcaaattctcattgaatggtttccttatcccatt

SEQ ID NO: 551981 - DNA, 111 bp, Homo sapiens
agaggatctccagctgtttaggacgggtctggaatacacaccttggttatacgccggctccagtgctgagggctcgatggggctcctgatttccaccttgccaggttacct

SEQ ID NO: 551982 - DNA, 321 bp, Homo sapiens
aggcaaagctctacggagctcaggtgtcatttatgggttgcagagcacgctgttaaggggaatttggtagactgagctcagagacctgggtgtgaggggcaggacttgtgggcacagcggaggcgattagaggagggtccaccttgaattctttgcagcaggcacagagcttcttggttgattcccagaagggggcagacgcacaggccagggaacccggggctctaggctgtgggtccgaagtgtccccttgtgaactggaaaagcctgaggggggaggcttggaagctgataccaggattccgggtgtgttggtgagac

SEQ ID NO: 551983 - DNA, 121 bp, Homo sapiens
attcttcgtgcctacagtactccccagtagctttggaccacaggtgcccaccaccacgcccggactaattatatatgtatttttgggtagacgacggggtttcaccactgtcacaccagga

SEQ ID NO: 551984 - DNA, 168 bp, Homo sapiens
gcggacttcactggccacgaccgcgaagcctcgaccctgttcacccgcgcgagcggcctcgaccgcggcgttgagcgccaggatgttggtctggaaggcgatgccgtcgatgacgccgatgatgtcggagatcttcttcgacgattggctgatcacgtccatcgtggc

SEQ ID NO: 551985 - DNA, 161 bp, Homo sapiens
gaccttcagcctggacaaatctgaaataggatccagtatgtctgaaatactgctttctcaagtaacaaatatgaggaccgcaactctcattcaacatccaagcccttgcagttcgtgccaatatatgtgtagcaacaaaggacagagctgcatggatccaa

SEQ ID NO: 551986 - DNA, 229 bp, Homo sapiens
cgataggacaggatggtctcaaacttctaacctcaggtgatccgcccacctgggcctcccaaaagtgctgggattacaggcgtgagccaccatgcccggcctaattttgttaatcttgccagtttcaagccatagacacaaaaacatcagcaccatcttaagcagtcacactctgacctataaaatgtgacagccccaggagaccgcgtccaacacgggggcacctctc

SEQ ID NO: 551987 - DNA, 81 bp, Homo sapiens
gtgaaaaagtaaagtttaatttaaaaatcatatacataaagcttctgattcattttcagcgctcccttctgtcgtcttctc

SEQ ID NO: 551988 - DNA, 732 bp, Homo sapiens
  misc_feature (230)..(230): n is a, c, g, or t
  misc_feature (638)..(638): n is a, c, g, or t
  misc_feature (713)..(713): n is a, c, g, or t
  misc_feature (716)..(716): n is a, c, g, or t
ttcttttgttattattatactttaagtactgggatacatgtgcagaacgtgcaggttacgtgcaggtttgttaaataattatacacgtgccagggtggtttgctgcacccatcaacctgtcatctatgttaggtatttctcctaatgctatccctcccctagccccctagcccccaaccagcctctggtgtggtaatgttcccctccctgtgtccatgtgttctcattgntcaactcccacttatgagtgagaacatgcagtgtttggttttctgttcttgtgttagtttgctgagatggtttccagcttcatccatgtccctgcaaaggacatgaactcatccttttttatggctgcatagtattccatggtgtatatgtgccacattttctttatccagtctatcattaatgggcatttgggttggttcccagtctttgttattgtgaatagtactgcagtaaacatacgtgtgcatgtgtctttatagtagaatgatttataatcctttgggtatatacccagtaatgggattgaacttctggttctagatccttgaggaatcgccacactgtcttccacaatggtttgttctcattctttttccttttaaaataaatactgtctaaaatgaagnaatagtgcagcatgattcttacaacaagtaatttggaaagaagttggtttaattaattccctatgaggaaaggcngcnatgcgatcatttattt

SEQ ID NO: 551989 - DNA, 426 bp, Homo sapiens
  misc_feature (2)..(2): n is a, c, g, or t
  misc_feature (4)..(4): n is a, c, g, or t
  misc_feature (191)..(191): n is a, c, g, or t
gnanccagcctgggcaacagagtaagaccccgcaaaaaaaaaaaaaagtgccgtttaactctttgtcaacactaggctgaggcaggacgatccattgagcccagaagttcaagaccagcccgggcagccatggcaggacccctttctacaaaataaaaaaagttgactgggtgtggtggcacgcgcctgtnagtcccagctactcagaggctgaaggtgggcaggttgctttgagcccaggaggttgaggatgaggtgagccaagaccatgtcactgcactccagcctgggcatcagagcaagaccctgcctcaaaaaaaaaaaaagtgcagtttaactctttgtcaacactaggctgaggcaggacgatcacttgagcccagaagttcaagaccagcccgggcagcatggcaggaccccatcccc

SEQ ID NO: 551990 - DNA, 174 bp, Homo sapiens
gcagccttgaaatacctggactcaagggatcctcccacctcagtctccccagtaactaagagtacaggtgcgcatcattgcatacagttaattaaaaaattttttatgtagacacggggtctatgcatgttgcccagactgatcttgaactcctggtctcaagcaatcttcctg

SEQ ID NO: 551991 - DNA, 455 bp, Homo sapiens
tatatgtatcgattttacagtcgttcctccatatcactggtttccacatggcaaattcaaccaactgcagatcaaaaatacttggaaaaaaacaattaaaataataaacaattaaaaataatacatataaaaaactatatattataacatctatttacgtagcatttacattgtattatgcattataagtaatatagagatgatttaaagtatacaggatgatgtgtgtagtttatactcaaatattatatgccatttcatataagggaagtgaacatctatggagtttggtatttatgggggtcctggaaccaatttactgcagataccaagaaagactctctgtatacatattatatattatatatacatagatggtgaatatttattctcagattgagatatatgagtaaaaaatgtgaaattcaatcactgtattagggtagaatgcaaaa

SEQ ID NO: 551992 - DNA, 315 bp, Homo sapiens
ccaaaacccccggggcagggttaaaggcctttggccctccaccccagcccgggttgccttcttttttttgctttgggctgttggccctgccttaggggggatttttggggcccttaaaggcccttaatttgggggtttttgatttcccccccccccttccctaccccccccttgccatgggcccaatttgcccccccctcgctttttttttccccccgggccttttaatttgtccccctggggtggtttccgggggttttttcctttccccgggggggggggtttttggccattaagtttttttggtccctccca

SEQ ID NO: 551993 - DNA, 816 bp, Homo sapiens
  misc_feature (6)..(6): n is a, c, g, or t
  misc_feature (99)..(99): n is a, c, g, or t
  misc_feature (148)..(148): n is a, c, g, or t
  misc_feature (158)..(158): n is a, c, g, or t
  misc_feature (178)..(178): n is a, c, g, or t
  misc_feature (180)..(180): n is a, c, g, or t
  misc_feature (184)..(184): n is a, c, g, or t
  misc_feature (189)..(189): n is a, c, g, or t
  misc_feature (192)..(192): n is a, c, g, or t
  misc_feature (196)..(196): n is a, c, g, or t
  misc_feature (204)..(204): n is a, c, g, or t
  misc_feature (207)..(207): n is a, c, g, or t
  misc_feature (214)..(214): n is a, c, g, or t
  misc_feature (217)..(217): n is a, c, g, or t
  misc_feature (242)..(242): n is a, c, g, or t
  misc_feature (247)..(248): n is a, c, g, or t
  misc_feature (260)..(260): n is a, c, g, or t
  misc_feature (274)..(274): n is a, c, g, or t
  misc_feature (283)..(283): n is a, c, g, or t
  misc_feature (306)..(306): n is a, c, g, or t
  misc_feature (324)..(324): n is a, c, g, or t
  misc_feature (346)..(346): n is a, c, g, or t
  misc_feature (351)..(351): n is a, c, g, or t
  misc_feature (354)..(354): n is a, c, g, or t
  misc_feature (361)..(361): n is a, c, g, or t
  misc_feature (402)..(402): n is a, c, g, or t
  misc_feature (472)..(472): n is a, c, g, or t
  misc_feature (492)..(492): n is a, c, g, or t
  misc_feature (499)..(499): n is a, c, g, or t
  misc_feature (516)..(516): n is a, c, g, or t
  misc_feature (527)..(527): n is a, c, g, or t
  misc_feature (530)..(530): n is a, c, g, or t
  misc_feature (600)..(600): n is a, c, g, or t
  misc_feature (619)..(619): n is a, c, g, or t
  misc_feature (625)..(625): n is a, c, g, or t
  misc_feature (673)..(673): n is a, c, g, or t
  misc_feature (678)..(678): n is a, c, g, or t
  misc_feature (714)..(714): n is a, c, g, or t
  misc_feature (720)..(720): n is a, c, g, or t
  misc_feature (726)..(726): n is a, c, g, or t
  misc_feature (729)..(729): n is a, c, g, or t
  misc_feature (748)..(748): n is a, c, g, or t
  misc_feature (764)..(764): n is a, c, g, or t
gtccgngaattcccgggatggactggccggccgcggccgtagccgtgtgaacgctcttcgggctcgcgtcgtcgacccgcagccgcggggcggactaanaagggagccgcctgctgcgaggccgccgggctcccggtttaaatgtganactggtgtanatctccttgttctaaactanantcanccaanaanccanaaaaccanaangtggtanaanatcctttttgaaaggtgaatattantgaannaaaaaggctganaaaaatgggaaaantattccaanacaaatgtatattgaggtggaanatgattatgaatatgaancaaaagacaaaaaaattgtganaaaanaangggaaangtacatcttggtgaaaaaaaccaatgatgactggtggcaantcaaaccagatgaaaactccaaagacgttttatgtgccagcccagtatgtgaaggaggtcacgcgcaaanctctcatgccacctgttaancaggtanctggtctgccaaataantccacgaaaanaangcagagtttgcatcttcagagatcaacagaaaatgtgaacaaattgcctgagctttcaagtttcggaaanccatcgtcatctgttcaangaacangtcttattcgtgatgccaatcagaattttggacccagttataatcaangtcanactgtcaacctaagcctggacctgacccataataanggaaantttaanaangactcacattctcctaaantttccagccagaatangacacgctcatttggtcattttcccggtccagagttcttggatgtagaaaaa

SEQ ID NO: 551994 - DNA, 226 bp, Homo sapiens
  misc_feature (22)..(22): n is a, c, g, or t
  misc_feature (134)..(134): n is a, c, g, or t
  misc_feature (173)..(173): n is a, c, g, or t
cccataatgaaaggtttaaccnagtcacagtaaatattccatatccctgaaaataagccatttaatgagaatagaaccatttaatgatccatgagccctaaaaggatatctgccccgtattgccaagtttaagncaaaggtgagatcctgtaccaataagaagacagctttcntgtttgacattggtaagtaccaagaattctaactcaccatatagtaggaaaca

SEQ ID NO: 551995 - DNA, 1077 bp, Homo sapiens
  misc_feature (337)..(337): n is a, c, g, or t
taacccttctttagcttttagtgcgctcgagaaaaccaaatttaaaccccccccccgagtgtgtaacgggggggcgagggcacaagagagcagagaacacgcgaggaagagccgagcgggggagaccaccgaggttcgtggcccccgcgccattatatcgccctgtgagtgtgggtttgtgggtttccactctctgtgctccctgtgtgtggctgtgggggtggaggtgtgagaggggtgtggagcgccctccgtggggggagccgtgggccccgtgtggcgccccctctgtgtgtgagagaattctcacagaggggagagtgggagagaagaggcnccagtgtgtctcgcggcgcgtgggactctcgggggagacacaggggtgtggggtctccccagaaagatctccgagagaagcgcgcggaagagggaggagagttggaggacaaagaggactcctccctccgagagtgtgtctcagagagaggggtgctcacggagagagccgcccaagagagagagggggggccccctggggctggggcccgatggagagctgtgcgccggggagagggccaagaggcgcgctataaccgaggtgtgtgtgttacaccagagaggagggggtctcccccacaagaggctgggggagcaaggggggtagggcgcccgagcgtctctccgggagcaacatctttgtggaatgagaaaacgcatctccccatactactacacccagtcggggggagaaaattttattggcgccgccgccacttttagaagagacaccacctgggccctttggggacccaccacaggggaggggatcccagaaaaaccccttcgggggggaacacccctcgttgggggaagccaccacagtgtcgggtgagtttacagcgccccgcgggacacaacacgagaaaggacaccaggcggggagaacatgtgagacgacccccaaaaaaaagctagaaacaaacatgccacagagatctgggccccaatccgaccacagggtgttttctgtggacccccggaaaacaccaacagacaactaagcggaaaggcacaaga

SEQ ID NO: 551996 - DNA, 236 bp, Homo sapiens
ggcagcatttaccatgtatgcccgaccttaggatatcactggcgttgaccagatgttgcctgacgttgtgtgtgagactaattatctccaaataacccgtccatatctcagaggcgcagttgtcaatctgaagcgcagctgacatgcaagcatgattgtacgcattaagccttgcttactgaggtggtaccaggggggattagaggccagaatgaaaaagccaaggccacgtggca

SEQ ID NO: 551997 - DNA, 313 bp, Homo sapiens
  misc_feature (1)..(1): n is a, c, g, or t
ncgtaaagataatcttcctcccaagaaatgaagagtgtcgcctttaacccttaaaattcccctgtcagggagcctttaaaattttggaaatgtatgccaccaaaatgtaacctcggtatttttggcgcattctaatgtttgggtttaataagtttaagaaattgactctgggaattttcttttccctgaacctttgattccccctagtaagtcaaagttctaaaaaatgttctagctctttaagccttatgtgctcttactgattgaaagattttttatgtttcccttgtaataaaggccctaacccagaggt

SEQ ID NO: 551998 - DNA, 1366 bp, Homo sapiens
tatgaactgggaggcagaggttgcagtgagccacgattgcgccgtatgtactccagcctgggcaacagagcaagacccatctcaaaaaaaaattttttatatacctagagaggaagcctgaggcttgaccagactctagggagtataagtaaggcaggtactgttattactcctaaggccctagagctataactagacatctactgagtatttgtcttaagtatggcaacggacgccagggtaatcctggacctagagccagcaccttaacgctactataggttatattagctaggccattacaggtataaggcaagggtaggtagtacctagactggcactataccagataggcaggcacccaataacaccacacatacctaggccccaacacaggactatactacccgtagcagccacgagcaacaggaaaatcgtaccatctagccaatctgtaactactacatcattccttactaagtaccttactttggtaggtaagctgcattaaccttagaagggaacagcttagaaacgcactgcggggatagctatccctatacccaccaaatgcatttacagttggacctaatcggggaacttgttggcgtctagccaccccattgtttccaccaatcaattagcgacatgcgataccacatagccaattttaaggtagcatacacaagtgggcacccaaactacaataagacccatgcgcagacacatcacgttcacattattaccacaaattctatgggcacccatgagttaacgatatattagacaaacggattaacaaaggcatcaacaagataacagtactcgacacaccaatcaggaccagtagcatctacgatagagcgcccatacgtacagtgaaacccaaagggacaaaggacccactgaaccactggcatagacaaagtaatggaccaaagggcgaaagatataacgaaaagacaaatgagtggaatagcgcacaatggccgccagtaatatgagaaaaagataaaaaataacacagaataagcacaaagcttaattacccttgatgtataagtgtcgttatttaatctcactgtaggatgagacacataaatatatttgtataacacacacctttaaaactgccacacaccacacaccacattattctaacaccccaatacatatacaatcctaaccacgaagtaacacataacaactaacaaactctgtagatcaatctattaacccacatttatatataaatacactatcatttaatatcaagaaatcaattaaaacatatatataatcactaactaaccaataaaataatcacacataacaatcttaaatcacctatataaaacaattctat

SEQ ID NO: 551999 - DNA, 361 bp, Homo sapiens
atcgagctcgcgaccctgccatttactccatggcatgggcgtgagcaacagcttgctaactgatctgctacatctatcaaacagacttggcatatggaccagcaagacgcgggacaggccctaactcctatgcgcacagtgcctaacacctcactcaccattgcagcagagcgaatacacaatctgagttgacctgacacacatctcactccgtgctgtgttacagcactagcctggtgcgactctacacgcagctggctgaaggtctttgcactcactgctcactgcctatgtactcacagatgccttcatggctcctctctgacgtccttaagatatccctactatatcgtctatacaa

SEQ ID NO: 552000 - DNA, 687 bp, Homo sapiens
  misc_feature (513)..(513): n is a, c, g, or t
  misc_feature (589)..(589): n is a, c, g, or t
  misc_feature (655)..(655): n is a, c, g, or t
  misc_feature (687)..(687): n is a, c, g, or t
ttcctctttaaccatactgacagatgcccacagaatactgaaaactcacagcctgcaggagtctctctagcatgcccctcaacacttctgctcccaactgctgagctgtatattcactcagaacaatatttgttccaaaacctcaacaggggagttttattgttattgtaattagctaatttaattaaatatcacataaaccataaaagcaaaaataaaaggtcttgtatctttaaaaactaagtcaaacgcattgaaaagacttgataaaggcaagtcactgcaaaatactgctgttgaaataggcaaagataagagaaatatttttaaacctgggaaaaataataaaatatagaatataatgtttctgaaaatgtagcatggaagccaagcatagaatactgagccccaccttccatagtttctgattcagtaggtctggagtaaaaccaaagaatttgcatgctatgaaattcccatgatgctgaagctgctgggctgggaaccacactntgagaaccactgctctgcaagtgtctcaattttttaatctatattaaagaaataaagcataaactggatatgactngttatagatgtagatttatataagacttgcaagttcaatcagcaagcctatattgaaggccctggntcctagtcacacagtctatttatacttttgcn

SEQ ID NO: 552001 - DNA, 890 bp, Homo sapiens
tcctcccacctcagcctcccacgtagatgggaccacaggtgcacaccactgcagctggctaatgtttgtattttttgtagacacggcatttcaacacgttgcccaagctggtcttgaattcctgggctcaagtagtcttcctgtctcagcctcccaaagtgttgggattactggtgtgagcatcgtgcccagccttggtgtcttatttagttgtttgatgaggtcatgtttccttggatggtcttgatgcttatggatgttgttcatgtctgggcattgaagagttaggtatttcttgtagtctttctagtctgggcttgtttgtatttgtctttcttgggaaggccttgcagatattcaaaaggacttggattttgtaatctaagccatacctgcagtaaaggacaacccaatcccagtaacactgtagttctagtagacttgttagaggtacgtccttggtggtcttcaataagatccaaaagaattccctgtatcataggcagtctcttattctcttcctttactttttcctaaagaaacatcatttctctctctgttctgagctgactggagctggggaggggtgccccaggtcctctgtgggcaccgtaccaggacgtgctgggtccgacagaagccagcacaagactgggtctgcccaggcccgtgtgaaccctactggtactgctatgttgctccagacctggtttcggatcgcggactgcggagcgcccggggtggctccttggggggaggcctaaccaggggtcacaggaccgtggaccgggcgctaaacccacagcggtcggggtgcaccgccaccaggacacggcgcccagggagcaccccaaaacccgacaagggggcccacagaagcgcggcgccaa

SEQ ID NO: 552002 - DNA, 461 bp, Homo sapiens
  misc_feature (31)..(31): n is a, c, g, or t
  misc_feature (348)..(348): n is a, c, g, or t
  misc_feature (409)..(409): n is a, c, g, or t
  misc_feature (419)..(419): n is a, c, g, or t
aaatgacattaggtagtaaaagttaaaaaanaaaaaaaagtagttgctggaaaatgttcagaataactgagtaggaaaaaaaatcacttccaaaggaggccattgccatgtaatgtcatgggttttaaatcttaaactcttttccatggaaaatttaaaaagaatgcatttgattttgcattaattagacaatattttatgttatctattagttttagaaaataaaatctgattttcctttagttttctttactcagtaagtgtattttgccttcatctaaatgttttacatttatagttcttaactcttgtaattagatgataatcttaagaatacattgctggctnagacctgtactttaaccaatgtagtttttaagttttatgtggccctgagtggtttgcctcncccggtatcngtgtgtcatgtgcatacagtgcccacggaggccacatgcagg

SEQ ID NO: 552003 - DNA, 388 bp, Homo sapiens
gatcaccacatgtgtgtgtctggcttactgtggctccctccctctttcggtgcagagttccccagcaggcctgaaggccctgggcttttacgtagtataatcattcttaacagactattccagtgcttaggttttgaataggatgtagcagaagactcagggctagagatcttcatacatatcaaactgtatgattgccagaagcgtaaagtcacagacgaaatacacacccacgttgggattagcagtgacctgtggggaagctggaggccaggagaggacctcccctcatcactcagccagacagaaaaggatgcagctctttcccagccgctctgttcctctctgtccacaatgctggagcatgggcagatcaaacaaaactcct

SEQ ID NO: 552004 - DNA, 418 bp, Homo sapiens
ggtcggtcctgcttactgggcgttgggcatgacctgcagggtgaagctgagctacgctaccaggagatctccaagcgaacttctgcctcctcccatgctccctgtgggtcctagccacaagctctccaacatttactattgcactcgcgatggccgtcgggaatctgtgcccccttccatcatcatgtcgtcgcacaaggcgctggtgtcaggcaagccagcacagagctctgttgtatctgccactgagaagaaggcggtgattccagctcctcccataaagaggtgggagctgtcctcggaccagtcttacctgtgacactgcaccctcacggacaaccgagtactttgcctccttggatttcctccaggtagaatgtgacctaatttatgactaatacatacgcccaggtacgca

SEQ ID NO: 552005 - DNA, 426 bp, Homo sapiens
cattagaacccctggatcagagaaagtgtatgtgtgtgcgcgcacgtgcgataacgtgtctaaggtatcggcctggtgtgtgtagccgtactgcggtaagtctcgtgagatgtggtctgggtttcggtctgtccactgcgtgggtttcgtgggatccaggacactcggtgaaattctcatctagaccggatcacagcccatacggtccatctaaagacttgatgaacaagaaacgattcttacctggtctgaaccctgagccatggaaataagtaacaaaagaaatatctgaaagttgaaagctgatcccctggaaaagggggtgggagagggccatgctcttctccataaagtttatgtaactttttgcctttaccaaatataaaaatgtgtaatttgattatattcaggttaaaactgcacaca

SEQ ID NO: 552006 - DNA, 1377 bp, Homo sapiens
  misc_feature (566)..(566): n is a, c, g, or t
gctcgacttcttagctgtaggtgtgcacccaggaggtttcttctccctggcatggcttggctcccaagcattgtcccatggtcgccgacgactagtgcctgcctggggttggaagagacttgacgtttgttgccttaagggtctagctcacggtgcgctgggtgaatgctcatgcctcatgacccgttcaaagcgctctgaaccaggtagagggagcagttgggcgcacgataagtctcctactatgcctatgacgtgcatcgatagtattgcatggaagtacggaagattcgcctttctgacgtcccccaagaatgggctagttgcagtgctatccccttggcgctgacgttacgctggaggaagctgatcttgtgagtggctcaccagttgagtcacgatgcatgcaacgagtccactttcgtacatcgtgcagacacgtacgtgacgacaggtgagaatcccgctactaacggcacgaccatgtccttgcgctctttggccgtagggttgagtgcagggacttgctacaagctactgtctttgtatcgcccttgtgttcactntgaacgttgatactgtacagatctagcctaaaataggttgcgagtcggttacacgagccaatgggggtaccctgacacgggacattgggacatgtggacttgggagccaaagggcaaccaggcttctaccgaccgatgaggtgcccacggcaggtcgatcggcgcagtgctccgtacctaaccttttggccaggcgcatcgatggcgttcctactttgagcgtacattgggattgccccctttccgcatgtggggcgagtgggctctacggccgcagggaccccctagtggccgccggcttccctcaccatgcattccggatcgatctccttcgtggctctcagcgcgggagacggtgcgctgtgtctttttcactctatgtggatgcggtcattcccgttttgaaagcctccggctttccatcctgggttcgcgtgagtgcgctgtggcctttatgccgcttttgtctattaacaggtgcgccacgtggcgttcctagtggggcccgacggccgatgcctggtcatgcctcgctatacccaatgttttaagcgcccagtgtggtacattgttaccatggggcgctcccccacggacagagttgatgtgatagacagcgcggagaggtatgggcgctaggcttccaattggcgcgcgggctgtggataaaagccatgggacagcgtcttgggtttagtgttatatgggcacgccgcgaattgcaaccccacgtgataccccagaacaaggttggtatacccccaatgtgaaattcgtaacttgttgggacgtgacccttgtctacgtacct

SEQ ID NO: 552007 - DNA, 1332 bp, Homo sapiens
gacacacctttcagcaatggcttggtgactgtgatggttccccagctgcggagggcaaacagccttctcctgtggaatgtctttgacttgaacacccccagtccacaccttcgtggggcatgatgatgtgtgtcctggagttccagtggaggaagcagaaggacgggtccaaggactatcaactgtgtgactgtggtcccgggatcagaccttgagaatgtggcagggtggcattcccaagatgcagcaggcttttgtgcaaaatgaccatcattcaagcatggtgttgcatgcagttccattgcaggagtcatataccctatcattgcctggcaaccatgcaggaagcacctgcaaccacatgcacagcatacgagcatccaccagcaacactgccagccatggggcaggccagcagccctagaacagcaaggatccaccctagaaatctacctgcgcacgagagtgaacatcaagatacaccattgtggcgctgcctcaagcaccttgcagcaatgggaatttctacccatgatcaattgttgcacaatcccgcgcaactgtaccaagtcgtgcgcaggcatgcgatgacgggcaagaccagggcagcattgcacacaagcaggttctagactgacaaacttgcgagaacaaacacaatacgagagtgacaacgcagtgcttgggagtgacagtatcgcactgagcgacacgatacaccaccacaacaacaagaccacgaacgcaaatgtcgacatagacccaaggctcagacaagtcaaaaaccccgccaaggccaagacgccacatacagcaatgccacgcgcacagatgtacacgcacaggacataaaaagggcagtggacatcggagcagggaaatccccgtcggaaaaggggaacaaaccaagaccccgttgagcgagcacagcaaggatggaaccgagccggaatgcggacacaacggcaagggcaatgacaccattggggacgacccaccagtagaacacataggcaggcacgcacacacacagtccggcacagaaccaaagtacccctcagtgaacagaattcccgcgaaaggatggcaaaagcacacagggaaaagaaacccaagacgacgttattaccaaaagagaaaaaacaccacggcaataatgaaagcgatcaccaccaaaaacggtaccgtagaacccaacataccccgacaccacatgaacccgagcaagagaattcagacagacacgggacgtgtgaacccaccaatagggatgtatacaacgaggaggatacaggcaagagcaagtagcagtcgcccgaacagaaaatgccc

SEQ ID NO: 552008 - DNA, 144 bp, Homo sapiens
gtgtgaaaaaatggagtctgtaataaagagggtacccaggtgtgaagagtttatgttctcaggacttggaatgcattctgtcttgacccatcacatttctccgactgccaacttcagactctcccactgcaaccccgaacacgg

SEQ ID NO: 552009 - DNA, 258 bp, Homo sapiens
agcggggattggggtttttatcacccagcagatccccctttcgcatcgccgcggcgccctagctgcagggacccgcggggacgagaacgggaggcggcacgagcagatgcggattgaggattcccccgagccatgacaccgaggaccaagcgctgcgccccgcaggagcaaaccagacgccgctacacagaacacactccaatccaagccaccaaagccacaacgaccaaccccgagccacccacacaaacacccacc

SEQ ID NO: 552010 - DNA, 813 bp, Homo sapiens
ggctcgttctcgtggtggattagagtacggtggacatggtctcggttataatttgatgaggaaagaagctgatcaaagagccaatacgcgcattgctacagcaggtacttttatacatgtactattggagtgagcgagacgagtctctgcgtccgcaggtaagatggaaggaatgggcgtttgtaaatcgaatagtgacgcatcagttctgggcactgctcccaaagagatcgatgtatccaatctgctgccgtcggtgcctgagtgatgcctggagctatgctgggattcttgatgctcctgagcattgagttaataacatggatggttgtgggggtttgatatatatgaaaacctagggatattgagtgtggtataacattctttgtttagtctcttgatggatattaattttgagttgtgatgtgctttgatgaacgatattgtgttcccttcgctatgttgtcccgatgttttaacatagttgctctgtagtgattcttatagtatataaaattatagtgtaaaatagaatgactgccgtctatctcctgctgagaaaaaaatggttaacgatgaattctgcttgttccttagtttggcgaaaagagtgtgctcgcgagttatctactattgttgtatccagcgagtgttgagcttccagcaacctggatggttccccccaattgaaatggttattgagttaacggccttacttaatatggaaaaccgtgaacacattacccaacgggagggacaaaggcatcagtgctgtgtggccgtgcaatttgccaagcctgtccgagcttgaaa

SEQ ID NO: 552011 - DNA, 209 bp, Homo sapiens
  misc_feature (11)..(11): n is a, c, g, or t
  misc_feature (67)..(67): n is a, c, g, or t
  misc_feature (173)..(173): n is a, c, g, or t
attcggcacgngggggaggatgtatataggttacatgcaagtgctacatcattttattttatataangggacttgagtatctgtgaattttggttatcagcaaggggtcctggacccaatcccccacggatactgagagacaactgtattaccttgcatagtatttattcagntccaatctaagtatttaatgtccaacagttatatga

SEQ ID NO: 552012 - DNA, 438 bp, Homo sapiens
tggctgcatgtattcggcacgaggtgtgtgagagtgagagagagagagagagagagagagagagagagtgagagacttacagcccgtgagagtctgtgcgctggttgggttctgtgctgaggtgatatagatgcccatgcattctctcttccccgccttcgttgcctccatgtatgtcatccctgccctgtttctggtggtgcccatttcgattcactatgtccctcctacgtcttatgtttactgtgaggtgtgtgtattcctggtgattgaggtgaccaatctgattgtcatcatcccgtctgtgatttgattacttcgcgctttttactttttgtgcttctatcttgccatttccctgttgggagttcccccatgtggtttccacgttctggtccttcctcctttccatccttctggacgggtcttcccttgtct

SEQ ID NO: 552013 - DNA, 1528 bp, Homo sapiens
  misc_feature (1035)..(1035): n is a, c, g, or t
tgtgctgctcgtcttgcttttggctgtgtccaactatggcgttagtggtgtcgagtgcgtcgtgtctgtgtttacgattgagatggtcggattagatttgatagcattctactctatggtctgttatctgtgattgattttcgtctgggaagcggtcctcttctgcgtccctgtctctacagacgtgggtggtgtagccctacgcataacttcgttgtttaatggggtgttcttctctgacacagtttgtgttgtcttcgcctctctctcgactactctgtgttgtcggccgtctgcaccgctcgtggtgtgttttctcccacagtggggtggtttgtaatctttctcgctgcgctccccctagcggtggggttgttttgtgccaacgggcgctgtgttgctgtctgggtgggtaatagtatgttttgttgagtagcacatctgtgttagtgtgtgtaggttaatgtgctcctccttcggggtgtgtcttgcgccgcatccatgtgttgccgcccgccgcacactacgggggccttgtttgtgttggtaccgcctcccgtcggtgtctccccttgggttgtctcccttcgtgtgagttatttttgttagtcatcctcgtttgtggggggctgtctttctttcgcccccagggcttcttgtggttgccgcgcacgaggacgcgtgtatctgtggggtgttggttgtccgccctctccgtcgggtgtgacaaccccgtgggtgagttgtgtgtacgcgtaccgctgttttctgctcactcattgttgcgtgtgttgtttttctcctcggtgttctctttgaggagtgaggctcgtggtgcccccgcacgcggtcgctctgtgttttgttccccgcttatagggagattatctctcgcctttttgtttcacatccacccggctctccactgagagaggctgtctctctcacgttttctcacgggcacatgctcctgtggagttgtgaacaggatattatgtgtgcgcttgtgtgttgttttctcttgttgtttgtgtngtgtgaacacatctctgtttgtttcacactctctctatgagcgtctttataaccccactatgtttattgtggctctttatattcgcctctctccacgagttctctatatatacctcgaggagggcgcactgggggcttattattttgagattctcctcgtgatagcgcctcgaggagatctgagggctattgtagaagaggagttcttattttaacctcgctggttctgagactttaatggagttgagcacctcgttcctctttttttatttttgagaaaaaaaaaaaacccctgaaagttcttgggaacccccctaaagttcttttgggaatcctttaaaagccactgggaagttaagtatttagctacataaatgttgtaagatcatattcttatgtatagaagtaataagaccctttggaattactggactaattgaatagttaaggtttttattcgggaccataaaatgtattttgaaagtgctgctta

SEQ ID NO: 552014 - DNA, 804 bp, Homo sapiens
  misc_feature (177)..(177): n is a, c, g, or t
  misc_feature (198)..(198): n is a, c, g, or t
  misc_feature (265)..(265): n is a, c, g, or t
  misc_feature (314)..(314): n is a, c, g, or t
  misc_feature (452)..(452): n is a, c, g, or t
  misc_feature (490)..(490): n is a, c, g, or t
  misc_feature (508)..(508): n is a, c, g, or t
  misc_feature (521)..(521): n is a, c, g, or t
  misc_feature (561)..(561): n is a, c, g, or t
  misc_feature (573)..(573): n is a, c, g, or t
  misc_feature (588)..(589): n is a, c, g, or t
  misc_feature (606)..(606): n is a, c, g, or t
  misc_feature (608)..(608): n is a, c, g, or t
  misc_feature (663)..(663): n is a, c, g, or t
  misc_feature (665)..(665): n is a, c, g, or t
ccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcacatgagcaaccaagagtgtctagttgtaccgcngaggcgttctcagcgaggcangcaagtacctgttggtggatttccaggctgaactgaggcaggctattcttagctgagacaccaaganggtggttaaacgccagtattggagctagcgaggaattctgattccaagncaagaaagccagggctccatctactcatttggaagcttctgcccagcgttgcaattgtgtctagtgagaagcctgcgtcagtagcctttactcgtatagccttccgcctaggtcttcagaagcatcaagcttttaacntgtggacattggattaggtggaaacagcaatcatgacntgttggcaagagtagcangatgctgcgggcnctattgactataggaatgagatgtatcctgcgaagatggncgaatcttcatnggcacctttaagggnnttggacaagcatatgantntgatcctctgtgattgtgatgagttcagaaagatcaagccaaagaatgcgaagcnancagagcgtgaagaaaagcgggttaagggtctggtgttgctgcgctgcggagaacttggttatccatgactgtggacggggcagcccccatagatactggcattgctcgggtaccacttgctgggagctgctggaggccc

SEQ ID NO: 552015 - DNA, 230 bp, Homo sapiens
  misc_feature (2)..(2): n is a, c, g, or t
  misc_feature (22)..(22): n is a, c, g, or t
  misc_feature (27)..(27): n is a, c, g, or t
  misc_feature (39)..(39): n is a, c, g, or t
  misc_feature (42)..(42): n is a, c, g, or t
  misc_feature (54)..(54): n is a, c, g, or t
  misc_feature (59)..(59): n is a, c, g, or t
  misc_feature (70)..(70): n is a, c, g, or t
  misc_feature (81)..(81): n is a, c, g, or t
  misc_feature (85)..(85): n is a, c, g, or t
  misc_feature (91)..(91): n is a, c, g, or t
  misc_feature (112)..(112): n is a, c, g, or t
  misc_feature (121)..(121): n is a, c, g, or t
  misc_feature (124)..(124): n is a, c, g, or t
  misc_feature (141)..(141): n is a, c, g, or t
  misc_feature (148)..(148): n is a, c, g, or t
  misc_feature (155)..(155): n is a, c, g, or t
  misc_feature (162)..(162): n is a, c, g, or t
  misc_feature (166)..(166): n is a, c, g, or t
  misc_feature (189)..(189): n is a, c, g, or t
  misc_feature (204)..(204): n is a, c, g, or t
  misc_feature (212)..(212): n is a, c, g, or t
  misc_feature (218)..(218): n is a, c, g, or t
  misc_feature (225)..(225): n is a, c, g, or t
cnaggtcgcacgcgtgagactntcttnggccgcctccgncgnagacgccgccgngatgngctacgtccgncctcctacctngctngggctngccccaggggggcaactcccnccccccagncgnccaagggacatccaagnaaggatncttgggncaggcgngggntatcgagggcggacgacgacccnccctcaacaaggttnatcagtgnagcctngaatggnaaaaa

SEQ ID NO: 552016 - DNA, 199 bp, Homo sapiens
aagcgccggcgaaaaaaaaaaaccgaaataaagctgtaatagatatacagctatgaaaagtataatgtgttaaatgggttttggtaaatttcgattgatcattgtcatgtcaggtttgaatttttgtgttttctcagtatgctcatgtattttgagagtatcgcactccgtatacatttaagtaacagttagtactgcc

SEQ ID NO: 552017 - DNA, 370 bp, Homo sapiens
  misc_feature (343)..(343): n is a, c, g, or t
gatacaacagttgatatacctccttttaatttcacacagggtcttgctttgtcacccaggctgcagtgcagtgctgtgaatcatggctcactgcagccttgacctcctaggctcaaatgatcctcccacctcagcctcctgagtagctggaccacagggacatgccgcacatctggctaatttttgcattttttgtagagacgaggtctcaccatgttgccaggctggtcctagactcctgggctcaagtgatccccttgccttggcctccacagtgttaagattacaggtgtgagccatggcacccaacgatatcccttctttttaatggcaaggatctttncccttgcaacaactttcaggcctcggc

SEQ ID NO: 552018 - DNA, 138 bp, Homo sapiens
gcggccgcctactactactactactgctcgaattcaagcttctaacgatgtacggggacatgtttttaatgttgtctgtcttctgtgctgttcctgtaagtttgctattaaaatacattaaactataaaaaaaaaaaa

SEQ ID NO: 552019 - DNA, 474 bp, Homo sapiens
  misc_feature (117)..(117): n is a, c, g, or t
ctgacatgatcatccttgcacggctataagcgcgtctgcgtctggtgtctaacgtgcaccgtgtgaagctctctgcgtcctggtgtctgatatgcaccgtgtgaagcgctctgcgtnctggtgtctgacaggcaccgtgtgaagctctctgcgtcctggtgtctgatatgcaccgtgtgaagcactgcgcgtcctggtgtctgatatgcaccgtgtgaagctctctgcgtcctggtgtctgatacgcaccatgtgaagctctctgcgtgctggtgtctgatatgcaccgtgtgaagcgctctgcatcctggtgtctgaaatgcaccgtgtgaagcgctctgcatcctggtgtctgatatgcaccgtgtgaagctctctgcgtcctggtgtctgaaatgcactgtgtgaagcgctctgcgtcctggtgtctgatatgcacatagttcagcgtctgaggggatcctcagagtcgat

SEQ ID NO: 552020 - DNA, 490 bp, Homo sapiens
  misc_feature (14)..(14): n is a, c, g, or t
  misc_feature (62)..(62): n is a, c, g, or t
  misc_feature (65)..(65): n is a, c, g, or t
  misc_feature (195)..(195): n is a, c, g, or t
  misc_feature (204)..(204): n is a, c, g, or t
  misc_feature (206)..(206): n is a, c, g, or t
  misc_feature (223)..(223): n is a, c, g, or t
  misc_feature (248)..(248): n is a, c, g, or t
  misc_feature (260)..(261): n is a, c, g, or t
  misc_feature (283)..(283): n is a, c, g, or t
  misc_feature (338)..(338): n is a, c, g, or t
  misc_feature (366)..(366): n is a, c, g, or t
  misc_feature (480)..(480): n is a, c, g, or t
actggggatatggnagggtttcgccttcaagcacagccaagagaccctcctttgcccttggngtnttctcctgaagagcatggctgttttccccatggagaaaatgaggtctccagaggtttcctgccttgcccaatatccaccaaccccctcagaatctagaccccccctgtttgttcctcatctcggccaggntcgggggananccccattttgcagagtnagccccacccccaccttagcagganaaaacaaaaaannaaaaaataaaaaataaaaaaangagcggataaattctattaggttctccaactgctcctccaggcgctgtacaactncatggttctcgatgacccagtcaaagtncccgaagttgtacaggccacattctgactgagcatcgtccacccctggtgtgaacacccagccccgctgctgttggctcttctccaacgctacaacgcggaccgtctgcgttanggccccatag

SEQ ID NO: 552021 - DNA, 696 bp, Homo sapiens
  misc_feature (334)..(334): n is a, c, g, or t
  misc_feature (525)..(525): n is a, c, g, or t
  misc_feature (596)..(596): n is a, c, g, or t
gcggtggggtgaaggatggcgagccggacataccattgttggatgtatttttcttaaaacagcaataattagccatattcaaaggacgggatgtacctgtgctgtgtgcactgtgcaccgtgtatgaggcgtgtgtgtggtgtgtgcaaagtgggttcattggcatatgtagtagctgtagagacatgtgtgctatggtgtgaagccttagtcgcacgatgcagtagtagtaggttgcagtaaggcatgctacagggctgctgagctagtgcatagtgctggtgtacgatctgttgtatatagtggtggtactagtgtttgaagtgagtgttgngtggtacgatggctgatgcagcggacagctgttattacgagtgctgacgggtgctgagtgatagcagcaatgatgctgccgatggtagcagtgcatgacttaaggtagatccttaggggatactgccgaatagatgcgaattgctagcgatagatgctaatgacacatgctgacggtgagtgaatgatgcnactgcatgcaagctgctatgtgctagtcgtagctagaatggccgacgagtgataacgttcgagtggttacntgtcgtgcatcgaaggggagaagcaacaaatagtggtcatttgaggtggatcattgaagatgacgattacgactatagacataatggatagtacagtgaa

SEQ ID NO: 552022 - DNA, 531 bp, Homo sapiens
ggtttcctgtggaaaaccttcagtggggttttgcccttgggctcttggctctgggctggaggtccccgtgtaagggaggtacccctagaaggtctttagtacaaaactgctctaagggccacctggtgattcctccccaagggatggtttaaatttcccataaagagttttccctttcccaaggttttcatgaggccaggcgccatatatgataaattatgttccgtgataacttggttttcagaaatcagccagggggttttcccccccatgattcccctttgatgggtttttaaaaaccaaaggggttttgaaaatctttaatggctccgaaaataaaacccccccgtttggggagggctatatttagatttttttagactttaggggaagccctttggaaaggccctgccccccgggcttggactgctaaaagccctttttgtttcccttttgggggaaatggatttatgggggggctttaaccaaatacccatccttataggctgaaataaaatgaaccttccaata

SEQ ID NO: 552023 - DNA, 785 bp, Homo sapiens
atcatttatggggtgattcatctcaaagaagcaaatggagggtgggggcggtggctcacacacctgtggtcgcagcactttgggaggctggggcaggcaaatcacctgaggtcaggagtttgagaccagcctggacaacatggtgaagcctcgtctctactaaaaatacaaaaattggccgggcgtggtggcgggtgcctgtagtctcagctgctcgggaggctgaggcaggagaatcgcttgagcctgggaggcggaggttgcagtgagccgagatcgagccagtgtactctagcccggacgacagagggagactctggaagaagcaaatgggctgcagaacaggttgtctctgggcccggtgcggtggctcacgcctgtggtcccggcactttgggaggccaaggcgggtggatcacaaggtcaggagttcgagaccagcctggccagcatggtgaaaccctgtctctactgaaaatacaaatttagtcagggcatggtggcggtcacctgtagtcccggctgctcgggaggctgaggcaggggaatcgcttggaccgggtggcggaggttgcagtgagccgagattgcgccactgcactccagcctggtgacagagtgagactccatctcaacaattacacacaagacacacaaaattatctgtggatttggcctggcctggttgaacctcacttcttgcttgtcctaacacatagcttgaaccagataattctcttcgaattttctaccctagatgatcttgtgggccaaaacaggaccca

SEQ ID NO: 552024 - DNA, 154 bp, Homo sapiens
cccttcgacttggcgggcaccttatgcgcgcttacctatcttaccaacgcttcgagtgtcagagattgaagagtacaaagtctgaccaagatgttgatgttggataagagaattctactgctccccagctcgtctaagttgcccgccaatcgaa

SEQ ID NO: 552025 - DNA, 317 bp, Homo sapiens
caggagttacagaccagcctggccaacacggcgaaaccccatctctactaaaaatacaaaaaattagccaagcctggtggtgcacgcttgtaatcccaggttcttgggaggctaaggcaggaggatcacttgaacccaggggaggctgccttgagctgagatcgggccactgcactccatcttggacatcagagcaagactccattttataaagaacaaagaaagaacttcaattttttaaaagttttttcctttcattgaactccattcataggctttccattcagagcataaagattaattttaaaacaaggctt

SEQ ID NO: 552026 - DNA, 309 bp, Homo sapiens
tgtgcctggcgcactatactatagtaccgccggggagatgatgaagagattataaccaagcatcatatagcaaggactaaccccatataccttctgcattcatgaatttatctaggaattaactttgcaaggatagcccaagcttataccccctaatccagaccagctacctacagaacagcttagagagcacacccgtctatgttgcacaatactgggaagatctataggtagaggcgacgaacctaccgagcctggtcttagcttgtttctctgcttgtagtgtcatagttcacttttaaatgtgcc

SEQ ID NO: 552027 - DNA, 193 bp, Homo sapiens
cgaaacagtgtgtggtatgtttggaagaggtacatatactgctgttatcattttaccagcaaaccacctgccatgcaagggctttgacagcagcaatagctgcagcaattgatgggcgcttcacatacacattgccctgagctgaatttttgtcaagcctaaatttgaataactcctccatgtttattacatt

SEQ ID NO: 552028 - DNA, 428 bp, Homo sapiens
tcgtgacaaattttggtcaagtgtctccattaaaaagtactgatgttaaaaactaataacttaaaactgtcatacgcgataagagactaacaagagtggtccacaaagatattctcctttccttctgaaggttttacgatgcattgttatcattaaccagtcttttactactaaacttaaatggccaattgaaacaaacagttctgagaccgttcttccaccactgattaagagtggggtggcaggtattagggataatattcatttagccttctgagctttctgggcagacttggtgaccttgccagctccagcagccttcttgtccactgctttgatgacacccaccgcaactgtctgtctcatatcacgaacagcaaagcgatccaaaggtggatagtctgagaagctctcaacacacatgggct

SEQ ID NO: 552029 - DNA, 858 bp, Homo sapiens
  misc_feature (13)..(13): n is a, c, g, or t
  misc_feature (438)..(438): n is a, c, g, or t
gggtgtggggtanaagtgggggggggcgcccttttcctctttcctacccttttatggctctgtgcaccgttccacagtggagattatggtgacaacttgcagtctgttcagccactctgtccggtcaatgactctgggcaggtaactcgctctccaaccttattacaacagtatcttctgggggggcgcggctaacttgcgccgaacgcctgcattagggagggcgcaagatttattacttgcgttgcgctcgcctcagaccagttgcccacaaagttactagaaaaatgccttaccaatcgcgaaaggattgcttagccccgtcgatggggcacgtgcccccaactctgaaccacgtgtttcagatcgtgccaccgcccctggcggcttgttttcttatccagctttgccctcccgcaacggtgaaaaatacccgcntaattttccggggcatctgtgcctctctaactacatgggcgcgaaagctagacccccgccctccaggtccaggaaatttgggtccggggaacgtccaaatcgtttcttatctgcgtaaacgcagtggataatagccggccgagcttgtaataaaaggctataaaattccttcgcgccccggtccctactgtgcaagaacgtctcagtctcgcagagtgtggcgggtaattccgctataattattcatccacaaccttgtataataaaaaaaaaaccttatgacagactctttcaccctcttaaccgttgcccaacacacatatgcaccaatccattttcagcttctgttcggcgccccttaggtatatatattatcttggtggccattctgccgtgccacgggagattaacaaattaata

SEQ ID NO: 552030 - DNA, 693 bp, Homo sapiens
atttttgtacagatggtgttttacacattgctcaggctggttttgaactctggggctcaggtgatctgcccatttcagcctcccaaagtactgggattacaggcatgagccaccccgccagccccatttcattacgtagccacatggttgtgtttcacagttcactgcagcctcagcctcctgggctcaagcgatcctcccaccttagtctactgagtagctgggtctacaggcacatgccaccattcctggctgatttttaaaaaatttttttgtagagacagggtctcactatgttgtccaggttggtctcgagctcttggtctcaggcggtcctccctccttggcctcccaaagtgctgggattacaggcgagggtccccacacccggcatcacatggttaataactatgacttccgacgtgggcgcaggggttcacgcctgtaatcctagcactcacgggaggctgaggtgggggaatcgcctgaggatcagggagttcgagaccaaggtctgggcaaccataagtgagaccccgtctgctacctacaaaatccagggtaaaagccagcgcggaacgcgggggcactgctgctcggcccagccagtgccacccaaggtcgacgttcggcgcgcggcgccttgacctgctaggaggccggcgcagcgccggggctatggcgcggcgcacc

SEQ ID NO: 552031 - DNA, 1381 bp, Homo sapiens
gtggcggtgcccaggtggagcgcgtcgggcccctggatccgcgggagaacggacaaggttgcgggaagtctccttcacatctcgtctcaacagcccaatttctgtgtgccgctgtgtgctgactgtcatcataccggaccataatattgcctcagtagaattatgcggagcaaggcatccgaggcccatgaaacgtggaaccagagacacacagagaacggagcctggttgtccacgaacagcatggttcagcgtgaggacgtgcaataacataggtgccgtggtcacacgggtagagcttgccaacagagtctcactcgccaactgtgctctgataagtgcactgacgccgaggacattctctcgacctagggacgacgaaccgttggtgtgtcgatcgaactaagtccgctacgggtcgtcaccatggtgtcattgtgctgggcctcatggtggtccaaggcgtcttgcattcagcgtgagtggatactaccgtatccgtggccaagagatcgcttccatgggcaccactacacggccatggagccccttgccatctagttgccgaacggagcatggaacaaaggaacaaccaacgagagttgtaaatcggtagtttggctgtcggggcacaaccagtgacgatcggtcacattcccacagtccaaacgacgtctgtcttaggaaccctgtcaagcgctgggtgacacgacaagtacctggcgccgatcacttgtgcattgtccctcaatggacccttcagcaagtggacgtccgatgggcactatcccccattcgtgcgcacgacagggacggcgccaagcggccccagcacgccataccgccacacaaggatgcacccatttggtgccccccgaagattactcgtgcatttgcacccgcacggggcacacctcggctggtcacagctggatcgggcgcacacccgggactggtcgccacattgagcttcacgtccccggacccccggtgtcgcccagcagacacacctcttatcctctcgaggacatgcctgatgggagaccgtcccaagacgccaatcatggggggaaataacaaacatacaactccgacgccgtccaacggaacatatcgggccaggtgactggtgatcaccacgtggtgggacccaggccgcgaccggacggaaatggggtccaccccaaattcacgttgtggaccccaagaaacagggggtcgcacagcggggacaccgttttcccaggaggaacggacggagagacaccgggtcgagacgaacacaaagtcgcactgacaaccataccacgaagagacagcgagacaacacgcgtgagcgacgaccgagcgaagagcgtgagcagccacacagaacaccaca

SEQ ID NO: 552032 - DNA, 185 bp, Homo sapiens
cccacaaagactcgaaggagcaagcactgatgagcgagaagtagaaaaacagggcgcttcgagcgctaaacgaccagcttttggcggagcttgcccgaatcgcttctgtaaaccagcgcctccttttcgaaatggctgagttaaaagcggtctccagcggaaaggttgtggctctgactcagaag

SEQ ID NO: 552033 - DNA, 318 bp, Homo sapiens
ataaaccggtgctttttgatacattgttataccattttagacctggtcacacttaaatttcattcatggacctgctgttttactagacagcttttcaaatatattcatgctatgccaaagaaaaatgtttcacatttattcttcttagttacacatcttttatatctgaaaatagtgttctcattatttagaacaatggaaaagactacttagttcaggttaaaaatcaaagaactgaattagtttgccaggaagaatatctgaaaacattattcctcaaaccttggtaatgaactgtgtctccacagatttacacac

SEQ ID NO: 552034 - DNA, 648 bp, Homo sapiens
ttaccgtaagcataaccaacccagtgatgtatggacctcgctgattggtagcatgttgggagggcaccgcaactacctcaatggtgttcggggctggtgctgcactagacggaacctgtgcgctctgcccgtcgatacctggccgcctttacaaggaagacgatgtggtattcaagaaggcccagaaatttggagaagcggatgaagttctcctttaattacgaaatcagctccttggtactcccgtagagggtgatcttgaagtactccctgtattgagaaactttcttgaagaacaacataacatgctagttataattagtgctcaccactcggacgagataactcgtaaatccagggtaaatccttatgttgcccaacataaactcaccgggctggcaacctggaacaaaagtcctgatccagtaatcacacttcttttacctaaacaggacggaggtgaaattgtagctctaatactatttcagctcatagatagtgacatacatctttagcgagtctttatcttctcagagaattgcatccctgccaggcctaccacataccaattcccctggaattagttgtcctgaagtccgctgtgaaatacaacggtacgaactcaatcgaactggctactgaaaaagg

SEQ ID NO: 552035 - DNA, 159 bp, Homo sapiens
caaggttaagagaaagcatcagcgtcagacattccctgaacagaaggagggctggatggccttcatgacacctcacaaatacaacactttcacatgatttggccctatactgttaattttcagtacagacattatagaataagtcacttcattcttttc

SEQ ID NO: 552036 - DNA, 988 bp, Homo sapiens
  misc_feature (988)..(988): n is a, c, g, or t
agcggagctgtttgtctgttcgacacaggcttggggccgaagggggagacggagccccaggagttttgaagcctggaaatcccctcccttgtgtgatctcatgagccaaaaagacagtgtcctgggtctagtcagcaaacaagtatggagctagcacaaagagctagagagataacctccgatccctacaccgtcgagacacacaagacccactacggtaacagcaaactgagccctggcctcccaaagggctggctcacatgacaggatccgtcatggacacttggaaaacagctatcaggaaacaaatcaccaggcaggatgtaagcacactgagacttactacacccatactcctgggtgctatgagggttaaatccacctacaggacatatagccgttcgaaaaagaagactcatcttcacgtttcggactataaaaggtaccaaaggacagaagacttacgtaatctattggatccctacgattcaactaggagtatccctccacaaagcttctgcagagagagtggctgctgacgtcctgtacaagtcaccactctgtgacttgtgtagcagccccctgttacttgaagccgaactatgaatacgtctacacgaggattgcagacgaagtgtgtggatcctggactggcaggcaagaggtaacaggtgaaattacacttaagggccctggtcgaagaactacagacaaggcaagaagcgaaacagagaccgaagaaagaggtaaaaaaggaggacaaaaagtatagaagacatgagcatccagaacgaaggaaagatccattgacgacgaaaaagaggcgcaaacgaacaaccgccaactaagaccctcacaaacaataaaggagcgactccaaacataggtatgacgacaatatgcggcaaatgatagcacagaaaaaacgtacgcgaagatctacaacaacaacaacagaacaagagagaagaaagaatgatgtcctatn

SEQ ID NO: 552037 - DNA, 387 bp, Homo sapiens
  misc_feature (60)..(60): n is a, c, g, or t
  misc_feature (65)..(66): n is a, c, g, or t
  misc_feature (70)..(70): n is a, c, g, or t
  misc_feature (72)..(72): n is a, c, g, or t
  misc_feature (74)..(74): n is a, c, g, or t
  misc_feature (87)..(87): n is a, c, g, or t
  misc_feature (98)..(98): n is a, c, g, or t
  misc_feature (119)..(119): n is a, c, g, or t
  misc_feature (132)..(132): n is a, c, g, or t
  misc_feature (169)..(169): n is a, c, g, or t
  misc_feature (218)..(218): n is a, c, g, or t
  misc_feature (251)..(251): n is a, c, g, or t
ggcagctgttaacagataagttaacttgcatctgcagtattgcatgtaaagggataaggntagtnnttancnangcgggagtctaantatcaccaggnacttctccgaccccttcctangggattcaggatngagaaatttccatcgagccttttaaaatgtaggactngtacctgtgggcttcagtgatgggatagtacacttcactcagaggcatntgcatctttaaataatttcttaaaagcctctanagtgatcagtgccttgatgcccactaaggaaatttgtttagcattgcatctctgaaggctctatgaaaggaataccgtgatgtgctgttgtctgctgctgcagcagacgacagctaacggaagccaagtaacttta

SEQ ID NO: 552038 - DNA, 201 bp, Homo sapiens
gtttcaacccacggggaggctgggctgggggctccgtgcaggagtcgagccacaaggcatcttgagcgtcccctgcaagagcatcaagataaagccaggataattaacgccgtcaggcctggggcgactccactaaatcctttgtggcggcctgaggctgccgtctctcctccaagggctgggggtccccttcccatcttt

SEQ ID NO: 552039 - DNA, 664 bp, Homo sapiens
agaacacagattgatgatttaacgaaactttatgaatgattttagggttacagccaagatcctacttctgtaatctatggatcaactactaaactaaactagagagggagaaaaatcagacgagatttgatcgatagacgacaaaattcgtacaccagagtgctatggattctttcattgaaaactagcagcagcgaactgtagccatgtggcagcagcaaggccgaactatgccccagtcatttccccttcacatgacttacgtaacacggagcacaagaggggacctgaggtcaccttcccaatgggggttcatgcacttccatgtcccagcatgttaataccatgataaagacgatcaggaacgcacaagaacagacgcagactgagcaagttaggaaatcatacattgaatcccaatgcaagacggagttcaacccaacgttaccttctctcgagccaagagccttgctactaccccaagcttcacctcgggctcaagcacaacctagcccatctatggtgggtcatcaacagccaactccagtttatactcagcctgtttgttttgcaccaaatatgatgtatccagtcccagtgagcccaggcgtgcacctttatacccatacctattacgcccatgccagtgaatcagccacgacat

SEQ ID NO: 552040 - DNA, 625 bp, Homo sapiens
  misc_feature (9)..(9): n is a, c, g, or t
  misc_feature (87)..(87): n is a, c, g, or t
  misc_feature (242)..(242): n is a, c, g, or t
  misc_feature (276)..(276): n is a, c, g, or t
ggggtccanaaaccgaacccgttgtttttggtaatttgtggcgccccccattgttttcccccggagaagggcccctccaaggggggnatttttgcgcgggcccaaaaagcgtttcgccggagaggggtctcttttttggggtgtgtccctcccaggggtggttttctccccaaatagaggcgggggccccccccaaaaaaggggctttcctggggtttttgtggggggggcaccacccccgngtttggttttctaaagagaggaggagggcgcccngggatttttgggtggggggccttttccccccccccaatggggggggcccccccgggggcgccccaaaatttaccccggggggttttttttccccccccccttggggggggaggccccccaaaaaatgccccccccacccccggtttttttttgggggggggccttaaaaaaccccccccccccttttaagggtgtgtttttttttccccgggggggccccgtttttttaaaaggggcttggggccgggggggggtttttttttttttccccccccggggggggggctttttgggtttttttttgggccccccggtttttttggccccaacccccccttcccccttttta

SEQ ID NO: 552041 - DNA, 104 bp, Homo sapiens
ttgcatcttgcatggtcgtctctacacggatccccttcagcatttatcatacagtaccttcctacagtattactgactaattttggggtgggtgtttatcacta

SEQ ID NO: 552042 - DNA, 166 bp, Homo sapiens
  misc_feature (147)..(147): n is a, c, g, or t
cacgtagagccgtcccaatcaggatcccgggattgaaggtctgtctaggtcggcctgttcaccaccaactctacaagttgctgtcttccactcactgtctgtaagctttttaacccagacagtatcttcataaatagacaaattctncaccagcacatcttctagg

SEQ ID NO: 552043 - DNA, 1854 bp, Homo sapiens
  misc_feature (336)..(336): n is a, c, g, or t
  misc_feature (340)..(340): n is a, c, g, or t
  misc_feature (348)..(348): n is a, c, g, or t
  misc_feature (386)..(386): n is a, c, g, or t
  misc_feature (553)..(553): n is a, c, g, or t
  misc_feature (571)..(571): n is a, c, g, or t
  misc_feature (1245)..(1245): n is a, c, g, or t
  misc_feature (1279)..(1279): n is a, c, g, or t
gacactttaggttccggatgactacgctgtgaggtgaagcatgtctcgaaggcgccattcgcacgacgaggcagaacgacggttggccgatcgcggctttccgtgaaactggagacagcctgattcctgtgcaaagcttgtaccaggcgatcaagtgtcgtgaccggtgacgcagcgtgagcccgtgcatggtgaccgacggtacccgtctcaggtgatgtaggcaagacgtagggtgtaagaccttgcttaattgcaccatgagtacactcgtctgatctcttatgatgtttatgctctgctgtgggacaacctccggaatacaatcctctaggngtgnattggcgntttgtctgtctctataatatggtcgtctgcctctgagntatctgctcggaaagactagtgaagaacgtgccaagcaaccgaacacgtctcgggccggtgcacacgggctaaccccacgacagacgtgcatgtgtggcatgaggtgaggtttccattcacccggagtgttcatgtacatgcctggcatgtgcgtgttatctatacntctctgtctacgcaagcntaaaaaccaacagttatctctggtaaacgtgcgaagcatcacaagggggatagacggtttggtgggctctctcggacagtctaatctgcttaccaggtgggaaagcgcacgcaaaaaccatgtggtagcgcccaagggctcttcgtacccagtacgagtttactcgccccagtgatagacacccccacctgggatcaaccggtggtactgggttccgtttgtcggaccgacttcctatggaggggttccgttatcctatccaatctgtctcgtgttttggtaggctccaaaaaaagcggggccctattgttgggcattatgtacacttggaacaaatttgagggtgggctttggcgaaggaatgaaacaaacgccatgggtccgttggaagttagacggggaacatgttaggagcagcttttcggttaaaaggcccgtccgaatagtctggttgatttgttagaggatttacggccaggtctctgggggaggcaaaattaacgtcgttaaaaaagaccagtctattgctgtaaggacacgaccaaaaacaattgtgtttagctttggcggagcagaatgtatcctacctctggtaaccccacatatagggcctggtgtaagccacgggagacgacttttttttgccgacttcgcgacggcaacaaaataggaancctcggtgtctcaggtaacttcaaagagaaacgngttattctcacgcagggcgcgccccttgtatattttcgcgggcagtccaaacgtttatctctagaaccacacttgtggtggctactccctttttatgccctaaagaccaggctcttgagaggcagattttctttctgtgtcccccggttggggcccatgttctgtgggcccgttgtctataactcgcgtgggggtggggtgggggggagtcttggccctttaatggccccgaaccatagagttggaggaatggggctcaaaggtgttgtaccccaagcggagccagtccggggggcaccgtacccccggtgtgtgtcaccgaacaccccaacagcagaggagtagctcactgcccaacaaccctggtggcggtgggcaactacccaaaaagagagggcccgtggaacaggagcccaacacagagtgtcacagcgagacgacagcgagcgaggcagcggcggggaacaagcaccaataggaacatactcgaggcgaaacgcagaggagtcacccgtgaaaagtaggacatagtcgagcgaccagagcaaggactgtactacatcagcggacgagag

SEQ ID NO: 552044 - DNA, 1015 bp, Homo sapiens
tggaccacgcgctgtagtatccgtctgcgtgctgtcctgtgcccaatgatgacttaccaatgacagacgctatgactgagtgctgatgtgaatccaaatggcctatccccttgcctgatgcccacctcaccaatgaagctactgtgacctctgttcagcagtcatgtaactataagcatgctatcgtgaaaggagccaatgagtgccaccaaaaccctcaacatggggcatctctgatgttcatctgttgatgcgctagcagactgcctgagccactggcagatcattcttgcacctgcctgctgctagtgtgaagacaacgaatgtgccctacgtgtacctgttgcgctccaatgcatggccctgtggtgagacgccatgttggtggtctcccatgtgcctgtccatctgcctgcttcttgtccacccatctaaagaatggctctgctagcttgcacacacagccagatccaaatccatatcagacacgtacaccattggaatcaggctactatagtcctcacacacctgtcgcgccttcttgcaacacagatagctaccccttgacccagacctataccaccacctagagagtactgttgtatccatatctttactcctagctgtctccagccaatttgtaacggcacactcctgcaccaccgcctaaccctgcttcttaattctgattcaacgtaaaacaaacttgttacaggtacccctaacacactcctttgggcctatcccatcgggcactccttccccggcacgtttctgctcacacgcgtaggctgtacacttgtgtaggatgtaaacaatgacgagccatttcgagccgtaaatatcgcccccgacctttgatacccataatatccacgctatccccctgtccacagtttccttgttgacaacttacgccattccaaataacccctcatgcacattaccctccgcaccatgttgacacctgggaaacacccaccaggtgcctacgaggaaagcaccagcacaagac

SEQ ID NO: 552045 - DNA, 928 bp, Homo sapiens
tggtggagaagtgagtgagtgctgtgctgagcgtgcattagcgaggagtgagtgcgtgcacagtatgaccggcagatccgcctgtggggactggaggcccagaaacggctgcgggcctctcgggtgcttcttgtcggcttgaaaggacttgtgggctgaaattgccaagaatctcatcttggcaggagtgaaaggactgaccatgctggatcacgaacatggtaactccagaagatccctggagctcagttcttgattctgtactgggtctgttggcctgaaatagtgtgctgaagcctctttgcgcagcgagctcacgaatctcaaccccattggtggcactgtgacaggctggacacttgagtgatatacgagaagcaaaccacgagctcattatttcactcaatatcgatgctgtgtcgtctgacttgctgctccagggcatgtcatagttaaacgttgaccagatctgtcacaaaaatagcatcaagttcttcacaggcgatgtccccggctaccatggatacacatttgccaatctaggagcagccatgagtccgtagaggagacccctaaagttgccaaagttagccacggccgtcgcccgatgtggccctgacaccaagagatcaaaacttgattcttctgagacaacgatggccaccccgaccgtggtcttctgcctgtccaagaaccctgaaggtgcacctggacgcacagagcaaagcacgcgctagatcctgaagcgtccacgagctcggactaactatcctagcttcaggctgcctcaagagggttccgtacagaattcagcgaacgacgatcccagctactgtcatcacctctcgtgtacgactccgcgaagtgactgccccaccctcagcacaagagtcagtagcacaaagagcacgacagatccagtgccctt

SEQ ID NO: 552046 - DNA, 151 bp, Homo sapiens
atttaaattgatcagatggtaagatggtttgttgctggagggctgctgttggtcttggagcattgtgctactatggcttgggaactgtctaatgagattggagctattgaaaaggctgtaatttagcctcaagtatgtcaaggataagatt

SEQ ID NO: 552047 - DNA, 116 bp, Homo sapiens
ggacgggccagagaagatcgtgggcatgtcccaaacttgtactcaatgttcttaattattaataatgtgaaggaaaaaatgtatgagtaaaacaaaactccaaaaccgtttaaaca

SEQ ID NO: 552048 - DNA, 518 bp, Homo sapiens
caggaatcagaaaggcgagatgtggcagaaaggcagaatgtagggaatgtgtgagtatcccacagccagctcacagtgcagcttgcactccgaacggagactcaggcacacaaggtctcaggatgcacagtatcagctatggccacatgtacctaggctggggagagggagaccattcacacgcctgtgcttggccgggtgtggtggctcacgcctatacatcccagcacttagggcaggctgaggcgggtcagatcacttgaggtcaagaggttgagaccagcctgaccaacatggtgaaaacccatctctactaaaaatgcaaaaattagacaggtgtggtggtactgcacctgtaatcccacctactacaggacggccgaggcaggagaattgcaagaacctgggagtcaggagagttgcacgtgagccaaagatagcgccaatgtactccagcctgggtgacagaatgagactctgtctccaaaaacaaaacaacaacacacaaaagctgtgct

SEQ ID NO: 552049 - DNA, 453 bp, Homo sapiens
  misc_feature (406)..(406): n is a, c, g, or t
  misc_feature (424)..(424): n is a, c, g, or t
gccaatttgctcgcagtcttaattccactctctaagaatgatgagtctttccgttcacttctgcacagaagacaataatccccagcagggtagggtggtgtcctatgattcatgccaaaactaaaaggagtctcgaagtagcctccgggggcggcgccgcccgcgctcgcgcccgcgccgagaggcccgttggccgccgccgcgccgcccaccaggcatgccgcgctgcccggggccgccaggcccgcggcctgggaaccgcgcagcgccgccgccgggccggccttgccgctgctcgcgccgccgttacccccgcccgagccgccgccgccgccccgcttgttcttccggcgcttggccccgcgcttggcgtcggctgggctcatcgcgttctgacgcagggcgngaagagcgggcgcggggnccgcagcaggcggcggagggcggggaagg

SEQ ID NO: 552050 - DNA, 140 bp, Homo sapiens
cgggcatgcggaacaccgtgggacgctcaaagataatgctatgttgtaatacctgaagattgctcaggacctggagatggatggaatcaactatttcgagacaaaaaacaagaaaggaacagacctttggcttggagttg

SEQ ID NO: 552051 - DNA, 181 bp, Homo sapiens
aagatttaaatgttctatataacacttagatttctgatattttggaagaagttagaagttaatgaaagcaaactcagataccaattttctggaaaatatccatgtggtaatggtagactttttaggtggcactgtttggactctgggcactgtttggactctgagcactgtttggactctg

SEQ ID NO: 552052 - DNA, 131 bp, Homo sapiens
  misc_feature (63)..(63): n is a, c, g, or t
ctaaggatccgggatggagctgagctggatcaatctgttctgctctatgtcctattgagctgnataaatgtactacgtgtttcagatctgcaacattacaggcacagggcgtcactatcagtcccagctgc

SEQ ID NO: 552053 - DNA, 180 bp, Homo sapiens
gaggtcggtctatgaggactcccgattcctgtactaagcacatccacaatggcccttttgtcgagatatcatattcacaaatgagggggggtcaagatgtgcactctctgattatcttctattatctatctcgatagatagatcatagattatctatctctctagatagataattagatt

SEQ ID NO: 552054 - DNA, 648 bp, Homo sapiens
atagctatcctgttaagtgtcagaggagactatggaaagccattacatttcttcaaagcgctactcgataaccagtggtaaggagatcacagagaagtgattacagacattgccgggtaataccagctgagaaaattgatggagtatttgctgcctgtcagagggctctttgacaaactagaagctgtggtcaaggtaaagtcagcttactaactttggggaaaggaatattaagtcatcataccaaaagttttttttattataggatttaatagatgagggtcatgcagcaactcagctcgtcaatcaactccatgatgtggttgtagaaaataacttatctgataaacagaagtctattatcacagaaaaacttgccgtaagtaggtactttgcacatgtcaatggaacatttaactacctgaaggatgctaatttcttaaatttttctcgtaggaagttgacaaatgcctagcagatggtgctgatgaacatttgcaactcatcagcctttgtgcaactgtgatgcagcagttatctcagaattgttaacgtgaattatctcagaattgttaacgtgaatatatctggatggggggttttgtaaataatgaagttgtaataaaaataaaatgaccaaaagcaaaa

SEQ ID NO: 552055 - DNA, 473 bp, Homo sapiens
acggcggccgcttcgcacgcaacgcagcaccaaatcgtagtcctgcgaaccgtcgcactcgctacgcgtcaagcccactcgcttgatcagatcgtgttcgaaactgaccaggtgtcccaggtacatctgcgccaggaacaagtcgtagttccaatccggcttgaagtacggattacgcaaccggccatcctcacccaacatgtcgtggtcggtatagacgacagcgcttcctgtcttgatatggcaatccactaccgccgccaacgcgttgcggtcgagcacgtcgtcgtgatcgaggaacgtcacccaccgtccgcgcgctgacgcaagcgctgcattggtggtggccgcgatgccggagcgcgtttccgaccgagtgacacgcaggttgggaatgcgcttcttgaactcggccagtatccggcccacgtggggctcattggacgcgtcgtcatggatgcaaatttcccagt

SEQ ID NO: 552056 - DNA, 266 bp, Homo sapiens
agtgaggtgaggatagaggagagggcaagggagagcaagtcgattggggatggagaccgccgttcgtggggtatggggaggggcggtcggcttgtggcagaggagatagctcatgagggagacggtagggaggtattctcctagcgtgagcagttagaagggggcctgcttttgtaagcaggaaagggcgtgccgtatattaactcacaatggacgtgaggaaggagggtgcttatgggacgtgggtcctctgctctccagtgggt

SEQ ID NO: 552057 - DNA, 439 bp, Homo sapiens
gggaaccctcccttttagtttgcccgtttgcgcggttttcccccccccccccgggggtataaatgtttcccccgggggggggggccccccctaaaaacccccccccttgggaaccaaaagggggggccacctttttgttagggttgataagccagtggtcccgtggcccaatattcccccttttgtgaaaaaaaaaagattgcccccggggttggggggtgccccttattctcccccgtttgggggattgtctgcagggtttttcttcctgcccggagcgcatttttctaggagctcatttgtttccccgcccaactctctgggggcttgaggacagttccccccccccggccaatgcccttctttgttctgctgatgaggcacgtcataaaataatggtacaacaaaatcttcccgtcttgttcaaaaaaaacagagt

SEQ ID NO: 552058 - DNA, 261 bp, Homo sapiens
gaaaaaaaaaagaaagaaagtctgggaacagtagctcacacatgtaatcccagtactttgggaggctgaggtgggtagaggtcaggagttcgagaccaacctggccaacatggtaaatgaaaccctgtctttactaaaagtacaaaatttagccagacatggtggcaggtgcctttaatcacagctactcaggaagccgaggcaggagattacacttgatcctgggtttcagaggttcacagtagctcacatattgtaaca

SEQ ID NO: 552059 - DNA, 398 bp, Homo sapiens
gcttggactgcagagcccggcccgacgccgccatgagcgccgcgctcttcagcctggacggcccggagcgcagctgcgccctggcctggcggcagcctaggagccgccgtggttgcccgcgtgcaggtttcgttgggacataggagcgcaaagaagctacagccttggacgttacgcacacagttaaactgcgagagaagctaaaccgtgtctatagtcccttaaacttatattcggtaatgttaggcttctttctacaatcttacttccgtgtttgcatgcagtctaccggtaccatttgctaaggagcgaccccatctaaccacgagcttttcgagacggaagccctttgtagtggctcgactaagaggaaaagactgagcatgctcacttatcta

SEQ ID NO: 552060 - DNA, 846 bp, Homo sapiens
  misc_feature (157)..(157): n is a, c, g, or t
tgtggtgtgattgcttgtgtgacctcttggtcggccccgcgattctttctgcgggattctcgtgcccggggcccccgtctctctccgtgactggcaagttctcctgccccttgtttgccccgccgggtccgcggcacgcaggcattctcctcctctngcacgcaggggatgtctgttctgtgtgcaccgccccagcggccctgtgtcgttcctggacagccgccttctgccgcgcctcacttgcccccccccaggtttcttggtgcgacggggtgtgccccttgcccccagtgcgacccccccattcctctcatttacaatgtgaagattgttacctcccccgagattgccccccccacggaaggcgcttattttccataatactatcgacgaccctgtgagagagaaatctcctcttgataacaaaaaaagtggaccacccaattctggtaagtacaaaatgcttctccggctcttcatactcaacttcttcttatcatccaccccggagatgcaactcggccctccctcttttgacaagtctcacaagagatacatcttcccgctccctctttcatacaaaaaattgctgctccccaaagttgtattatcccacaaacaggtttcttttcccacaacaacccccttatgaattttttaataaaggcatacacccccccccatcgttccagtgtttacaatagcatataatacttgtgccaatctgtattgaacagcacagacaccttatggtaggcgagcagacacacggatatgggggaagccccaaaacaaaaaactggccaacagcccggaatcttcaaaaaaaacgcccacaaaaagaca

SEQ ID NO: 552061 - DNA, 283 bp, Homo sapiens
tatttgtggtcgatcagaggatccccgatgggcacactcgggcgcgctcccacgcttcacggttctggatgacaaagaccgtcaggcactacacaccttcttcacgaagtttgcgctgctctctgcgcgagttgctgtgcctggcgcaaatataataattgcgtctaacccactgctgtcgcacatagtcgctgacgcgatgatttccgcaggtttggagctacgtggatacgtcgcacgccaagtaactgactatccaaggttaacgggatcctgctagctc

SEQ ID NO: 552062 - DNA, 206 bp, Homo sapiens
tggccaggctctctactttccggctagctgagctctcaggtggtttggtgggtagaaccttcttcaagttggaattaccaggtaaaactaactaggggcccacggcgggggattctttatgttttcccaggaagcagtagagctcaccgggctgggcatattctggaaaaaagagagtctggctgtgatacagaaataattcagga

SEQ ID NO: 552063 - DNA, 160 bp, Homo sapiens
ctagttatcccagatccggctgttgaagggccgactgaggcatacagatatcgcaggctctctcccagaaccatctgctcctggacgccctgtgttagaaggctgaagctcacccgagctgcaggccctcatctacaatgtgcagcatgtgaaatgggaa

SEQ ID NO: 552064 - DNA, 246 bp, Homo sapiens
  misc_feature (213)..(213): n is a, c, g, or t
taaatcccctttctgggatattaatacgggtatgtcagcttccagtgtttaatagcattggcaccttttactttttcacttttcattttgagcattgttaaattgtttcattataaatgtagtatactataaatatataagtatttatattcagcgtaaaaatcatttcttagtcgaaatatttaatctaattgtaactgatgtaattaatgntacatttgcattgaaattaaccatcttaatagt

SEQ ID NO: 552065 - DNA, 321 bp, Homo sapiens
gggaggggggccccccccgaaaagtttttaaaggctggggggggaggctcccaatggccgggttagattttaattttaagggtggggtttttaaaggttttggggttaaaaaaccccggttgaggccatttggggctttaaaccccggccttttggttttaaaaattcccctggtcggggggtccaatttggtaggtttggggaaatttccccctggggggggggggttttttttttttttttggtttaccaaaaatgggggggggggccttttcccccttttttccccccaaaaaaaaaaatttttccggttccccggga

SEQ ID NO: 552066 - DNA, 583 bp, Homo sapiens
  misc_feature (142)..(142): n is a, c, g, or t
ccacccccgtccccccagcgcatccattaggcgacgcacgttttgagactcactctggggcggtagggtggccttggaggttgtggacccaggcaagaatatcacgccctcctttaaccatggtgtggtttgcagcctgttntagtgggacaggccagggcttggttgcccattttttggccccacccaatcaagggaaaaaggaggaattctggactggaggcccctggagccaaatggcaaaagggtgccagcttccttttctgtgtggactttgtccagttcctttagaaaaaatggatgcccagagggcttccccccctgggttggggtcaagaaaccgccagcaaaagttaggggccttagggccctggggtgttgttccattaaaaccgactttggccctggcccctaattgtttttttagctttttaggcctttccagtttggccctgtcccccccctccactcaggtgtcctgcagcaaacactcccccctcccccttccattttccccccctattgcagcccctccaggcctgttggtatagagcccccctgtatgtcaataaaccacaggtga

SEQ ID NO: 552067 - DNA, 406 bp, Homo sapiens
cgtggtggctggcgcctgtaatcccggcactttgggaggccgaggcgggcggatcatgaggtcgggagattgcgaccatcctggctgataaagtgaaaccccgcctctactagaaatggaaaaattggctgggcgtggtggcgggcgcctgtagtcccagctactcgggaggctgaggcaggagaatggcgtgagcccgggaggcagagcttgcagtgagccgagatcgcgccactgcactccagcctgggtgacagagcgagactctgtctcaaacaaatacaaaataactaaccataacgcttcctttgaacctgcactcattcgctctctctgtagtcttggcctgctgtgcacttcaactacagactcaagtagttgccacgggagactgactatactgtga

SEQ ID NO: 552068 - DNA, 376 bp, Homo sapiens
  misc_feature (335)..(335): n is a, c, g, or t
gggtttcaccacgttggccaggatggtcatgatctcttgacctcgtgatctgcccgtctcggcctcccaaagtgctgagattacgggtgtgagccactgcacctggcttagtgttagtgtattttatgtgtggttcaagacagttcttccagtgtggtccagggaaaccgaaaattggacacccttgctccaagatctgggaatatgacaaggatgcccactgtcaccactgttattcaatgcagtacttaggaagtcctaggctagagcagttcagacaagacaagggtattaaagggtattccagattgggaaagggaaggaagttcaaattntccgtttgtttttaacaggatgggtgttaatttttattatt

SEQ ID NO: 552069 - DNA, 979 bp, Homo sapiens
ggtgcgcatccagaaagccagcagtgtggtagcacacgccacctcttcaggaggtggagacaagatgaaggattcggtcgtcgtgacttcgtttgacattctgtagccggctaactgtaacctccacctcgagtgcagcggactccgatcacgtcgtgggtaccagtctagcctgggatacagggaacaggttagaaaaggcaaggtggaatagctactctttgacggcattttgcaaatggcccgaggataaacatcacattgatgcgagtttgcggtttctgacatgagcaagttgaccacgtgtatgttttcacctaggggggcaattattggaaaacaatgccaaagtacccgaacggagtggtcacgatcgacctttgcgtgcaatagtatatcgactacaggattcggaaggcatactcctgagattttacctgagaggaggtgaacgccagtttctaactccctgaaggtgtaccggagacacgttggcaatagacagaggtttcaaaacgaaggtcattgggacttaaactaccggtttgctcagcagttaggtcttcccttccaaattctaagagagcggaatgatacaaattcctatgaggcccaaggctccagcctttggtggagcaaggttacgattgcttacctttactagatgccagaaattacggacgggtcctttaccctcactcatgggaagacatgtctaatcaacagaaagacggttccaggcaatctgtaaaccttttgtcccagaatttatcaggagagaccacgggactgctaggtggaacgggcctcaacctttctaagaagggtcctgccaggaaacgttgtcccgtgcatgcactggccctctgcaacacttgggtgttcccaggctcagacacttgccaaagggcggacccgttggacggcatcggctcccctccctgtgcggagccactgtcaaacgcgccagattaacgca

SEQ ID NO: 552070 - DNA, 564 bp, Homo sapiens
  misc_feature (9)..(9): n is a, c, g, or t
  misc_feature (183)..(183): n is a, c, g, or t
  misc_feature (188)..(188): n is a, c, g, or t
  misc_feature (212)..(212): n is a, c, g, or t
tggaacctnactttcagctgggaaccagtggctcatgccctataatccccagccactttgggaaggcccgaggttgggccggattcatgaggtccaggagatcgagaccatgctggcttaaccatggtgaaaccccccgttttctaccttaaaaattacccaaaaaatttagccaaggccatnggttntggccgccttttagtccccagctnattcgggaggcttgaggcaggagaatggcgtgaacccgggaggcggagcttgcagagagccaaggtcacaccactgcactccagcctgggggacagagcgagactccatctcaggaaaaaatacaaaagaaaagaaaggaagcctcagtcatatgaagctatcacacctaaacccagtaccaaaagatctctaatttcaaaactattcagctctccacagcaaagatcaaatatttgggccaggcgcagtggctcatgcctgtaatcccagcactttgggaggccgaggcaggtggatcacgaggtcaggagatcgagaccatcctggctaacatggtgaaaccccgtctct

SEQ ID NO: 552071 - DNA, 136 bp, Homo sapiens
tcagctgacttgggactggctcagctgattctagcccctacccagcgctctagacggtcaaggtgtggtggaatcagcggggaaagaagaccctgttgagcttgactccagtcccaagtcggcgaagaagcgaaga

SEQ ID NO: 552072 - DNA, 326 bp, Homo sapiens
tcaaatccagagtactcagtaagtccagagctgaatctagacatccagacaaaagctaattttcagaggaaccaaaaatcagactaagcctcgggttctagcggcttatttacacggactaggagtgctcttggtgtgttaggtctacctggccaggtagacctaacaatctcatatgaagatcaccctagaccatcattctactatcaacattactaataagaggctcctttaatctctaccacccttatcacaacacacgaacacctctgattactcctgccatcatgaccctaggccataatatgataaaactccacacaaga

SEQ ID NO: 552073 - DNA, 394 bp, Homo sapiens
tcactacctgggtgatgggattattcagtggcatgcatgcaacaaacctgcacatttatgcccttgtgtcttatattcataagattaaagttgaggctgggtgctggatgttacgcctgtaatcctagcactttgggaggccgaagcaggcagattacttgaggtcaggagttcaagaccaacctggccaacatggggaaaccctgtctccactaaaaatacaaaagttagccaggcaaggtggtgagcacctgtagtcccagctactggggaggccacggcacaagagttgcttggacccaggaggctcaggttgcagtaagccaagactgcaccactgcacactccacactccagactgggtgacagagcgagactctgtctcaaaaaaaaa

SEQ ID NO: 552074 - DNA, 176 bp, Homo sapiens
agcaaggcagagatcgaacccacatcctcatgaatactagtcaggtcaattctgataagccaaataggaactcccagaactatgtctcttgatgtaggttctccatcctcatggcttctagcatacctccagtcgccagcatccctatagctacccagctagaaggtagcctctcc

SEQ ID NO: 552075 - DNA, 780 bp, Homo sapiens
  misc_feature (211)..(211): n is a, c, g, or t
  misc_feature (360)..(360): n is a, c, g, or t
  misc_feature (535)..(535): n is a, c, g, or t
  misc_feature (642)..(642): n is a, c, g, or t
  misc_feature (651)..(651): n is a, c, g, or t
  misc_feature (749)..(749): n is a, c, g, or t
  misc_feature (768)..(768): n is a, c, g, or t
ggggggggtaacttattcttttaatgactagaggcaggacgtgatacattctcctggtagactacttgggctacaaaaccagctgcacagataggctaacgaactaaacttatttcaatcttactcgtgtgtcagtccactagtaatggatcgacttctacttctcaagcatctcaaggggattttgagactatgggtggaaaattgttgnatagaagatattcgtaaaacagggcttcttttgtgggattgtcatttacaacttgctatggtgtaaacgactaccctaaaaactagatactttggagtgcccgaccttggttaaaggtggtcacttcaacgagggaattcttattcacntcgcatcacgactatagcgatgtctatatccttgctcaaaaatatgcaggggtctttccttattcaaaaaaatgcaaatattcgaagagggccccgtttgaatttttcattcaaaccgttgaactccgaaggtaacggaatttttaaattttcacggtattcctttttaaacctnactttctatttacacaaaatggggagattgactcattcgggtacacccggtagtagatggatttttgggaaattccacacaaaacagacagtaccctatcttcggcntggaaaccnaggattttcctttatgaaaagagaggtgtgggcaattaaaacaccggctctctaattcaaaacggaaaaatagcgccactctgagcgtttaacctaanggggagccccaaacccttnctaaattctttg

SEQ ID NO: 552076 - DNA, 105 bp, Homo sapiens
gctggtaccatgccgatttctcctacgcagattgcgccgtgcccgctgggattgcgcgcactttgaacgtacccagtttcatcgctgcctgctggacaaggccgg

SEQ ID NO: 552077 - DNA, 358 bp, Homo sapiens
aggaccagagcactgcagcagatcatttaatattgcttccgtggagtgtggcaagtcagctaagatactttgacgccggtgggatgcgatgagttattgtaacggagtgtacaatatgctcgtgtgtctacgtctattcctactgtatatatatggtgtgctcacacgtataaagccctaggaagccaattgatatcatagctcagacctgtcctataatccatatggttctttatagccggagtagtaagtcagcaatatgggagattattccgaagtcctggtaggataagaatataaccttcagggtgaccgacggttcagaataggtgtaggtctacaaagaggtctcctcctc

SEQ ID NO: 552078 - DNA, 274 bp, Homo sapiens
tcacaggatcccccaagaggctattgagggggaacagtgcattgcgtggccattgattttaatttgaatttttggacggggcaagctacgttactttatggcagaaaaaaagtgcaactgacatactacaaagagattttttaagttttaaaaaaagttgggatctttgggattcctttttttttttggggccttattgtcgctaattaccggctgatttttatttacgcacacaattaagaaaaggttaattttttttcctgggcccactcca

SEQ ID NO: 552079 - DNA, 284 bp, Homo sapiens
ggtagaggcgggtttcaccatgtaggccaggatggtctcaatctcctgaccttgtgatccgcctgccttggcctcccacaagtgctagggattacacggcatgagccaccgaccccaaactcttgtaatattttttcttttttattatatatcctgctaataaatttatatcaaggcaaaatataaccctcaccagttatacgtgaggtaggatgaccatgttccaggatttatattacgcctgtaaactgaaatatcggtggctgacccattccaagcctaac

SEQ ID NO: 552080 - DNA, 376 bp, Homo sapiens
tgtgataaccctatcggagagggggttgttagtagagtcggaccgtaagtgttggtgaacagctaagtaggttgttgttgatttgattaaataaattgttgaggcattatgctaatgattagtgctgtgagtgtttgtgttgattcaaattatgcgatgagtagggcctgggagcctactacggtgtagaagtaggaagtatgtgcctgcgttcaggcgttctggactggttgcctcatcgggtgatgatagccaaggtggtggagtagtgtggtttcgaagaatgatatcaaatatgattagttctgtggctgtgaatgctataattgaggagatttgtagggagattagtatagagaggtagagtttttttcgt

SEQ ID NO: 552081 - DNA, 223 bp, Homo sapiens
ggggggggtaacattttcccccggggaccccttttgccccttgggcccttttgggggcccctttaaacccggttgggcccaaaaaccggggggggccgggccgggatttcccggggttttgtccccccccgggccccccggtttttttttttaaggggggccctttttttttttaaaaaagacctgggggcccataaaaaccccaaaggggggccttttttta

SEQ ID NO: 552082 - DNA, 215 bp, Homo sapiens
  misc_feature (142)..(142): n is a, c, g, or t
  misc_feature (195)..(195): n is a, c, g, or t
actgtatcggggagcacgtaacagcttcagaattcatcaggaccaagaaaggataagggtatttggctcacctcgttccacagctccaccttcctcttctcatcaaagcctaccatggatacacaggcgagcttctttctcncttagccgagtaatcgtgcccagtgatgatcccgtgacagcaaacaagtttcnttttgcgcggtaccgagctc

SEQ ID NO: 552083 - DNA, 110 bp, Homo sapiens
ttacatagtaaattctataattaacaaaagatcttgatcttacttgaagttacatgagggaaagaccccctcagcaggtgtcccgttgcttaagaagcaaatagaggact

SEQ ID NO: 552084 - DNA, 823 bp, Homo sapiens
aagacaatctagggagcccagcaggcccatcctgagcctcactctgagatttgtgcctgacctaatacggactagttctaataagactgttactgatgtgtggttcagtcgttagtaactgagttgtctagtcgcagaactgcaggaatgccaaggcttgtggtagtgtcgaactacgagtcgcgctaggattggatctatgtaagagtttctcccgtcccaacggggctattgaggatcacgcaaggttaagaccccgagcaggattagggaggtcagctctggggctcatacggtcgatggcaggggtccctcggccagacccggtagaatcctgagatacggagtgtctctgaccttggtgtcatctagtcgagtccgttctcattagtaaaggagcaatagtgaaagctgggggaggagaaggacttccctcaggtggcacacgctgtttcaggctactagactatggctgtgtgaaaccattatgataatgcctagtagatcacagtgtcagatgaacgttgaaccccaaaagatggtcgtgatgctttggccaaaaccggacactgtgcagaccctctactctccaactcagcacccacccacatctcccagagctatagccaggcagaacattgggtcagggtggagcaaggcactgcagtggccccagagggcatgtgtcactaatcactgtccatggtctacgcaggaatcagcggcgtcaatggactcttctggaagcccggggccggccccaactgggcccataggaaggcaccgggcaggggcagcagagagagaccaaagcctaaacacg

SEQ ID NO: 552085 - DNA, 351 bp, Homo sapiens
agtgaggctctgacaacccggcgtggctgtcggcgacgctgctacgggcaagactagacacaagccgggcgcggtggctcacgcctgtaatcccagcactttgggaggctgaggcgggcggatcacctgaggtcgggagttcgagaccagcctgaccaatatggtgaaaccccgtctctactaaaaatacaaaaaaattagccttgcgtggtggccggcatctgtagtcccagctacacgggaggttgaggcaggagaattgcttgaacctgggaggcggaggttgcagtgagctgagatcgcgccgctgcactccagcctgggggacagagcgagattccctctcaaaaa

SEQ ID NO: 552086 - DNA, 225 bp, Homo sapiens
catttttataattgcaagcaggttgttgattcgagtaattacaagtacttgtacaaatacattcacagcgcctgtgaggagccttctgtgctggaactggtgacacctgtgccgtctccggacgagaggagaggaagtcccaccgccgccttccagtcagcagcgagccgtgtgtcgtggcattcccttgttccgctgctcccacccttcactgtggtggaaggg

SEQ ID NO: 552087 - DNA, 305 bp, Homo sapiens
gtaccttactacaatgatggataccatcattatacatttgtccaaattcacagaatgtacaacaccaagcgtgaacccttatcccttatgtaaactatggaatttggatgctgctgctgatgtgtcaatgtaggttcatcaactgtaacaaatgcaccactctggtgggggaggttgacggtggggcaggctgtgcatgtgggaatagggggtatgtaggaactctctctacctttctctcaattttgctgtgaatctaaaactgcttaaaaaataaaatcttaaggttgtaaccctttaaaaaa

SEQ ID NO: 552088 - DNA, 531 bp, Homo sapiens
gattaccgcttacgatcggcaagagccaatggatgaccggggcaaccatgatccctagtgaagcggccccttgctccaccggcaggtcaaacttgtggatcgtatggacaggaaatcccactggagatcgagtggagatttacgtgaagcaggagagcgggtacgagtctaccacacgatcagggaggaattatccctaaagcgcgaatttcccagtagtctgatggcatcgtccctgaaacgctggattgatgggtgcccacaagacacatcgaggtggaagatagcttctagacagaagcctatgtgtccctgtctcaaaagacgactgcaggaggaggtgatggaggccatggggatcaagggagatcccggtagttagtactggaaggtctattggtattgagcctggggcagagcagctcctccccaattctgtcccagccttgaaggctgaggcacttcttttgcagcatgccaataatagagcactttgatgagtcaaaaaacaagaaggaaaacataaaagga

SEQ ID NO: 552089 - DNA, 1343 bp, Homo sapiens
tgataacggatccggaactttttgggactatcaggacaaagatggactatctgagctccctgggcaagacagcagactgccgtggtgcagagagatgctgacattagagcgatggacgaggactgaaacgggacgcagagcatccgggaagctgagtgacaagaaggagatgctaggatgtgaagttcatggacagacacccaagcattgcatagactactaagccagagaccttcagagcatgcaaaaagtcagaccttcagctgaggacggttaacaatcacagacagactgcaggcccagatatggcacatactgacgctgcaagaggagagcccgatgacacaagacaagacacgatccgagcaggaaagagatagaggaattgacggattgatgccaagcggcaagaaaaccgactaagccgcatagagcaggcaacaagagaagaatccatgcggataaccgagaacaaatgggaggcatccacatcagccataccaaagatgacggcacagagcacatggcccgacgagccccgaagagccacaaacacgacaatcacaagcaagcactatgcacctgacagaggattgaaacaacaggattgaacagactacgagatcgcatctatattgggagaaccacgaggacaactgcaaacgggccttggacgagtacaaggaaatcaccgcacacacaaagctaccgaggagacaagaggcccagggaaaagcactgggagaagcacacaattcaggaaagagacgaaacatgggcacaaacgggcacgcacaaacgacacatggaacacgaggacatttgtcaaccggctaccacccagggctacgacacagacccaatccacccagcaaacacttaacactacaagaatttgcacaatacaccaacacaacatacgcaccaatatacagcagacaaatagcaagaggacaacacatagtacaaacccaaaaatattagcattatgaccacataaaaaaatcatgaattcaacaccaaagactattcaaaccataaatgcatactaatttcaccatcacttagatgaaaacacaaaacaaataaataaaaacacaaaaaaaattaacgacgtacctacaaagacacaacaaacaatgagaaaacaaactttgatataaacaactcaaacaagaacacatgaaaaaaaataaaaacaaataacccactcaacaacacaaaaatcaccaacacaatactaaaacaaaaaccacatataacaaaagaacagaacaaataaaataatcaaacaatatatcataaacacctcaaatccataacacaatcattatctaacaaac

SEQ ID NO: 552090 - DNA, 489 bp, Homo sapiens
  misc_feature (1)..(1): n is a, c, g, or t
  misc_feature (390)..(390): n is a, c, g, or t
  misc_feature (452)..(452): n is a, c, g, or t
ntacgatcttaaaaataaataaataaataaattcatactacatatcaaaggaggagaaaatagctctgaaaaaccatcaataggtaatgcacagattattatcttctaataaatttcagtgagaaaggaaagaaaggacactcatggatttcaatgccataacattttgaatatattttattttgtgcttcgggaatcatgtgttaaagggattttattttctctaaggcctcataacacagtcaagacttttccaattactttcatttcatctggatcacttacacttaggaaggatttaatgtttcaataataataattgggaaacaaaacatgtcacctaaaatttggatcttcttttttggttctgtgttgactttatatactatnctctactccttctctgattatctattactgcataacaaactgcattcaaaattggagaattnaaaatagtcttgtgtacaatcttgtgtgccagaattt

SEQ ID NO: 552091 - DNA, 156 bp, Homo sapiens
tcagaacctgagcatggtggaggaaacttatactgactttggactggacaggctatgaaccctgagggatggtgctgggacacgcatagtctgaatagccataactccctctctgatataactgccctcggtcatcctccagtggatgtctagaga

SEQ ID NO: 552092 - DNA, 164 bp, Homo sapiens
tataacgtataagtaaataagttagaaggaatatgtaactgcactggtacattttaaaggtgacacatagctccttataaagttattacaaattacaggctaagcttaaatgacgtagccagtagtctcacttcatatgatcaatattgatatagttgctgcac

SEQ ID NO: 552093 - DNA, 278 bp, Homo sapiens
  misc_feature (94)..(94): n is a, c, g, or t
  misc_feature (99)..(100): n is a, c, g, or t
  misc_feature (205)..(205): n is a, c, g, or t
  misc_feature (215)..(215): n is a, c, g, or t
gaaagaatgatttgagaataagtttaggtgggaagatgttggatttatttatttatttttgagatggagtctcatctcatctgtcactcacgcnggagnncagtggtgccatctcggctcactgcaacctccacccgccgggttcaagcgattctcatgcctcaccctcccgagtagctgagattacaggcgtgtgccaccatgnccagctactntttgtatttttagtagagacagagtttcaccgtgttggccaggctggtctcaggctcctgacg

SEQ ID NO: 552094 - DNA, 316 bp, Homo sapiens
ggtcgacagagattaagaggcatgcatcaaccttatgatttaaggttatttgggaggccaaggtgggcagatcagttgaggtcaagagttcgagaccagcgtggccaacatggtgaaaccttgtgtctactaaaaaaatacaaaaattagctgggtgtggtgttgcacacctgtagtcccagctactcagaaggctgaagcaggagaactgcttgaaccctggaggccaaggttgcagtgagccaagattgtgccattgaactcctgggtgacagaggtagactctgtctcaaaaaaaaaacaaaaagtcgacgcg

SEQ ID NO: 552095 - DNA, 512 bp, Homo sapiens
ggagagagagaactagtctcggttgagtgtctatttctctattttggaaaatggaatcaaaatttttttcccctgttggttggaaaacaaaaactatgtgggtggtttgtttacagggaaccccaattcctctaaccccttccaaagaaacacataaaaaaacaacgcggcccacacaagtgtgtgtctcccttacgtgccacacaaagtgtgaaaaagagacccgaagagaggtctacacggcgagacgtggacgtgaggcgaagacccgaaggtgtgagacgccagccaggccaccgggcaaacaagggggatggggaggccggctctgcaacgagtgaccagcgcgcggggcgcgagtgcacaacgggtggcgcgagcgcccactggtgagggcgccccaggagagagtaattgaagagaggagcagagaaaaaaaaggtgcagcaagggggacggatagtcgaaatgaggggagagtaaagcggagtgggagcacagcagggccttgg

SEQ ID NO: 552096 - DNA, 105 bp, Homo sapiens
  misc_feature (33)..(33): n is a, c, g, or t
tcgctctagaggatctcccgctctccacccacncccattaggctcacccctgcagcacacctctgcctggacatccaggcatttgatacatctctaaaatctagg

SEQ ID NO: 552097 - DNA, 309 bp, Homo sapiens
tcgctctagaggatccaccttatgttctgacccaccactgattaagagtggcgtggcaggtattagggataatattcatttagccttctgagctttctgggcagacggggtgaggttgccagctccagcagccttcttgtccactgctttgatgacacccaccgcaactgtctgtctcatatcacgaacagcaaagcgacccaaaggtggatagtctgagaagctctcaacacacatgggcttgccaggaaccatatcaacaatggcagcatcaccaggtgggtcagaacataagggggaccgagctcg

SEQ ID NO: 552098 - DNA, 924 bp, Homo sapiens
  misc_feature (662)..(662): n is a, c, g, or t
tcagtggagctctgagtttcgaatcggtggcggcggattccccgcgcgccgggtcggggcttccaggaggatgcggagccccagcgcgggtgctgctgggggccgcatcctgctagcagctctctctcctgcagtggcaccatccaaggaaccaatagatcctctaaaggaagaagccttattggtaaggttgatggcacatcccacgtcactggaaacggagttacagttgaaacagtcttttcgtgtggatgagttttctgcatctgtcctcacgtggaaaactgaccacgtgtcttccttccaattgtctaacacaattgtgtttgtggtgggtttgccaagtaaacggatggccctgtgggtcttactttttccgaactaagaagaagcacccctgttgtgaattttacattggccaatctggccttggttgacctcctctcgtgtcatcctggttccccttgaagattgctatcaatatacattggcaaacaacctgattaatgggggaagctcttgtaagtgtgctttattggctttttctatggcaacatgtactgttccattctctttcatgacctgcctcagtgtgcagaggtatggggtcatcgtgaaccccatggcacttccaggaagaaggcaaaccattggcattgtgnttctccctggcaatatgctgctgattcctggtggtcacatcctttgtttgtcgtgaagcagacaatctattctgcctggaaatcacgactggcaggttggtgctggacagctgggggcagccatgtcaatcatccctctctggcatgggttttggccacctcccaggcttcattggggacaagcggcttgccgtgacccagagagaggggcaaattgtccggcgtggccaaccgttggatttaaagcacgtgtttgctcacc

SEQ ID NO: 552099 - DNA, 137 bp, Homo sapiens
aaaaggtcatggccagaagtcgggctacttctcccgtcggcagcctcgaacgaagctgacctggagctcatcggccgcgcacgacctcgcgtcgatgcgcccgggcggtaagacggcgtatcggccaggacgaggag

SEQ ID NO: 552100 - DNA, 343 bp, Homo sapiens
tcaacagagcgtctatccacagttcctgctcaataccttgcacctggtatcaggactgggtcatcatcactgtcatctgtgtcctgaagaccaaagtccttggtgaatgtttcttcatgagctgaaggcccagtggcttctgtttgaaactgaggctcaggattggtgttatttccaccagatgaaccagattcttctgaacccccacaagaccgatcaagattgagtgtcatttctttctcctaagttggaatccaatggcttgcctgtgaacttatctgattgtgatatattgatatggttctcatctgggttttccgcagatactccttccagatattct

SEQ ID NO: 552101 - DNA, 380 bp, Homo sapiens
  misc_feature (54)..(54): n is a, c, g, or t
  misc_feature (89)..(89): n is a, c, g, or t
  misc_feature (113)..(113): n is a, c, g, or t
  misc_feature (121)..(121): n is a, c, g, or t
  misc_feature (136)..(136): n is a, c, g, or t
  misc_feature (193)..(193): n is a, c, g, or t
  misc_feature (195)..(195): n is a, c, g, or t
  misc_feature (197)..(198): n is a, c, g, or t
  misc_feature (201)..(202): n is a, c, g, or t
  misc_feature (205)..(206): n is a, c, g, or t
  misc_feature (284)..(284): n is a, c, g, or t
  misc_feature (300)..(300): n is a, c, g, or t
  misc_feature (316)..(317): n is a, c, g, or t
  misc_feature (319)..(320): n is a, c, g, or t
  misc_feature (365)..(365): n is a, c, g, or t
  misc_feature (375)..(375): n is a, c, g, or t
ccggatggagccgagcccctccgtcctcgcgtctcggtcctcgcgtcgccccgncccacccgcccctgcttcggcgggaatcgtgtttncccggcgtgtagtccctgacaagngtgccctntaggagaaaagtctntgtcctgtgaagtgtgaccgtgtagtgtaggggggcgggcgggggggcggatgggcngngnnggnnggnnggggaggggcgcggcgcggcgactcggggcggggttcttttttccattttgaaagaaagcgtcggggttggggtgggnggagtttcagtcctcnggatcagccctctccnngnnagaagcacaagcgcgggcctggacggagtagccccccggagcccntccccttttntaaac

SEQ ID NO: 552102 - DNA, 98 bp, Homo sapiens
gtttttcccctaaacaagtttttttaaccaaatccttgggttttgggggcccttttttcccctcccttatgttttatagaaaaagggttaatattttt

SEQ ID NO: 552103 - DNA, 436 bp, Homo sapiens
  misc_feature (53)..(53): n is a, c, g, or t
  misc_feature (339)..(339): n is a, c, g, or t
  misc_feature (425)..(425): n is a, c, g, or t
gcccatttgaattaatgtatggatgccctttcctcttacaaaacaggcctccntctgagaccctttcctcttacaaaacaggcctccttctgagaccctttcctcttacaaaacaggcctccttctgagaccctttcctcttacgaaacaggcctccttctgattctcaattaggagagtacctcccagcactctccctcatccgccatctcctctgcaaacaggcacaccaggccctcccaataccacataaaggcctcactgaccagaccctcctaccagggggaacatgtttttctaaaaacccttaaacccggctgggcacagtgggcttcacgnctgttaatcccagttacagtggggagggccaaggctgggtggaatcacaaggttcaaggaggttggaggaccttctggggccaacntggtggaaacc

SEQ ID NO: 552104 - DNA, 1098 bp, Homo sapiens
ggtcgacccacgcgtcgcatcaggctggtggctgagaagatgatctggctgggcaaataaggacccactgcctcccctggacccccaggccatcaagcccatcctgaaggctcttcttgacaacaccaaggctaagaacaccgatggtcagggcctacagcgaccaggcaattgtcaacctcctcaagcatgcggcagggctgaagaggtgatctcagctccctctccaacgatcctggatgtggacagctctggaggtgctgacccgaggcttcaccgacaggtccctgcacacgacacgctggccagccacggccgactccacggagcaggctggacgacaccactcctgacactgagcagcgccctgggcccagccagcagcatctgccgcctccacactcattcgcctccctgcttctccatcttcctgacaaaatacactaagcttccacatgggcgcagctctgcgcagactggccgatgcccaggaacagctctccctcactactcacactagacgcatcagcccaagcgccgttacccctcccgcaccgcaccaccacccccctgccaccactctggcctcccgtccaatcctctacaccctatctaccatgatgggacaacagcagaacgggaacacacgccccaccgcaatgacagcactcacgcaaaactgggcacgcccccaggcagcatgaccgaccccacgcttacacgccacatgggactaggcgcaccttggcacacctaatacaatagcccacagcgacatcaagcaccctggatgggctctacaaccccttcacttcacttgctgcccactgacaaccctcgaatgaaccaagacagacaacatggcgcgccacacccaaacaccactctccccgacctagtgcccggcacgcataggaggccccacacccacacggcagagacaaaccacacatgcacacaacccagacggacgaaagcaaccagagcccacacgccacaccccgccccctccctgcgacacacagcacgcaacatgcaagcagaacccccacaggcaccacctacacaagcgaaccaacaacaacacacccaccacac

SEQ ID NO: 552105 - DNA, 360 bp, Homo sapiens
  misc_feature (48)..(48): n is a, c, g, or t
  misc_feature (52)..(52): n is a, c, g, or t
cccattcggcgaggcagtctctgaaagtggatctgaactacagatccnatantcaaggtaagcatctttgcagacctcgctgtggtttaggaatgagtattgtcaatactcagaaaaaggagatgccttgcaagcaaatatgttgcttgaaggtttttttttttttttttttgggccaaatttagaaatttggaaaaaaaaatttaaaggtggggttgggaaaaagtttttcccaaatttttgggggggatttttttttttttttggcaaaaaacggcggaaaatttttttttggtttaaaaagtttttttttggctctttttccccgggcccttaattttttttccatttaagaccccg

SEQ ID NO: 552106 - DNA, 117 bp, Homo sapiens
tctagaggttcccctccatgaaccggtgggagggaagctattgacaggtgtgctttcattgttacccacagcagggtacatctggcactggcccaaggaacttcctcacaatgtgct

SEQ ID NO: 552107 - DNA, 159 bp, Homo sapiens
ttatgagtatcacgctgtgtttttatgtgtgctacattgtgcatagaacactattaatcgttgggaatagtgctttgtcattaacagaaagtcccaattaacaacagtcaaaagaaaataaccatttgcatacccgaccaggaaatttgttggtaggta

SEQ ID NO: 552108 - DNA, 979 bp, Homo sapiens
gaaagtagcaagagaggctattcctccccagaagctgacaatgcaagactcctctggaagtgaagctcaatcagtaaaaccaagtacaagaacgaaagaacaggcatagaactgggagacattcagagttccatcgaatctatcacaacaccaaacaccaggcacagcaacattcaaccagcaaatcattcatggctcttcgacaatccattctcagtttccaagccaaaaccggcccacggcattattttctgccaaccaacacacagcactcacttccatcattttcctcctgcattttgcttcaagtccatcaatcaacacttccatgttccacagtcagacagttcctcgtcacccattgcaatcaagtgcaactcagcacacagcaatctgattctggccgtgggcacccagtgttccaagtcggtcttggctctttcatttcacacaacatcaccaatcattccgcacaaaaccacaaaaacacaacgtcaggcagccatcccacactgtccagcaggtccattgcacctttctcagctcatccttttcatactttcccaccacttgcacaacaaagccagcttcatacctcattctggcatctcatctcacacaggtgcaggcgtcatgctgcttcaagctggcccaaaggaacccatttctccctcagcttcttcaggtcggagcaaatggtgtcctcacatacattgcaggtcatcaacatccaaaaaccccaaaacactgctcatcaccaccacacttgctcctccctctcatttgacaaccttcccctaacccgtggaaccgagactaccctgccctatcggtacactctccttaatcacggctcacatggtccccgccagcatcacttaacaccggctctaccaccacattccggtctacccattcaaccccaacaagccccagtggcctctatcgcaacatcgttcaataccaccttcactcctgg

SEQ ID NO: 552109 - DNA, 1043 bp, Homo sapiens
  misc_feature (1041)..(1041): n is a, c, g, or t
  misc_feature (1043)..(1043): n is a, c, g, or t
ccacgcgtccgtctctctggctccttcactgttccctctgtgcttcccataggtggggcctgggaggtttccccctggccttagaaggggcccatgccgcatctcatcctggcacgccctactccactgccctgtgtagcagcaggtgtggcgcatgtggaggggggtgcatggcccccaggattccgccagccaaactgtctttgtcacccactgtgggtgctcactttaacatccttccacctaacttccactagtccccgtacctaggtttggacgagccccgcgtatacgggctacaaggataggcaggcaggagtcgagtccccctaattgccgcgtcttcacttgtgtgccccagcccgccttgcgcctccgaactggtatctggagtacatatagttggtgatggagatgcgagtcacgttgattgtccaggtgaggcctgaagaggccctgtgggcctgccactctgaggtgtgggctcgtggctgttcctctctgattcctactttgcttccagtcactcagccttttcctcccctcctcagattggggcagccgattaacaaggaagctcaccctgcccgttcccagatcctccttgtgctcctcgcttgccgcgccaaggtttctggttccgatttttcctctgttcacgactactctgggaaaggggagggcgtcatgtccatgcttcgacatccgtcatcgctgctgaaagcagcgcccaaatgtgcatcctgcattgctcctgtcctgccacgatccctccccgagatacacttgtgggaagagggctgtgatggaaggttggtgacgctagccagtccaaggaaggtgggcctgcccaacgattgttgggggagggaaagggccagatggacaaaggtggtggcccccacccagtttgacagagaggacaaagcgtggccccgggccacatagagccacagcatatcaaagattcgaaaaaagaaaaaaaggtcgcaccagaatacacaaacacataagagaagaaactcacacactgtataccgntn

SEQ ID NO: 552110 - DNA, 219 bp, Homo sapiens
tgttctgctgtatcatcccgttcttgtacgtatggaacacacccagtggctcacgcctgtaatcccagcacgtttgggaggctgaggtgggcggcttacttgaggtcaggagttcgagaccagcttggccagcatggtgagaccccatctctaataaacttttattaataaaaacttagccagagcactggtgggcccagcctgtggatccagatagat

SEQ ID NO: 552111 - DNA, 428 bp, Homo sapiens
cccggctcgtccagacgggggggctgacgggggaagatcagcttcacggtggtcaggagcgagatcgaggaggtggcagtgagctgagaccgaccacggcactccagcctgggcaacagagcgagactccgcctcaaaaaaaaaacaaaaaaagaaaaaacgacccgaaagaaagaacccaactctacaataattttttaaaacttcggcatggtggtacatggcagccactcgggaggccgaggtgggaagacaacctaagcccaagggttcagggctacaataagctgcgatcccatcactacaccccagccggggtgacatgagtgagaccccgactcagaaaaaaaacaacccaaaaaacaaaaccacacgttaaggggatcatggttcatttggcttagttactctgagaaagattttttcta

SEQ ID NO: 552112 - DNA, 189 bp, Homo sapiens
  misc_feature (94)..(94): n is a, c, g, or t
gtagatgctgtctcagctcctgtcctcggcacttccccaggctcatttgagcaggtgtgcttcgcagctcccctaaacttcccgggtgcctcantccataatgagataatgcatgtagggcgaaaagtttctcaagcaaggtggaagcaggcagcacggacttgtgataagggagtactctgctggtca

SEQ ID NO: 552113 - DNA, 585 bp, Homo sapiens
ggagaagactgcgctcgtgcgtgttcatacttgtccgtgggcctgaggtccccggaggatgacctagcactgaaaagccccggcctggctccccagggtccccgaggacgaagttgaccctgaccgggcctgtctcccagttctgatggccctgggtcccactggaactcgcgtctgagccgccgtcccggacccccggtgccctgccggtcctgcagaccctgcaccgggcttggactcgcatgccgggacttgacgtgtagaacaatcgtttcttgtttggaagaagggtttttcccttcctttttggggtttttgtttgccttttttttttctttttctctttggtaaaattttgggacgaagggaatgtctggaacacaatggaaggaccggttcacccgctggactcagtggcttggcggcggtgactccatggaccctgtggtccagcatggaggtgtgtggacccgcagcagctgggcatgttcacgggagggcgagctgatgtcggggggtatggacacgttcatccaccggaatcgactccaaccgaggtcatctaccagccgtgccgcaagcgga

SEQ ID NO: 552114 - DNA, 91 bp, Homo sapiens
agaccctctactacgtgaaggtgtacctggtgctcggtgacatcatcttctacgacctgaagcacccgtttgatgcagccgggtactacca

SEQ ID NO: 552115 - DNA, 792 bp, Homo sapiens
  misc_feature (212)..(212): n is a, c, g, or t
  misc_feature (748)..(748): n is a, c, g, or t
aggtccccaaaaacccccctctccttttttctacaacatatgagagcagggtggctcatttcctggagggcgtctgaggactatggggtcatcaagactgacgtgtcccagcctgttgccctctttaaggcaaaagacatgcaagcagtgcagaggcccctgatggctttgggcagcttgccagtgaccaagaatgatgggcactacggtgnagatcccaactggtttatgaagaaagcgcaggagcataagagggaattcacagagagccagctgcaggagggaaagcatgtcattggccttcagatgggcagcaacagaggggcctcccaggccggcatgacaggctacggacgacctcggcagatcatcagttagagcggagagggctagccctgagcccggccctcccccagctccttggctgcagccatcccgcttagcctgcctcacccacacccgtgtggtaccttcagccctggccaagctttgaggctctgtcactgagcaatggtaattgcacttgggcagctcctccttgtgcccccagcttcagcccaattttttaccggaaggcttcatgccttgggcccttccttccgggttgcccccttcccttttctgttttcttccttgggttaaccagggaaaaagcggcttgggggaagcttggatgtggcccaagtccactgtcctctttggcggcaaaaagcccatttaaagaaagaacccagccccagccctgccnccctatctagtcctggaatatttttggggttggaactcaaaaaa

SEQ ID NO: 552116 - DNA, 107 bp, Homo sapiens
tgccagcagcgaggggtgggtgcaccccagtggcagtggctccagttccacgcaaaagcgcagcgggtgcaactcccacgtcagtcgcaacgcgtgtggggcagctc

SEQ ID NO: 552117 - DNA, 384 bp, Homo sapiens
gtctcgaccaagcgtcttaacactcagcgatcgatgtgcttccaggctacacggtcgtcaggcgccatgattacgatgcatcgcggcattgagacgggttacgagtggtatacgcgagcctcgttacagtcactagggagagtagaagttacggttagggttgactccatgatgagccactctggcctactgccagcagcgcgccgatcagggcgtagtttgagtttaatgctcaccctcgaccagaggattggcttttaatcccctgtggcggtttcctcatagatggtaagagaggatgtccaactggaatggtgacgtgcatgaaatgccaccctgggagaccatgtagccaacgcagtaacttcatagggtcctgggcat

SEQ ID NO: 552118 - DNA, 904 bp, Homo sapiens
ggagagagagaactagtctcgagttttgtttttttttttattctgaccaacgaaaaaagtgttattggcggggggcttctgagacagcagaggtggtccccagagaaaaatgctgctctggcagtgagggagggattccggtggaagctgcaggcagccactcttgtacatcctcggaggtggtggccgtgggatgtagcagataccaacgcagaggtgaggcagaagacacgtgggtgaaattgcctcacctgctgccaatgccaataccactggactttgcattttcgataagccaagaaatttccggtaaactggattaaacaatatggcctttattggtgtaacccagatcgatcgggattatcagaaacagcctagctgaattatagctcctttggggataaacagtagaagcctcactattcaccctttaaggtgtaattccagcttttccccaacaattcagatttccgtgggacaccaacacaagacacagacaccccgggtacaccgtgttttcacccgtgaagcgtgacagggcccaacacagtgcttcacggagtttgttgctcccgtgccgtaaggtgtggcattttagaacgccatattacatggcatctcacaagcctctcgagtgtgggggcgccaggggggcatctctgatagatgccctcttcaaaagcgctttacaccccattgggggcctctgtaccatacatttaccagcctgggggcacccaaaaatttgtgcccccaacaaagtgcccacaggacaagagaggtgccctcccagaacgcgcaagccttaaaccaccgcggtgaacagacctcacttggcaagggtgaaagggcccaaaatggagtcccccataatgtggatccctccaggcaataccaaccg

SEQ ID NO: 552119 - DNA, 649 bp, Homo sapiens
  misc_feature (286)..(286): n is a, c, g, or t
cccagcagcaccaggtctccagaccctaggagttccatgcctgtcctttccagaaaagcttggtgactttaccagctgtgtccagccccctttatccagacctatactgggtatccggtgccgccaggtcccttctcccctgacctgggaaccagctccactcagcttgcccggttctggcggcctctatgtgctcaggtccagaccttctattttatagcccccccggttaggttatgtcttccctgcttaagaactggcttgtttccagcccccttgcctggcnctggggatcccgccctggattagagaagccccatcccttgcctgggccggagattactgagcctgtcagtgggtcagatgaggcttgagctgggtgcaccctgacccccttcagccagaaattgcaggtcttggaatgagagccagaacctgctataggaaagtagcttgaaccaatatactccaaatggtgaacccctgccatttcaccgagggctaagattataaaccaattttatgtttcttgttagacctttgatagtctttcagatgtctggtgaccagtcatagcatttctatataatccagaccaatattaggatgtaatccattcatatgccctttgccaattttaaattgtaga

SEQ ID NO: 552120 - DNA, 253 bp, Homo sapiens
tttgagcgcgtgctatgatggatatctgcatgaagtaacgaataccagcatacggggacgttatagtgtcatcggatgctcggtacaagctgggtcatcagtgtcagagctagttgcctgtgtgacatcgggatccgcaaggtccccaagttctgaggcaggggtctgctgggtctggatgaggtcttctgcaggctgggtaagctccatggggaaaggtccccacgatttttcctctgtcccccccgacgcc

SEQ ID NO: 552121 - DNA, 495 bp, Homo sapiens
gcatacgtacagagcatcgtcaccacctgttggaatgacctgaagtgcaacaaaactccatacagaaaaaccagatctataacagtgaggccaacaagttccattcttattggaggcaagcacccaattcaattagcatccaaatgtacaaaaatgcgtaatgtccgtgtcacccacgtaatgtgtgtgttctgaggccacgatccctttagtcacaaacaatgtcaacacatgcaaatctccgtcttgtgtttacagattcccagtatgtaaattagaacaagaaaatcatatcagaacgttttatggatattgttctcaagtattttagtgtgacttggcataagggaatgagaaggcgccacagagggaacttgagttgattgcatctggtgagataaaccccaagaaatcctggcttgaagacatcaggctgatgtgagtagagagaatgtgagcctgggaataaatcagtggagaatttaaaaaaaaaaa

SEQ ID NO: 552122 - DNA, 244 bp, Homo sapiens
tacctgtactgttttcaaacaacactcattttgtaattgtctatatcaagcaacctcaactaactgtttgttttatcagcaacacatttcccttttattttaaagagtgctttttaaatgaaggcccaacaagaactactttcagatggtacagaatttcttatttcttgaagactctgtggttgacacttcttcattagttacctgcagcaagacaccttcccatggcaaataggaagaagct

SEQ ID NO: 552123 - DNA, 367 bp, Homo sapiens
tccttgctttggacggcggccccggcccagctgacgtgagcgccggggtcggatgctgttgatggagtatgaatgtgatactaccaggaaagtatgtccacagacagttatgcagtattcacaagtggtcgattgcgtcagagcctgaaatatccgtaaatggcgagaagaccaattggaacgcttggaagcccttgatgccaattctcggaagcaagaagcagagttgaaagaaaaaggccaataaatggagctagaagaatggtatgcaagacaggacgagcagctacagaaaacaaaagcaaacaacagggcagcagaagaagcctttgtaaaatgacattgacgagtcgcccccaaagcacag

SEQ ID NO: 552124 - DNA, 294 bp, Homo sapiens
tccagtacccgagcatgcatgcttgcctgcgggtcgacgtgtattcaccaatgcggtgcatgcctccctgaaacaagttccgtcggacacgtgagaaccagtgctgagctccaaatctcgttaagctggagcctggtcgacgtgtatacaacactgaggtgcatgcatccctgtacaaagttccgtcgacacgtgagcaccgttgctgacctccaaatatcgttgcgctggagcctggtcgactcttgcggatcctccagtacccggagcttgcttgaatggctgccggtcgcc

SEQ ID NO: 552125 - DNA, 150 bp, Homo sapiens
cccccccccccctggtttggggggggggtttccccaaattttggcccggggacccccacctgggggggggtttcggggggccccctggggccccttttttttccggggggcccccccccccccccggtttttttttgttttttttgggga

SEQ ID NO: 552126 - DNA, 142 bp, Homo sapiens
ttgtaagtggtgcaggagtctacgaacccgtccacggttctggccccgatatagccggacaagacaaagcaaatccattagcgcaaggttctcagtgctgctatgatgttacgctacggcttaaaccaaccaagttaccgat

SEQ ID NO: 552127 - DNA, 1202 bp, Homo sapiens
  misc_feature (167)..(167): n is a, c, g, or t
  misc_feature (247)..(247): n is a, c, g, or t
  misc_feature (1069)..(1069): n is a, c, g, or t
ggctccgctccagcccgagtttggttccctgaaggtgactcctgtgtggaggaggatccccagtcctggtaagaggatttgacatgttattagtatcaacagtcagtgagtgaattaggaggtagggataggagtgatagatcgacggacatgaagaagaatgaggngtagcgagatgaggaaaagacgtgaggaaagacctcttggagagaatgagggaatgagggagtgaagcacggagattctntgcgcaaatagggacatcaacaaggaggatggaatgaacgagtctgagagatcgtagatctcgaaggatagaactaaacggttgactttacgtaaggagataagataggaactaaaggatagagacggtatattacagcgtacgtgtatcgagagagggacttgacaccgtgagaaagcggtatgcggtgcgaatagtaccctcggtggaggtttgagaggcaattatgtcctaggatgagtacttgattggaagcagagggtctgcgtgactaggaagaaacacggggaattccttggtggatcctttattaaacatagtataattggggtacataaggtatggctaaggcccgtgcgttggccaggaagtttggttatttcagtaatacaagactattgaggcaggattatggaagcgaggaagggccacaattttgaaaaggaaccttggggccaaatattatccaaaaggtctcgatgggctttacgaggtggaacagacacaagtgggggaaagacacttacaagggtttccaaattcgagatgacgtttggtccaaacgactttaaaatagcccttggttgatttcacagttatataaggcggatactatggaacttcccttcggttctaaacatgttagggatccgtcccagagttgatatagctagtcaatctagtaacagagagggtagcacacagacagcatttttttccgcaacaaaacacacgttgggggggatcaaccacagttaatcattgggtttccagaaccaaaacgaaagtttgtaataagagaacacttgtcgtacgaaggcnatggggggaaactttaaccagaagcagaccaatccacgtcaaaagttattcactttcgtaaaaggagaacgcgaccttaaagttctgtctagtaacattggatttatcgccaccacagtttcgaagcagcgcc

SEQ ID NO: 552128 - DNA, 368 bp, Homo sapiens
  misc_feature (52)..(52): n is a, c, g, or t
  misc_feature (260)..(260): n is a, c, g, or t
  misc_feature (282)..(282): n is a, c, g, or t
  misc_feature (312)..(312): n is a, c, g, or t
  misc_feature (331)..(331): n is a, c, g, or t
ggcccctgatgcagcttaaggtggatgcagatgaacctctggtcatcgaatnaaactaatgacttttcgccaacgacatctactaatcttgtgatagtaaataaaacaattgcatgtccagagctcattcgaagcagatatttctggatattgtcataaaacaatttagtgaatttatcatcgtccacttgaatctgtggttcattacgtcttaactcttcatatttagaaatgaggctgatgagttccatatttgaaangttttcatcactacttagtttnttgatagcttcaagccagagttgtcttttnctatctactctcatacaancaataaatgctgaaatgaattctaagcggagatcgcc

SEQ ID NO: 552129 - DNA, 342 bp, Homo sapiens
  misc_feature (2)..(2): n is a, c, g, or t
  misc_feature (25)..(25): n is a, c, g, or t
  misc_feature (121)..(121): n is a, c, g, or t
  misc_feature (337)..(337): n is a, c, g, or t
tnaacccctattaacccctaccccnagctttttttttttggaaaaaaagtctcaaagctgaagtgaaatggcgcccatcaataaactcactgtagcctcccatctcccctgggttcaaagnagtcctccctacttcagcctccccaagtagggactacaggcgtccaccaccacacctgattttttgaatttttagtagagacgaggtctcactatgttactaggctggtcttgaacccctgagctcaagtgatctcctgccttgggctcccaaagtactgggattatatgcataagccacagcgcccagcctgtcgctttcttttctttcttcttntaaaa

SEQ ID NO: 552130 - DNA, 794 bp, Homo sapiens
  misc_feature (328)..(328): n is a, c, g, or t
acggagcggtgtggggccgcgtgcgatgccgcctccgcgtccttccccgagcggctggccgcctgcggggccgaggccgcggtgtacggcaggtgcgtgcagtgcctccacggccccgggtggccgccttgagtaatggactttcttgcgcgtggggagttccgaggccctgtcggagctgcttcgcctgcgtgcggccacagtaagacgcttggagtggatggctgtccgtgagggaccttcttgaggctttcagcgagccatgtcttgctgccaatgtgttgcacgaggcccatagtccgtgattggtccccatttttgccagcantattcgagagttgccttaggggcagtaagcggaacgtgggcacgttggtctgcacgatgttgatccattcccttcgcgtgttgacgatcctcgtgtgatccattaagcaaggtttgatggcggtggtgtcggcagcagggacatcttggtcttgcccaggctatttgtgtccggtaaaaccttgagttaggaataggattgtacctggaagccagggatcaagactcgggtcatagtccttgaaaacaaagaagactatgtaacaacctcaaccacaatcacacaatagagacatacgtacacgggtatggaacgaactagtagtaatttgcagaaaaaaccttgtaatcaaaagaagagagtgtggggctacccatataatgaagatcatggagtaagagtgcaaaataaccttttacactgggcctaatcaagggaaaaagcaataaaaaaggaggcccgcaaa

SEQ ID NO: 552131 - DNA, 120 bp, Homo sapiens
gagtctaagtatgaggaagttgacatggagttcacttagccaaggctgttccagagcccttgaagaagtatactaagagtgtagagagctggctgaaagactgaaaatagaagccactta

SEQ ID NO: 552132 - DNA, 759 bp, Homo sapiens
gaaccagacgatggacaggcatgactacacttctctccttctgcagagcgggctggatgctggtactagaatgttgatataaagcttgacacattgcttgcactagtggtgcatagaaaaatgcagtctttgagttgtggtgtcctcttatcagcttgcttgccaacttaggctttcggcgtcagaagattatcgaataatgctttgtctatagtgtctgttatcagtagggcgaatttctgaggccgttgttatgatcaccagtcattcaacgcagatttcgggcattgttctctcccttaatagactattctcctttccaatttcaaaatctcctaaatcaactatgtttcaataaccttagtttaccatgagtggctttttgacgtggctttgccgcagcaaccgtggttctggtttcaaagcatttaagcgcacaatttccctaacggaattttggcgaacgaggttaaaagttcaagccagggcaaattctcatggacaaggtaggccctttataacttaaataaaccaccattttgtggtatctaccaagggcgctttgccttagcaactccacggggggggttacccaaagtgagcctcaaggctttggggaacgaacaacacctcttctggtgacgcttaaattcgaaacttttgggcttaaccgaaagagccttttactttgtgggcaaaaacacaatttaaattcaaaccttaagtttttgccccccttggcaatccacaaaactcttg

SEQ ID NO: 552133 - DNA, 684 bp, Homo sapiens
  misc_feature (400)..(400): n is a, c, g, or t
  misc_feature (473)..(473): n is a, c, g, or t
  misc_feature (524)..(524): n is a, c, g, or t
  misc_feature (554)..(554): n is a, c, g, or t
  misc_feature (593)..(593): n is a, c, g, or t
  misc_feature (607)..(607): n is a, c, g, or t
ggcccgcggagcatcgcagccggcccgggcccccgccagcctccctcctcgcgtcctcggtgtcctccgcgggccggcgcgatgcggctgggcccgaggaccgcggcgttggggctgctgctgctgtgcgccgccgcggccggcgccggcaaggccgaggagctgcactacccgctgggcgagcgccgcagcgactacgaccgcgaggcgctgctgggcgtccaggaagatgtggatgaatatgttaaactcggccacgaagagcagcaaaaaagactgcaggcgatcataaagaaaatcgacttggactcagatggctttctcactgaaagtgaactcagttcatggattcagatgtcttttaagcattatgctatgcaagaagcaaaacaacagttgntgaatatgataaaaacagtgatgatactgtgacttgggatgaatataacattcagatgtatgatcgtgtgatngactttgatgagaacactgctctggatgatgcagaagaggagtccttaagnaagcttcacttaaaggacaagaagcgattngaaaaagctaaccaggattcaggtcccggttggagtctngaagaatttatggnttttgagcatctgaagaagtgatatatgacggaatttgtcattcaagaagtttagaagaacatgaaaaaaatggtga

SEQ ID NO: 552134 - DNA, 138 bp, Homo sapiens
  misc_feature (1)..(1): n is a, c, g, or t
ncttcaatatcaaccattaaccttccctctacacggatcattttcacaatactattgctactgactatcctagagagcgctggcgccttaatccaagcctacgattgcacacttctagtaggcctctagcgccacccg

SEQ ID NO: 552135 - DNA, 359 bp, Homo sapiens
ccacgcggtgacgtatcgctatacgccaccgaatacgggcaggtggcaaaaagcaccaccactcaatgcaagaagaacaagaaaaagaccgaccaactgacctgcaccagcactccaaacacctcctacggcccggtagggacctcggagcgcaccggctacaccacgctcaccaccttccgggtcaccgctcgtgatgaagtgagcaggcgcgctgtctacctgctaagggcgtcgtcctataacgacgactgccaagccgccaaggtcgaagccttcctggtgcagcagggtttgcagaacctgaatttccaggaccgcgtgcagcgcaattacacggtcacgatgcctgaaagctt

SEQ ID NO: 552136 - DNA, 340 bp, Homo sapiens
ctcaacttatttatttttgctactatggactcaaagatatttattttaccgtatgggttaaaatctaacactatcggccgggtgcggtggctcatgcctgtaatcccagcactttggcaggctaagacgggccaatcacaaggtcaggagttcaagaccagcctagccaacatggtgaaaccccgtctctactaaaaaaattagccagacgtggtggcaggtgcctgtaatcccagccactcgggaggctgaggcaggagaaccccctgaactcaggaggcggaggttgcattgagccaagatcatgccactgcactccagcctgggcaacagaacaaaa

SEQ ID NO: 552137 - DNA, 336 bp, Homo sapiens
tgctctaaggatcccgtgtcatcccccttcgtgagttggagggggatgagtggaagatgggatgagtgaaggatgggatgagtggagggggatgagtggaggatgggatcagtggatgggatgattggaggatggagatgagtggaggatgggatcagtggatgggatgattggaggatggagatgagtggaggatgggatgattggaggatggaatgaatggaggatggggatgagtggaggatgggaggagtgaatggggatgagtggaggatggggatgagtgggggatgggatgagtggtggatggaatgagtgcaggatgggatgagtgcg

SEQ ID NO: 552138 - DNA, 140 bp, Homo sapiens
cctcaggagctagcggcatgggtctgtaccttacttgatgttctgtaaaataagggagctaaaagtctctgcctcacagaattgtcataaagatgaaactatttggccaggcacagtggctcacgcctgtaatcctagca

SEQ ID NO: 552139 - DNA, 319 bp, Homo sapiens
gctcgaccctggttcgtgaaacaaggataaaccgcatgctctctcccggactggaccagatagtggcacttcagtagcatcgccgcctttcttccatatccgtcagccagggatgactaatgccggttctgtcactgtttccatcacgcttgttaaccaccacaaccctgctgctatcggcgctactcggaggttgcagcgtcaacggcacttacccggacgccacggacccagacgccgccaagctgcgtttcatcgccaatacgcaaaacgccacgctcgattacttcgatgccgagcattgcgacgggcaaaccac

SEQ ID NO: 552140 - DNA, 102 bp, Homo sapiens
tgagccggtaccgtactttataaaccaaatagcgtctggtgtctgaagcagaaactgtcggcacttcttgcagaatcgcagctgtttcagtcttattcaggt

SEQ ID NO: 552141 - DNA, 459 bp, Homo sapiens
  misc_feature (442)..(442): n is a, c, g, or t
tcagcaccatggcagatgctagggactaggacgaggtgagaattggaattacctactggggtttccttttgggcgtgatggagatattatgctatcagaccatggctcatggttgcgtaacttcatgaatatactataagccactgaattgtatactttaaattggtgaactgtatagtctatgaattacatcccatttaaagtaggtaaacaatggcttacaaaatataacttatagttctaaaacgcttctttttgtgccttctcattttttatttttatacagatagattagccctcactatgttgcccagactagtctcagattcctggcctcgagcaatcctcctgcctaagctttccaaaatgttgggattgcaggtttgagccatctcacctgtactgagtatgcagcccttcattaatgctactattacatctntgcctgctttatcctcc

SEQ ID NO: 552142 - DNA, 120 bp, Homo sapiens
attcacctctttgagataacagacctggagaaaggtgaattccaaatctagtaccatattcaagttatctggcagagaagcaggcataaaagagttttctaggtaattggggcgctcgtg

SEQ ID NO: 552143 - DNA, 330 bp, Homo sapiens
tctatggcgcgggccgatgaactgccgctggttctccaggttgtggatgaaattgatgaggaaagacttgctcgttcatcaacgattggagaactggtggacgtcctgcaccaccaccggccgtcgcggctcagggatgtccagcttgccggtgatcatcacgtccttgtcgccgtccttggagggcaggaagaagacgcggtcggtgtaggtcttgtagtccagcacggggatgccggcctcgtgcacgtcgttggtctggtcctccatctcggtcaacttgtctggagtatactccagacaagttgaccgaagggggtgatctttttt

SEQ ID NO: 552144 - DNA, 226 bp, Homo sapiens
cgcaattcatttattgtcctattctatgcggccagccgacatggcccaggtgaagctgcagaagtaaggaactgaagtggtacagcctggaggcttcagtgaagttgtcctgcaaggtaactggatacatcttcacaagtaatgatatagactggatgaggcagacgcctgaacagggcacttgagtgagataggatggatatcacctggagaggggagtactgaa

SEQ ID NO: 552145 - DNA, 295 bp, Homo sapiens
  misc_feature (33)..(33): n is a, c, g, or t
  misc_feature (37)..(37): n is a, c, g, or t
  misc_feature (43)..(43): n is a, c, g, or t
  misc_feature (46)..(46): n is a, c, g, or t
  misc_feature (134)..(134): n is a, c, g, or t
gtcattttctctaagacttcagactcagccctngggntgtttnttntttgttttatatagctgtactcacttgtataattatatacatttttaattgaaaggttacattgtatgtgcgtaaatataagtaaatngtttcctgaacactcagcaatattttaagtctcttcaaccttggtcaattgctagaccttgacaatggacaggtttatttaaatttcagctacgtctggaatgactcaaaagatgaaatccctcttaattgctattgaaattaggatgcataatatcaact

SEQ ID NO: 552146 - DNA, 615 bp, Homo sapiens
gggcgcccggaaagccggacttatggccggggccgcatggcttcgtcacagaaagcgtttatctcagctagcgccacccggtcctggccagcctggcgcctgccggtgggttaacaccgaacatcatgccttcaatcaagttgcacagtcctgatggagagatattcgaagtaagacgtggaaattgccaaacaagccgcgactattaagaccatgatggaagatttgggaatggatgatgaaggagatgatgacccagctcctctaccaaatgtgaatgcagcaatactaaaaaaggtcattcagtggggcacccaaccacaggggggacccctctcctcctggagatgatgagaccaaagaaaaagcgaacagatgatatccctggtggggaccaaaaatcccggaagctgaccaaggaacacttttggacttactctgggtgaaactacttaaacataagggtttgttgaggtacatgccaactgttgccaatatgtcaaagggaaaactccggaggagaatccgcagacctccaatatcaaaaatgactttactgggaaggagggaagcccacgcacccacaagggaaccccggggggtgaaaagaaaaga

SEQ ID NO: 552147 - DNA, 127 bp, Homo sapiens
ctatgttctcggctctacctgtctctcggctctaccttgtctctcggctctacctgctctaccactgaatgagatggatcagtggatattaagacaaggtagagccgagggacaaggtagagccgag

SEQ ID NO: 552148 - DNA, 245 bp, Homo sapiens
gttacaatgtggatacagtaaaactcagagtcgctttatactcggggagaatgaaaggacgagatggcctgggggaggtcaagagatcatacatgggtaccatagtgacagaagccactgcaagtcattgggagtaacaggtaatcttataaaatgaaaatctgtcatccatctaacgactcctccccatcccacacacacgtaaaactcctcatttgtgtcagattgcttttacagtagaggcc

SEQ ID NO: 552149 - DNA, 198 bp, Homo sapiens
ctgagtgtgcttcgctggtcgaatctgatcgcgctcgtctgcgcatcggtgcggcgatcctcacgtggccggagttcttccgcctcgagcagaccttcccgctggcgcaggtgatctcgttccgcgcgatcgtgctggttggcttcgccgccgtctttgtggtgatgctgctgctgtgcgttgcccgtccgatccgca

SEQ ID NO: 552150 - DNA, 342 bp, Homo sapiens
ccccggggtttttttttttcgggggagcccccaaaaaaaccttttaaggggtttgggccaataaaaaaaaaaatttttttaaggcggcccggggcctttttggcctgggaaaaatgtttttccccgaaacccccggtggggaaaaagaaggtggccttaaaagggccctttgttggggccccggttttttgggggaagccgctggggcctggggggaattgaaaactttcccacggggggttaagggttgcttttatgcccttgggtgggaaagggcccccgattgcggggattttggtttccttatgggttcccccataaaggggccttggtggcttttta

SEQ ID NO: 552151 - DNA, 888 bp, Homo sapiens
  misc_feature (301)..(301): n is a, c, g, or t
  misc_feature (311)..(311): n is a, c, g, or t
  misc_feature (322)..(322): n is a, c, g, or t
  misc_feature (352)..(354): n is a, c, g, or t
  misc_feature (360)..(360): n is a, c, g, or t
  misc_feature (364)..(364): n is a, c, g, or t
  misc_feature (368)..(368): n is a, c, g, or t
  misc_feature (378)..(378): n is a, c, g, or t
  misc_feature (383)..(383): n is a, c, g, or t
  misc_feature (385)..(385): n is a, c, g, or t
  misc_feature (392)..(392): n is a, c, g, or t
  misc_feature (403)..(403): n is a, c, g, or t
  misc_feature (410)..(411): n is a, c, g, or t
  misc_feature (415)..(415): n is a, c, g, or t
  misc_feature (417)..(417): n is a, c, g, or t
  misc_feature (421)..(421): n is a, c, g, or t
  misc_feature (439)..(439): n is a, c, g, or t
  misc_feature (443)..(443): n is a, c, g, or t
  misc_feature (466)..(466): n is a, c, g, or t
  misc_feature (474)..(474): n is a, c, g, or t
  misc_feature (489)..(489): n is a, c, g, or t
  misc_feature (524)..(524): n is a, c, g, or t
  misc_feature (529)..(529): n is a, c, g, or t
  misc_feature (588)..(588): n is a, c, g, or t
  misc_feature (600)..(601): n is a, c, g, or t
  misc_feature (628)..(628): n is a, c, g, or t
  misc_feature (720)..(720): n is a, c, g, or t
  misc_feature (736)..(736): n is a, c, g, or t
  misc_feature (768)..(768): n is a, c, g, or t
  misc_feature (773)..(774): n is a, c, g, or t
  misc_feature (803)..(803): n is a, c, g, or t
  misc_feature (831)..(832): n is a, c, g, or t
  misc_feature (835)..(835): n is a, c, g, or t
  misc_feature (838)..(838): n is a, c, g, or t
  misc_feature (849)..(849): n is a, c, g, or t
  misc_feature (883)..(883): n is a, c, g, or t
agcgccggcgagcgccgccgggaccgagcggggcggcgcggctggcggggccggcggcggctgaagcgagagcgcgacgcgagcgcgaccgcggcttcccgagctgcgcctggccgcccagcgccgcggcccgcccgaggcctggaggggtccgggccgccgtccatggtcgcggcgtcctgaggcgggggacgcgcccggcgcccccggccctcctccgcctcctcccgcggggcgggcggcctcctccggcgcctccccgcgcccgcccgccgctcgccgccgcctccctccctccttncctgcggctnccccggctttnggagcccgggggcggcctgtggcgcgcggnnncgcgcnggantgcncctcttttgnccttnangggaaanatgcgtttgcnttggatnntttnanattntgagtttgggatttcgcncgcncgcctgcctcttccgccccgcgngttttttncttttttccttttgntttttttccttttctccctccgggtctcctttttnactcnctccccctttatgctcgcccagccctccccctgctgctgagaagtgggggagggtctcngcgtccaggttnncgccccaccgggcccgggcgagcatgngggggcaagcagagcacggcggcccgctcccggggccccttcccgggggtctccaccgatgacagcgccgtgccgccgccgggaggggcgcnccatttcgggcactancggacgggcggcggggccatggggctgcgcancgctnnggtcagctcggtggcaggcatgggcatgnacccagcacggccgggggggtgcctttnnctntanaccccgcctcncggggcacggcgactccgagaaggcgcccgcggngaggg

SEQ ID NO: 552152 - DNA, 363 bp, Homo sapiens
gctacaccctaacatttcttcatgtgttcttaaaaaaaagttagcggcaacattacataaaacccgctggattcttaagtgccgtcctgacagcaaatattagcataagtccacaggcccacaggaacctacgtttctccttagtgggtatggtaacagcatgactcgtctacgcggcggttgccctcgttaccatgagttgcagctttggtgcagaggagccagattggacccccttcctcagaacaatggtttccaaagtacgccacagtatcctcagggtctgttaggactgttcaaggcttatttgctgaggatcctttggacagtcactcataagagacgctgagagttggtccacca

SEQ ID NO: 552153 - DNA, 272 bp, Homo sapiens
  misc_feature (254)..(254): n is a, c, g, or t
gtcaaaatccagtgttagaaattttccagtataaagaaaaaaattttaacttttagaaaagtaaacttcaaaaatttgcattgaaagctatttgtataaagtattcactaatatagaataaatgtagcgtgtgatatatattacaaagaatatttgcatataatgaattatatttctgggtacctaatttttgatattcagaggaaaggaaagggcaagtcaagggtcttgaggtccaaagggacagcccaacngggaaccctgtttgtttg

SEQ ID NO: 552154 - DNA, 261 bp, Homo sapiens
gaagtgatcctcctgctgcgctgccaaggtgctgagattacaggcgtgaaccactgtgcctgatctatccatgtttcattcagctcttcctcttacatcgggtttactttaggtcctatgaccttgaaacaagtatctaaaaacatcattgagccttacctaagtatcaaattgaaaaagtaaaaaaatgcagtagcatttgactctttactacaggagaaacttaggatccttgatctttttctctgccttgcctttgtt

SEQ ID NO: 552155 - DNA, 216 bp, Homo sapiens
gtcagttcgcctttcagaggaataaccgcccgttgcaaatagctgctgagattcttccattctgcggtttggccactactacgactccatgttgaattgttgcgcaatctccatgggcctaaattaacgccactgtttaaattcagaaaatactgtcgccagaatcactgtctcgctgctatgaatactgttagccccgctaaacgaatatcccag

SEQ ID NO: 552156 - DNA, 217 bp, Homo sapiens
acaaaagacgagatatcttatgagagcctcgtggaggaatcacagccgtatcctgataccctgcatttcagcctagttgagagtcatttttggacgtctcacctccagaatcatcaaagaatcaatttctcttgtttgttaagccactaaatatatggaaatgtgttatagaaaaaggaaacaaatacactgaccttcaatgttttgaatccttaat

SEQ ID NO: 552157 - DNA, 126 bp, Homo sapiens
gcggccgcctactactactactacttctgctcgaattcaagcttctaacgatgtacggggacatgctctaagaagctcgtttcttagacctcttcctggaataaacatctgtgtctgtgtctgctg

SEQ ID NO: 552158 - DNA, 268 bp, Homo sapiens
cgaagcagcacacggtcaatcccatctgtcccgtccttcttagtgaacattccctcaagagtgcgctcttgggagccttgctgtctcggaggaggctggtgtagagactgcaggcggggttggatgctgggtaccgggattcggacaagcacgacatgcgggagcactgcctgcagttcttacgaagcacacacggcaatcccactgtccctccttcttagtgaacatgccctcagatccgctcttgggagccttgctggttccgctg

SEQ ID NO: 552159 - DNA, 896 bp, Homo sapiens
tgccgtgtctgctaggaagaagcggactactttgtggcgtcctgccttggaaattacgtgcgggaacaggtgtgttcatcccgaatccacctccggggcatgatgtttttcagtcgccccttgcctcactcgaccgcagcagggtcttttagcagtatgcgatggttgcggtccccttccactgtaccaagcttacggcgtggcatccaggactgtctctgagtgcctggttcctttgcaccctgtagatgttctaggatagatggatgcatgttacataaattacgctatgcaagtctgtgagtgcgtactgaggggacactcgccaaggactgactgagacacgatgccgagacctcaagcccgttgaggggcagtcccaagaacccgttacagtgaagatggtttactctattgcctcccacctctggtccaacaatagaaagaagctcgccccacctccactctgtgagatccgtgaattctcggaatggcaggggaagccttgcactaggttgcagagaagcatccgtgccacatcctgtgtcagaaacccgtgggtctcacgtggcacttgtaactccacactgtgctgtcttcttggtcatgtgtaagctgttctctcaagctcagctctaggcattgcaggtccgagccaggttcacactcagaaagaggtgctccccatcctccattcggggctgacgatggggggactgatggctgcccctgcgtggcctgagtcctggtccaactctgaggcagttgacggggcagtcagatttataaagttttgtacaaagttttccatgttgtaatcactcccatttttacgtaacaaccaacttgttggtggctctatttctgattcataacctgggaatagtagaagcgcc

SEQ ID NO: 552160 - DNA, 610 bp, Homo sapiens
  misc_feature (139)..(139): n is a, c, g, or t
  misc_feature (148)..(148): n is a, c, g, or t
  misc_feature (166)..(166): n is a, c, g, or t
  misc_feature (174)..(174): n is a, c, g, or t
  misc_feature (195)..(195): n is a, c, g, or t
  misc_feature (332)..(332): n is a, c, g, or t
  misc_feature (360)..(360): n is a, c, g, or t
  misc_feature (461)..(461): n is a, c, g, or t
  misc_feature (562)..(562): n is a, c, g, or t
cgggctttgcttcaactcgagctggctcgggaaaagaagcggctgtggccattgtgaaattctgtggtggcccttgccaaggatggtggcctcaacctgacctcaaccttcgtcaggaaaaaccagtgtgagacccganccatgctgntgcagcccgcggggtccntcggctcntacagctaccggagtccccantggggcagcacctactccgtgtcagtggtggagaccgactacgaccagtacgcgctgctgtacagccagggcagcaagggccctggcgaggacttccgcatggccaccctttacagccgaacccagaccccaagggntgagttaaaggagaaattcaccgccttntgcaaggcccagggcttcacagaggataccattgtcttcctgccccaaaccgataagtgcatgacggaacaataggactccccagggctgaagctgggatnccggccagccaggtgacccccacgctttggatgtctttgctttgttccttccccgagcccctgccccggctccccgccaaagcacccctgcccactcgggnttcatcctgcacaataaactccggaagcaagtcagtaaaaaaaaaaaa

SEQ ID NO: 552161 - DNA, 503 bp, Homo sapiens
gctgaggcaagagaattgcatgaatccaggagttcaaggttgcagtgagccgtgatcacaccactgtacttcagcctgggtgagagcaagaccttgtctttaaaaagtaaaagagtaaaacaaattgtgatacagtcatacgatggagtattattgagcaagtcaaaggaaaggactgctgatacaacacggacaaatctcaaaaacattgcatttggcaaaagaagccagacacagagtacatagcatatgaatccatttatataaaatttaagaacaggaaaaagtaatctgtgtttagtatcttcttatggcagaggcagtaggttgggattttagtggaaaggattatgagggaacatggtaggatggtgaaaatgttctgcactgtctcagctgcactaatgacatatagctattaaaatctattaattaaaacaaaattcatttccactgtcacattagctacattttaaatgttcaatagccacatgtggctactg

SEQ ID NO: 552162 - DNA, 110 bp, Homo sapiens
cggttgcagcccaggatttggcggcaagttcaggactgacactgccgcgagggcggctgcccgggcgtcgagagtggctgcgaagcccccgccgagcgcggcttccatgg

SEQ ID NO: 552163 - DNA, 290 bp, Homo sapiens
  misc_feature (193)..(193): n is a, c, g, or t
  misc_feature (217)..(217): n is a, c, g, or t
agtcggttctaccatattgatgccgaacttagtgcggacacccgatcggcatagcgcactacagcccagaactcctggactcaagcgatcctccagcctcagcctaggaagcagcggacgagtagctggggccacaggcatgcaccgccatttccagctaattttttaatttttttatagaagacgagatccncactatgttactcagcgctggtcntcgaactccgtgagctcagggtgatcagatagaagagttgagataaatgtcaaaagatccacatcataagcca

SEQ ID NO: 552164 - DNA, 322 bp, Homo sapiens
ataccgccagtattctatcctatgaccaggacgagcatctaactcaaaatacgcactcatcggggccctacgagcagtagcccggacaatttaagatgaagagacgctggcgatcaccgtagtatcagggctcctagacacatgatacataaactcgatccaccctaatcacaacacaagagcacatttgaataatctttacatcctgacccctagccataatatgatttatctcaaccctagcagaaaccaaccgagccccgctcgaccttacagaaggagagtcagaacttgtatcaggctttaacgtacggcaacacca

SEQ ID NO: 552165 - DNA, 466 bp, Homo sapiens
actctctctacaaggtgatttcctagtgtgcatagagctgttcctctttggtctaccagttacatttccaagggaatctagatggttctgtgggcaaatttacagttgaactaggttcatatcttggacagccagctatagccaggcacggtaggtctgtggcctctacctatatatcttcgcaatattgtgctacatagtcgggtgtgctcgtttagctgttcctaggtagctcgcctggatcgtggggtcatagctttggctcaccgtgcacagttagatctagttatgtcatgaccatgaaggtataggggatagagcttgctatagtatgcttggttatgattgtcaatcattcccgtgcggtcctatatcttctgcaacaggtttcaagttctatcgattattctttatctgggtgaacggtaggactaaggatggctggtagtaaagtggagtgggttag

SEQ ID NO: 552166 - DNA, 104 bp, Homo sapiens
ttgtaatcttccccatgcagccagccagcagtcgcagtgttcagcagtgccaggctcccagcagcggggcagcaggctggcgcggcagttgggtggccgtggca

SEQ ID NO: 552167 - DNA, 733 bp, Homo sapiens
  misc_feature (4)..(4): n is a, c, g, or t
  misc_feature (13)..(13): n is a, c, g, or t
  misc_feature (54)..(54): n is a, c, g, or t
  misc_feature (85)..(85): n is a, c, g, or t
  misc_feature (95)..(95): n is a, c, g, or t
  misc_feature (273)..(273): n is a, c, g, or t
  misc_feature (423)..(423): n is a, c, g, or t
  misc_feature (426)..(426): n is a, c, g, or t
cccnagtaggacnggtccccctgtccctgtttgggaaaccatagcagttgtccngcccagcgaagcgccctctcaccccgcccgncagctcccgnggtgtccccagttttagtgccctcctcccgtgtatgtcctgtaaagccctctttattgattcctctgcctatatatttttaaattgcttactttgttctgattatatgctccttaagaaagtccaaatagtttatatatgctaaactctaaaaatacaaatccctaactgaacatacnggtacgtgcataaaaatacaaatccctaaatgaacataccgatctgtgcgtgtaatcacagttgctggggcagggtagggggatacagcagggggttcaggcaggaggatcacttgagcccagaagttggaggccaacctcagcaacatngcnatacgctgtctctaaaaaaaaatatatatatattttatatatataatatataattaataaatatatataatatatattacatatatattatatctatattatttatattacgtatgtaatatatattgtatttatattatttatatattatatatattatattatttatatgtaatatatttatattgtttatatatattatatttatattatttatatataatacatattatatttatattatttatatataatatatattatatttatattatttatatataatatatataataaatatataata

SEQ ID NO: 552168 - DNA, 174 bp, Homo sapiens
cccctgtcactatgtgtatatcaaatccttgaccagccaggtctgtagggcataatcaaatccaaagtgaaatagtatattaacacagtgccttgaactgggccaataacataattgctactcaaaagaatgtactgtttggactctcctagtggtcggcatgaatattctgga

SEQ ID NO: 552169 - DNA, 468 bp, Homo sapiens
accccctgaggtttcgcgggcgcagtcattttaataatgggcgcgggggttacatcctcattattattttgcctagcgaactcaaactaggagcgcactcccagtcggatcataatcctctgtcaagggcttcagactctactccccctaataggtttttgatgacttttagcgagcctcggtaacctggccttacccccccctattaacctagtgggggaactttctggggtagtaaccacgttctcgggatcaaatatcactctcctacttgcggggctcaacaaacagggcacagccctatactccctctacatatttaccccaacacaaggggggtccctcaccccccccattaacaacataaaaccctcattcacggggggaaaccccctcagggtgaaaacacctatcccccattttcctcctatccctcaaccccggcatcattacccgtttttcctttta

SEQ ID NO: 552170 - DNA, 1650 bp, Homo sapiens
  misc_feature (1133)..(1133): n is a, c, g, or t
  misc_feature (1650)..(1650): n is a, c, g, or t
gctccagtgccgccttctctggggtccaaggatgccatacagtgcctctggctcgtgacgcagtgccacattcagatcaccgttcttgcctcgatcgtcaccatgaactgtccgcaaggcaactgtggacagcaatggactgtggattcccggtcgcgtgtctccgtggtagctagactgacagccagttaggcctccctagctctcctcgacttagtggactcctatcactgactcatcagagctggaccaggcctgtgtgacatcacaacatctgctatgttcactctgctagtccggagcgatgaggctctggaggggccctgtgcgtcagctcctcgagaatcacgactcctgttcacggccagcggcttgttgaggtgcttcctatgactcttcaatcgagctgcaaccattcatattgcgtaggccgtcacgcataagtccaacacgagagaacgtgtgcgcatcggatctaggaaaacttcgcgtaccatgaagccagatataatcgcggaacagggcaaaatgaaggcgaacgcatattattctaccacgtacacactcagtggccagcgaatccaattccaaggtcccaaggaagaatctttcagacgctcacgcctcgccccaatgaaagggtccgttggtatagaaccaagacatctaatcccaaggagtcgcatgagtagtgggtagaggcccacgatagcgaaaacgccagggatgcaaaaacaccaggtgaaggcagtaagagatagctagttctaatcttggcacaatcacagagacgaatggtttaatcaaaagacgttagttatagatctcagggaagaccatatgcgccgatccggagatgtgccttgcattagttagacattcgcggaagctttaagtcggggactaccgggaaggcacacggttagcgcccttggatagagaacagacccgccaatggggatgtacgtcaccgcgcttatacaccgcacatactcagcgttaattcaaaagaggccaaagagcttagcaccccacccctgggtagaagcacggttgatagttcattccccaaaggaacagctgatgccacggggaaatggtcagggtaggttccaataatcactaaagcaccnggcttgggggccaggccgataggagtacagagtacggcggcgcgacacgccgtatatcttagtgacaccgggactcatgtgagaggacacaaaaaaagaggcgcgaataataatggcgtagctctataggctatcgcatggtagcgtatcgcgtggatagcccaatttcctatgggagcacaccagaagggattggcacggaaacacagtggaatggaatggtgggaaacgatagcgacacgtaacgacagacgtaatttcctggtggggcaactgaaaggcaaacagttatgaggattccgcgcatgtaatgccgtgcaacagcggaaagcccatgacactaaccagggacactagcttgtgagcgaaaaactcattctcgagaattgtggacattattccagtgggcaagtgaagcagatacaacagaccccgcgcgtcggcgctgtagttggatattgttgacaattctcccaccagatggagtgggaacaccggtacaatatgagaccactan

SEQ ID NO: 552171 - DNA, 235 bp, Homo sapiens
gaggatcccacctcctacgcacgacagagcagagctctctcagacagcacgggtgtatctacctctgcctcggcctggcactataatgaactgcttagatcaagctggtccaacccacggccatatgctgcccaggatggctttgaatgaggcccaacataaattcgtaaactttctcaaaacattatgagatttcttttgcaatttttttttctttgtccggggggtaggaggt

SEQ ID NO: 552172 - DNA, 271 bp, Homo sapiens
  misc_feature (62)..(62): n is a, c, g, or t
gggggtttccccccccccttccccggggggaaaattttggggggcccccccggggccccttngccggaattgggggtttttttttaaaaaaaacccgggggggggggatttttttgggaaattagggttgggggggaggggggttgcccccattttgggggtttgggtcccggttcggggggtttggggggttttccccccccccccccccctttttttttttttttttaaaaaagccaaaaaggggattacccccggggggccgggccca

SEQ ID NO: 552173 - DNA, 918 bp, Homo sapiens
cctgttttcacttggtgtgtgtggtattcgacccacagtgttgtgtgcgcccggtgcattttttatggaggtctgaagtgtccctggtcccgctccccggttaattccgcggggaaaaacaactgtgcccagttgagaaaactttcaagctttagccggcttaaacgtacgctcttaaacagctcgggacacaacccctttgtattggaatatggggaaaaagcgtcagtgcctgtgtgcaaaaggaaagtatggggataaagcccttcgttggaaaaaaccaagccgggggcctaccaaccatagggtgtaaaatcaagccggggggtattctttaattacgcggaattctttacggggtgcctcctggtctatcaaacaaacttgagtctctcacagcagcgattttgcatagtagttggtcccgcccgaaccccgggagttgcattacaccaaaacctgggaggattcgacattactttgaggcgcccaaactcacatggggtactagccactgcaaaaattcatgccgcgggattaatatccgggagggggaatgaccaaaaggaggctttaccacttatagcaacactagttttcttaattgaattcccagtcaagcctacagtggtaggataattaacaagttaaacatgttgcccttatgttaattatccacccgtgatcttataaaatggggaaccaaaatatttcttttaaaatcccctgaatactctaccccatgtttaaagcatgttttttttataataacgctcgttatcaaaatatgttaaacatttatgcacgcttccccacaagaactatcatctaacaattcacttctaataacatgtacgccaaagaatgaaatgcagcatattttatggcgcaccaaaccaaaaaaatttttaaaaaaca

SEQ ID NO: 552174 - DNA, 292 bp, Homo sapiens
cgcccccgggggttggggccccctcccgggggtgtttaacctcagcccgccctgggagtgggctcctcggggtcgggcattttctgttgctgcctcggccccgggcaaaaccgggcccccccgggggcccgttttagtgttttgccggaggacccaaccccctccaatccctgacagctccttggggttagttggggaccccaggtcggtgggaggctggttaaagggaacggggaggggcaaaggagttccccggaacccgggcagattaaagtaactgtgaagttttcca

SEQ ID NO: 552175 - DNA, 289 bp, Homo sapiens
cgacagaagggcctaaaagagtgatacagggtttcaccacattggccaggctggtctcgaattctggcctcaagtgatccacctgcctcgggccaacatggcaaaaccccgtctctacttaaaaatagcaaaaaaattagccaggcatagtgtcacatgcctgtagtcccagctactcaggaggctgaggcacaagaatcatttgaatctgggaggtggaggttgcagtgagcggagaccacgctgttgcactccagactgggtgagagatactgtctcaaaaaaaaaa

SEQ ID NO: 552176 - DNA, 882 bp, Homo sapiens
  misc_feature (123)..(123): n is a, c, g, or t
  misc_feature (293)..(293): n is a, c, g, or t
caagtgcaaggcgttcccctccgtggaccgcccaaaaagccgcgtgaaaaaagggaattggtaaccagaacccgatccgggggacccaaggtgtatcagggctccctacgggtcctgatggtnggaaggaccagcctttgttcccaagagggcaattccccgaggactttttggaggagagcatttcccaaaccttgtggtgccccaaaaaacaggggagcttacttgaaaagaggtgtttggccatttggggcagaaagccttaaatgggacactcaatggtaaatgcacanccctgggcctgagtcgaatggcacgcatgacctgtttgtacctacacaagagagacttttgaagtccagtaagatcactcactttatagggcccacgaggaattcttgagataaaagctgggttagcaaaggagactgttctcaaatttggagaacaagccacggtatcgaaattctttcacggaattgaatgtttgcacatgggaacaatcactgtaaaataaggttctttagtaagggatataagagagaatttgtaaaacgagaggacacacggcttattgggtcccacaaggagtttacacttgaaggcacattggaaactcttaaactaaattggtaacacataatggttccacggggaacaccagtgttcagccacttggagcctctttagtggcttaaaaagaggttagaaaaagtagtccttgagtactatgagagaatattcatgcccatttataacactttaaagcttaatgagttaagagagagttggccaaagattttgagattacgatcacacaagttgggagagatttttgccacagttcaaacaccaaaaatgtgaatatacgcaagggaccca

SEQ ID NO: 552177 - DNA, 149 bp, Homo sapiens
gctcggaggcgatgagctgctcgcgggagcgcaggtcccactcgcgccaggggcgatcacggtgacgtcgggcttgagggcgtagtagccgagctcgaagcgcacttggtcgttgcccttgccggtggccccgtgggagaccgcatcgg

SEQ ID NO: 552178 - DNA, 167 bp, Homo sapiens
tactacagaattggatggcgtttattcctccatctttagaggacacttgggcattagtcagctagatggaaagtccgctgtgaagtcaaactcattctgcccctagccacagctccgtgaagctcattggctcggtccaacccctagttccacgaccacgtacgaat

SEQ ID NO: 552179 - DNA, 144 bp, Homo sapiens
ggaataaaaggcatatttattggatacgaagaaataaaactgtccctattcacaggtggataattatagaaaatctattatttccgctttgaaacttctaggattaataagtagtgcaacatgtttgccggatacaagatcaac

SEQ ID NO: 552180 - DNA, 434 bp, Homo sapiens
gattgattcaggtgactttactgcagaccctgtcatgtgtaagatgccatgactgcttctttaagaccaggctcacaatctggaaacttcttgtttccgtctctgctccatacccctactctccactgtggtccagaaccagggtcatagctaatctctattgcagaaggaggcatttcaaggcagaaacagaccattctatccaggtaaaacacaaagagacgtggcataatgtcagattcaatagctctttacatgcagtagctcccttccgttgccaggacataggccacgaggccagtctctgagcctatgagctaccgtgactgttcccaacttactcagtttccatcaattaactccattctcttccatcagcctgtccttttttcccctccccgctggctcctcctgtcttcccttctttccttcct

SEQ ID NO: 552181 - DNA, 507 bp, Homo sapiens
cactgcatgttgctcccactgggggcggatataacttacctactagattgtgcaacacgcccagtctttcccttccctgctgcagccttagaaactaagtagcagtactgtttggtgtgtgttctgtttcttccccagcagtgcctactgcagctacttagtaacaactatcaggtggcgggtgtacggggaagcagttagatgagttacgtgtgatgcacaggccaatagtatcgcagcctatcaaaggtccctctgccctgcctcagtggcttgattcttcattggttgcatatctctattgtgcaggatgactgcccttctgaatcagatcagggatattccactgccagaccatggacccagacccagagccatgagatgagctagtccaaatatgggcacattcctggcccacacaggtttgacaatgatccgtcaggcatatataagccaaccctgtacatcttagctgtctttccatccagctcaggaactgctatttct

SEQ ID NO: 552182 - DNA, 155 bp, Homo sapiens
  misc_feature (80)..(80): n is a, c, g, or t
accccacgctgcacgggtcaaataattctcctcctcagctcccaagtagctgggactacaggtgcgcgcaccacgcgagntaatataggtattttatttttcttttatcgagtcgagagctgagatcacgccctataactaccagcctgggtaga

SEQ ID NO: 552183 - DNA, 114 bp, Homo sapiens
gacaatatcccacctgaatacaaacatattctggtggatagtgaacacgacaaaccagtgaacccacctgcatacatatcaaaggatttaaagaaacctgaacatgaccaagac

SEQ ID NO: 552184 - DNA, 658 bp, Homo sapiens
  misc_feature (51)..(51): n is a, c, g, or t
  misc_feature (496)..(496): n is a, c, g, or t
  misc_feature (544)..(544): n is a, c, g, or t
  misc_feature (578)..(578): n is a, c, g, or t
  misc_feature (636)..(636): n is a, c, g, or t
gccaaatgtccacattagcctgggtcagcaggcccctgggcactaaagaanatagggatgggtttgaaagcagttgatggcaaatgagacctaatttgaagggcagggacagatatcacataccgaagcaagcagccttcctccttgaaaagatggaatttctgaggaatcagtgtgtacccgggaagggcaggctggcaggtgggaatgggcgaaggctctgagggattcaaggactctgtactggtgctgcccgtggggtgcttcctcctgggcctgtgggtgtcacactggccacccacaaacagatgccgggcaccagtgcagtggggcgggagggtgtggacagttcagcacacttccaaccccattcctgggaaaaagaatccctaatcctgtaacagctcgtattggtgttaaaacaaatcctgccactgaaactcatccactctacttggaggagtcctccctggatcttgacccagattttcattgnatgattgattctaacagctttatttatctcattccccacagattgganatcacaaatcagaaggggactcaagggctgttgncaacaggatgggactggggacagcccatgtgcctgcctctgtcatgataggcaccccnaaatatttcctggatggccagc

SEQ ID NO: 552185 - DNA, 166 bp, Homo sapiens
actgatcccccacctgctccgtgggtacagtgccaggtggggagtttgactgggtgctggtacacctgtcacactggtaactgcattgtgtctaatgtgcgagctcagtgtaggacacgaaacctacccgttggatgcggtggaacacatccacctgctccatgcc

SEQ ID NO: 552186 - DNA, 281 bp, Homo sapiens
gcacgagcaagaatattagataattggaaggatgctgatatggtttggttgtgtccccccacaaatctcaacttgaattgtatctcccagaattcccacgtgttgtgggacagacccagggggaggtaattgaatcatgggggccagtctttcccgtgctattctcgtgacagtgaataagtctcatgagatctgatcagtttatcaggggtttctgcttttgcttcttcctcattttttcttgccacaatgtaagaagtgtcttttgcctccctcgtgcc

SEQ ID NO: 552187 - DNA, 240 bp, Homo sapiens
gcacccgtaaactttgttgcttatactcaagacatgtttataagctaagactttaaaatgcaaagttttttttagagctaagatttaaacaaatcctataatgtctgacattacaaattaatcaattggggaaaaggttgaataaggtctcctgaaatccttctccaatcacctaattgtggaaagggagtaattttcgagcctgattgtccggtattaacaatagccatttagatttta

SEQ ID NO: 552188 - DNA, 1467 bp, Homo sapiens
aaggccatcgagaagatgaatggcatgctcctcaatgaccgcaaagtatttgtgggcagattcaacgtctcgcaaagagcgggaagctgagcttggagccaaagccaaggaacttcaccaactgctttatatcaaacaacctttggggaacgaggctggactgactgacgagtctgcaaagcagctattcagtccagtttggtcaagaccctcaagtgtccacaggctgcatgcagagatccctaatgggcaaatccaaaaggcttcaggcttagtcgagttcacgcacaaacacacgcaggcatgcccacatcaaaggcctgcctggcaaggcagcatgcacatggccacacaagccaacatcacagctgcgctcaacacatccatccatctcctgtcaggccccgctgccaccacacccagcaaagctaaggccaacggcccagcgaccaaggagcgctctccacacacaccggccaacaacactcctcgcacaccaagccctcctggcacaccaccccacgcggcaggcaagcacagtctcagcgatccgcagtcaatccgcaggcgggcgcgcctgccccacatccctccttaccacttctgcacaagccatacgctctagggccaattgggcaaccaaccttcaatttcggcacatcggcaactgccaccgcaccacacttatccaaaggggccacaccacgacaccaatctcttacccctacgccccttctatacaggggcccacttcccaccgctttgtaaaccccaagcgatgggcccattccacgctgagtcaccacttggccctgcggcaccagcgggacactaggggcaacacgaaacaagcgccacaaacacaccgcggggagctcacaggacgccctacgtcaccggcgcaccgattcggcacgatctgccctcccaacagttactctaccccgctggcacaagagaaacacggagcaacacccaccagccaacaggcccacacgctacacaccccgtgtggcaccgcacacctcgccaacccctggacgcaccccgcgcaaacctcacggaacgagcgaggcccataccgcccaaacaggcacgcccgaacctaaacgctaagcctggcgcacgggcgcccacgtggggccccacacacacaacacgcggaaaaacgggggcaacaacgcacacggacagacacctcacggcggcactccacccccatgggaaacgccccacaacccccaaacgcacctcacctacatgtgccaccacagcgcacagaacgtctgagccctgggccaacaatggtgaacactacggccgcacaactccaccccccaggcgacagacacctgtgaccgcaactgctgtcaacaccgagcgtcacgcggcccccacgcgcacccgggcacaacaacgagagcacgtgggccaaccacccaaacgagggtagcacaaaccgccagc

SEQ ID NO: 552189 - DNA, 165 bp, Homo sapiens
  misc_feature (58)..(58): n is a, c, g, or t
  misc_feature (75)..(75): n is a, c, g, or t
tctagctagtacgagctggtggatcggcgagcagaccaagctctggtcagtgacgacnttgtgaagtggaatggncctcaggccagaacatcatgtgtggcctcctgcaatagcagccaggtggtggtggctgtaggcagggtgtgatgtgtggtggtgacttta

SEQ ID NO: 552190 - DNA, 456 bp, Homo sapiens
ggatgacatgatcgaatcgagctcggtacggtccatcgctagagccagagggcagggatgtgggtttggaagcgtgacggtcgggctctccaggtacttgtactgtgactgcacctcatcgccccatctcagcactacagccttgaaccctaagagctgtcagcggctctgcccacagaaggccctcagcctacaatcccttcccggccattcttccccatcggcgaggggcttctcctagggaacatctcatctgagctcgcatcctggtctgcaccgctccccgctgcctctaagcacagcatttatcatatgatattgatggcatctgttcatgtgctggtctctccatgctccctaatgctaacaaaggacaagggctacagattcatctgtgcgtccctagtgcccttggcccagtcctgggacgtggtactttatttgtcggtgtgaaca

SEQ ID NO: 552191 - DNA, 1121 bp, Homo sapiens
gtgaaatgtggtccctgggagcaggaggagggtcttcgaggtggcctgggggcgggggactaagatggacgcctgggaagtggaacatgtggagtgcagctggtggtgcctgtgtgtggccagagggctgagtgactggggtgctgtgagtgcgcactctgtggaatgcctgagagggtccctgcagagacgtcagtggctgccctgtgcggtgccggcggggagctgggtgggctaggggctggacgccctgacgtgatggcccttcccgcatgggcgcctgctggctctgctacttgctgctgccctgccaccatgttccaccgtgctcctggcggcccgttcgggcccctgcgcgcctgctgggtccacccggcgtccctgcccgggctggaggtgctgtggagcccacgggctgctgctgctgtggcatcgcctggactcgggctgcagtgcggggctctacctaactgccggcgcgcaacggtggccgaggcggcaggaatttgaatggacaagagtcgcctgcgccttatcctattaacggcttccaggcctggttgctgacagccctgtaggatggggatggggatgtacagcggggctgcatctgagaggcgctcccgtgaaatgctcctgcccttgggaggtaggtcgccaccttccacggttaccatcttcagcatcattatctaaatgaaggcgcaggtagccccaagaatcagacctggcaacatggaggggaagtcagggaatcggagtatcgaagtatggcagggacgagagctaagcctcgcaatcgggcggcgacatacagaatacaggaagcgggacaccggagcacacagcggggccgcaacaacagggcctgtggaaaggaggcaagcagagcgaacacccaacaggccaaggtagggccaaggaaccgagagacacgaaggaatacgcaatatgcagaggggagcgacaagcaggatacaatgaagaagcgcaaaaggacggagcgccggggaagcaagagagcacgatggacaacaacgcaagagaagcgagcgcacgagaccgagggacgacaagaaggaagaggaaccggggagggcgcgagcagccggctcgcacag

SEQ ID NO: 552192 - DNA, 912 bp, Homo sapiens
gatatgtgatatacttgttggtgaatgtctgtgaatacatgtgggaagaatcggtgtcttaatagtctccagtgtccacgcgtgattgccgtggtgtgactccagtcggtgtctcaacagtctccagtgtccacgcgttgactagcgtgtgtgactccaggcggcgtctacagcagtctccagtgtccacgcgttgactgccgtgtgtgactccagtcgacgtctcagacagtctacggtgtaccacgcgttgactgccgtgtgtgacgataccagtcgggtctcaagagactccggtgtccacagcgttgactgccgtgtgtgactccagtacggggtctcagaagtctccgatgtccactggcgttgactgccgtgtgtgactccagtcggggtctcagcaatactccggtgtaccacgacgttgactgccgtgtgtgactccagtacgggactcagacaggctccggtgtcccacggcgtagaactgcgcgtgtgactaccagatcgaggggtcatcagcagcctaccagtgtccccgacgttgaggtgccgagtgtgactccaggcggcgtactaccaaactactcagtgtgaccactgcgagttgactgccgctgtgttgataaccagtacgggcgacatacagacagactacagagtgtacaagcccgttcgactcgaccgtggtggctgagtcccaggccgggcgtctcagccagcactccgggtgtccacgcgctagaatggcagcgtgatcaacccgaaagggcgaaaaacaagcagcagcacagaccacccgcatcggactgcgctacgaaatacagcaggcacccaccaaccccagagacacagcagaaatacagagacaacaacagaggacgcacacaaaacgacgacacacacgaagcg

SEQ ID NO: 552193 - DNA, 318 bp, Homo sapiens
tctaccgatgctaggatctcgaatgcatccatgcgcattctctagagatcgagctgtcgagcattcaatttatgtgcgctgctcgccgatttacagattgtgttctcttttccttaacattgctttttacggagatgtgttacattgtaatgaattccagatttattactttttcctttcataggtcatgcttttggatgtagtatctaaaagattgtaactgaacccaaggttacctagattttctcttatgattgtccacaagttttatattttggtgttttacatttaggtctatggtctatatgcaatcagggt

SEQ ID NO: 552194 - DNA, 872 bp, Homo sapiens
gccaacatgccagtggcccggagctgggtgtgtctggaaaacttatgtgagccccgtggagagccttcgagaaatctcgttctcgaaacaatgcagctgaggctgtatcggcgagtatgggctccggaagaaacgtgaggtctggagggtcaacatttaccctggccaagatccgcaaggccgcccgggaactgctgactgcgtggcatgcagagaggaccccacagtgcagtctgattctagaagagcatactgcccgtgcagcaggctggcatgggtccagcagtttggggctgcatggatgaccggcaaacgatgaatgacttggattacaatcgcttgtggctctgacaaatggaggcattgcattaatatgagtacggcctgctaggaaccctaggatcttcacagctgggccttgacccaagcttcggatcccacctacgcctcgcgtcgctgtatcccgtctaggcgccaattattgacgggctccgcatagccaggtggtagaacaatcctcagctcactgtacaattggtccgctcgtggcattcacgcaagaagcaaatgatctggacttcttcatctgacggctacatccactaagggggagtggtcggaccgggccgatgtgaagatggatgaatggcataggaatggtgggcaggggtgggtgctggtggcttggccgacgactgatgcgaggaggcataatatgtccaaccatgttacctccctggcggctgctggcactttgtctgcgtaattcgctgccaaatataggcatggactcaaggcgcctttacaaataaccaagacctcaccaactggtggctggccttggtcggacaccctggccaaggtacagaaag

SEQ ID NO: 552195 - DNA, 750 bp, Homo sapiens
  misc_feature (587)..(587): n is a, c, g, or t
  misc_feature (605)..(605): n is a, c, g, or t
  misc_feature (612)..(612): n is a, c, g, or t
  misc_feature (686)..(686): n is a, c, g, or t
  misc_feature (709)..(709): n is a, c, g, or t
  misc_feature (713)..(714): n is a, c, g, or t
acaagtgagtctgactcatcagataacgagcctattgaagatgaacagactccatttcatatatcatggctatctgtgtcacgagtgaattgtactcagtatctcggtttatgtgctcttgcaggttgtacatttaacgatgttagaagtaatgtccaaaatgatacagaagaactagagagctgtggtatacaagacatatttgttttctgcaccagagaggaactgtcataatatagagtcccaaacctctgtgatctctaccagcaatgtggaattatcacccatcatcatccaatcgcagatggagggactcctgacatagccagctgctgtgaaataatggaagagcttacaacctgccttaaaaattaccgaaaaaccttaatacactgctatggaggacttgggagatcttgtcttgtagctgcttgtctcctactatacctgtctgacacaatatcaccagagcaagccatagacagcctgcgagacctaagaggatccggggcaatacagaccatcaagcaatacaattatcttcatgagtttcgggacaaattagctgcacatctatcatcaagagnttcacaatcaagatctgnatcaagntaaaggaattcaaatagcatatatatgaccatgtctgaaatgtcagttctctagcataatttgtattgaaatgnaaccaccagtgttatcaacttgnatgnnaatgtacatgtgcagatattcctaaaaaaatattga

SEQ ID NO: 552196 - DNA, 710 bp, Homo sapiens
tatagggaaaccagattcatgttttattcccccagagaaaactcaaaagtaggaagctcctccttccgggagaaactgtcacaggtgacttcaggtcaccaaagggaggaggtacagaaagatgctggggtatgtgacgaggctgggggccactgaagcaccacagtgcagggggaaagaaacaaggagagacaagcggggctccccagcctaggaaacagagggtgtggcagccgggccagggcgtggccacaggcgtgggggccaaggggaggagctcccgtgacgaccaggtgcttttcggaggccctcgggggtggttgcaaagaaatggcctaccaaaatttaacccactgcagcaggccaggttgcacccgggaagccgacggcaacaatggtgagactcccccctttgcaggggtctagactgaactacttcccaccataggcagggcggaatacgcatgcgggtggcacatgcgactactgaaccggcacagcctgacacgtactgcagtgatgacccgtccgcgaccctccaataatgagctagccagttgcaggaaaggactgtctcagttcgaactcttcccagagtcggctaaactagagaagggccacgtgcaggggcggcggcaccggtccagtaatgcactccaatgatacaccgctggataacatcttccttgccaacgcgaaacaaccgctgc

SEQ ID NO: 552197 - DNA, 689 bp, Homo sapiens
  misc_feature (345)..(345): n is a, c, g, or t
gattttaccactgcactccagcttgggcaacaaggtgagaccctgtctcaaaaaaaaaaaaaagttttctaaaataagcaggatgattgtttaatttgaaaatggaccaggaaactagagtgcttttaaaatactctgtcttcatttttaaacaattgttgacattggaattacctgcttaatcaccatgagtttggtttggctttccatacagactgtgtatgtgtcattggagtggttcccagattggagcgaggtaatcctgactctaaattgaaccagcaattttttccctttagcctctgtgtttgcccactctgggtaatcgtcctcctatgtgggcanaagcccatttagacaatgcttaaaacctcgaggcaccatggcttttgggcaaaaaactccagtgcacttttaaacctagcctcttttgcactaactggacgctttcaacgcgagacaacacaatattttcccttgaacaaaaacctgcggcctggtccactctttttcccccctttgtatagcctcttaacgccacgcaagaacctttacagttgccccttgccctttttaccaccattaggtacaaacgtctccctttaaaacacaacacaacacccaaacacacattcggggagcaacctacacccagggctaccacaaattccccacactctgcccccaaa

SEQ ID NO: 552198 - DNA, 1527 bp, Homo sapiens
gggctgcagaagtaccgactgcggagtaactgcaaagatgctgtacagagcgcgttgctgcggccgtcggtccgcgcccttcctcggacgggccggacctggtctaccagaaatgcttagggttccatcatttccattgctgccacaggaacttcccatagcctctcaacactccatcttcgacaacagcactgggcactagctagagcatgtccatctattcttgcaagcagcgtatttcttgcgagctagatcacctcttgttgcatcttgcacagcaacactggagcgtgtcctatcaagatcattgcgtgcatggctcatatgccacgcgatcaaaatggagcttgcacgggccactcgttcacagcaagcacagcacacatggccacccgctcagcataccacgagcatatcaagcagaggcgctacatgataccacgcgaaccaccatctgcgcaaccatgcaaacacctgactcggacgtcagaaccgcagcatcagagacaacaagacaaaaacaaatcacccacaaccagaccacggcagcacacataagacgcacaaaaaggaccaagaggagccaaactcagaacacaacagaatcaccccaccaccaagcacagtacgaggaagacaacgccaaagacgacgacagaagcaaacgacacagccctagacccacaggagactacacaagaccaacaacagactaggaaaacagagcggcccaaacagaggcaggcataccaagagccaacgaccgaacaaaagacgaacgcaacagaagacacgagcacacgacgataacaaccgaggcacagcaacaccccccaaccaaaaagatacccacactagacaccacacaacacactacaaagccacacaccaggaccacaaccacgagacagaagacagagcaaacaaacacagcagaagaccaacaacgaagagcacacacacaacacaacgcaagaacgcccacaccgactacaagtgagccaccgaaacgaaacagacaagtcgggcagactcacagcggaacccgcacgaaacaggaacacggagcacgcattacacaaccgaaaagcgcacgacacggcacgacgtatgggcccaacccacgaagaggaccaggaccgcccaacacgcgacggacacatacgcgaaaaaacagcaccgcacacaagcacccgaggaaagagtacacacgagagccggacagcaccgcagcaggaacagcaacacaacagaaagcaggctaccagacacgatgccgcagcgccgccaacggggacaggaacccgcccaggcacggcacaagcaaacacagagagagaaacggcgaacccaccagagaagaggacggaggagagaaagggcaggaaagaacgaagagaaacgaaagcgacatggcaggagcaggaccaggcgcaagcaacagaccgacggagacaaggaggaagggacacgggaggcaaggataccaacaagacgcaagtgcgaagcacagacgccgagggcaaa

SEQ ID NO: 552199 - DNA, 135 bp, Homo sapiens
ggatttgctggtgcagtacaactaggcttaatagggctcgaattcgaggctcgaattcgagctcgaattcgagcctcgaattcgaggctcgaattcgagcttctaacgttagaagcttgaattcgagcagtagta

SEQ ID NO: 552200 - DNA, 136 bp, Homo sapiens
tttgattggtggctccaagagcaatgggaagtcaacagccaggaggctggacagcgattccctgtggaccccgacggtcccagacggctgctagggcagtggttagtcggcaaagtaagacaaggtccacagaggg

SEQ ID NO: 552201 - DNA, 906 bp, Homo sapiens
tgaggcgggaggatcactggagcccaggagttggagacaagcctaggcaacatagtgagatcccatctctacaaaaattttaaaaaattagatgggtgtagtggcgcatgcctgtagtcccagctacttgggaggctgaggcaggaggatcacttaagactgggaagtcaaggctgctgtgagctgtgatggccccgctgcactccagcactccaacctgggcagcagagtgaggctctgtctcaaaaaaaaaaaaaaaagaaaaggaaaaaagaaaacaagtggagtcgggggaacattaagggcaacacagaaggtgttcagaagattgtcctctattggataacgtttcccacagggtttttgggttaccaattttggataatcctacagattgtatacgggagctggaacagagtaaagtaaggggaggggggatgtggctgaggggaaccaggtttgccgataatgggaggggggaattcagagataagccaggcaggaagcaagtcaaatgatccctggtttcaagtggtacatataaacgggaagttgatgtaaggttagtatatatgccagatggttcagatggcattcttcgctagtgtgtgctctatttcttagcgatgtgtatctacagataatatcctaaggcctggcagtggagaaggcttaaacgaaatgataccccaaggccggtgtgggagcaacgcctgtatccagcatggggaggcaggcagaagatgctaaggccggcattgtacacgctggccactggacaacctatcttctaccaaacacactgcgaattacattcgtgcgtggggcacccgtggccagccaaggagaaaggggacaccgacacggtgagaatctgcgacgatcgtctcaacaacaacagggacg

SEQ ID NO: 552202 - DNA, 930 bp, Homo sapiens
ctacctgcacccaggttcggcccgtaggcgtctaggcagacccggcgccatacttcatacgagcgccatggccgcagacctgcgggccggtgagcggccgggatactagctatgctacctacggcttgcatattgtatatcttgctgaccgctgggcacctgaccctgggctggaacgaccctgacagaatgtttgctgcgggatgtacaagctcttaccctccactatgaccgctataccacctcccgcaggctggatcccatcccacagttgaactgtgttggcaggcaccagctggtttgtgcattcttcataccccaaacagtccatcacagatgtccagcacaccaccaggctgggcatgggtcatgcatgtcacagtgggcacatgtcaagcacggcacttcagcatcattgccatcacgacacatttctggcacaacgacttgtgggtcgcagctgttgcacaggctcatgcaggtcctcttgcaagcaccagccatgatactcagcaggttctctgtgggcttggcagtctcacattccagcattcatagcaagaaacattgagcctgcaagacaacctgcacgcgagttcttggaaccagccagcacacgagacttatgcgctcctatacgtcctgacttgatcactccatcacgtagggacccgtcgggccgagactacccgtggtaaccactggacgttgcgctctcgatatgacccaatcgaatggatacgtccatagggggtactccgctcgtctggatacgtctagtgcagccgtgatggcgtgtaggtgacccggcgccgggtataccgttccatccaaccgatgacatcctaaaatatccatcacaatcttcccacacgcgtacccagaagcaatcaccaagtttcagcaggaacgctcaatccaccaggtttc

SEQ ID NO: 552203 - DNA, 885 bp, Homo sapiens
ttttcttcatcccttacattcagttaaaggtttaagatgctagacttggccaggcatggtgacacacgcctgtaatcccagcactttgggaagccaaaggcgggtggatcacttgagccaggacttcgagaccagcctgggcaagcatggcgaaaccccatctctacaaaagagaaaaaatacaaaagaaattaacctggtgtggtgctgcatgtctgtagtcgcagctacttggtaggctaaggcgggaggaccacttgagcccaggaggtcgaggctgcagtgagccatgattgtgtcaccgcacaacagcctggatgacagagcaagaccctgtctcaaaaaaaaaaaggtggattctgagctactacgaggaaccgacaaccatatcttattggtcttggaatcccaagtacttggcaaatagcatgggtggaaggggatgactgacattgattgcagtgacttgagtgagctgactgatgtgagtgccatgacctgagtgacatcctcccaggactcggacacctgatagccctataattcccctcatcctttcctcttgaatgctcggcgcgggtgggcattagacctaagtcatgacctctggagataagacctgggttgaagcccacgcttgtggccacaggtaccatcaggtgagccctgggaaatgttacgcaacattctcaagcccaagtccttgagagcggagccaaggaaaactcccccacagggtcgcggggaacaccgaacaaaacggcggggatgcaccggcacacaacgtggccatggaaatcacccaggcggggcgaacaccgcccggcaatggccccccattggagtcccgtcggccccaaaacaaaaggcgggcacaaacccgga

SEQ ID NO: 552204 - DNA, 238 bp, Homo sapiens
cccggttttatccgacttgttgcagtatcatcacgcgcttgtgtgccagttactccatattttacttaacaatgtaaaagatgcaagaggtagatactgctggacaaagggatgattcaaggcgtgatgatcgacgtggatggcacgatgatttcatcatgcttgcttatttaaacttactaagatacttggcctcagcttgtagcaaactatctaagagctaagggggtaccgacgc

SEQ ID NO: 552205 - DNA, 319 bp, Homo sapiens
tgttgatagcacaacctagggtcagttttgcaggtggtaagccatttaccaagatagttgtaggtaaggaagggcagatttattagagaaatgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 552206 - DNA, 439 bp, Homo sapiens
tatcttttgacattgtaaaaacattaaggatatgagttgtatatttcatagtagtcaaacagtaatctataatccttatatggataccaatttttaaatggtttatattttatagctaaatttcaggagtgaaaagaaaaagaggaaggaagaaaccccactcaggcaatcatgtacagccacccgaaacaatgaaatgtaatacattcataagacaagtgaaagaagagcatggcagacacacagatgcaactgtgaaagttccttatcttaagaaatgcaaggaagcaggacttcttaattacttacttgaagacatattagaccacagttcattcaattccagaaaaactcatggatgagactacttcagaatcagactatgaacaaatcggcagtgcactttctagactgtacattgttcgaagacacatccgcc

SEQ ID NO: 552207 - DNA, 384 bp, Homo sapiens
acctgcccccatcactttataaagtcagcaggatgtctctcacccaccctgtgcgtgggtctaacaaatttatcttgtcatgctctcatgtgtttggagccacaccgatcgggtgggtggtgaaccggctctctgtaattgtagcatccaaatgacaacagccgccgagcagcgaatcttgctcaggcccacagcatgtctgagacaagactccaacaagtaataattagctttttttctcctgccggctacagtagctgtcttactaaagagcttcccacagtggagggaaaggccatagaatccaggtgtcattcagagccagtccttgctgaaatgtggtcttccagtggaagcacctcttttattgagaggagacagtgt

SEQ ID NO: 552208 - DNA, 339 bp, Homo sapiens
ttaaaaaggtttaattggcttatggttctgcaggatgtacaggaagcatggtgctggcatctgctcagcttccagggaggcctcaggaagcttatgaccatggcaaaaggtgaagggggatcagacatgtcacatggtgaaagcaggagcaagaagggggcagggggaggtgccacacaattcctttagtgttttcaatcacccagtactcggttctcttagagcaaaaatcctttggtgctagctcagtgttaggaaacgtctttatctcaatggcagacgttctataccaattcaagggagttcaacaataaaattgatttggccttggtctgcagt

SEQ ID NO: 552209 - DNA, 172 bp, Homo sapiens
  misc_feature (27)..(29): n is a, c, g, or t
  misc_feature (89)..(89): n is a, c, g, or t
  misc_feature (109)..(109): n is a, c, g, or t
gccgaccctccccaaggtaaggtttgnnnccagggcccatcatgccattgactgtgggtgtctagacctcagggccctcatctggaaantagagcataggcaggtagcntggcagggactgacaccccagtgcccagtaaggaggcagtagaaaaccttccaacagcccagt

SEQ ID NO: 552210 - DNA, 169 bp, Homo sapiens
cacgagggaggtgcatattaatgggggccgcgactcacgggaaccggagccctgggacgtcggagattgactagggatgctggtgattctgaccggcacattgcaaccgcatagggttaactcttctgtctccgctgccgcaggtgcatgtgcacgctttgcccgtgtg

SEQ ID NO: 552211 - DNA, 254 bp, Homo sapiens
cggcacgaggggaaacagcccaggacaaggccaacagtgtccgggtcccagggaagcaagaccgagctgggcactgggacaccccttcccacccgggggacgcactgcaaaggagtgtgatggcgttggaatccctctggccacgcaatgtgctttaggagtgagaatcccgcagtggccgtgggagtggtgacgagagaaggcaatgcactcaggtcccctcagtaaactagagctgtgttttctcaaaaaaa

SEQ ID NO: 552212 - DNA, 262 bp, Homo sapiens
aaaaaaaaaaaaatgatggccatataaacgctttttttggatgggtcccccctggtactggaaaaatttgccagcccttccccggtaccctcctgtgaggcagcttatttttaccccaacataaaaaggatggtttggaggaggtatccaatttaaaagataaagccatccgaaaggttgggtttttttctatcttaatgtggatttcaaaattaaagtctatttattcagccattccttaaaaaaccggattttttgggga

SEQ ID NO: 552213 - DNA, 239 bp, Homo sapiens
caaaactacgcaggtgttagagcaaggaacgtgggtcccagtgagctgagtgccccaggtatcgacatgattctgaaggtcattgtcattgggtgctgcgctgggttgcaaagacaccgtctaggcttcctgggggccgtcctgggcctcggcggccacggtgctggactggagcaggaagtctttgtaggccatctcggcttcctccttggatgacctttttgccttcttgggttctt

SEQ ID NO: 552214 - DNA, 252 bp, Homo sapiens
tccagtagggaggaggaggaaacgttgttaaaaaaaaaaaggttcctttaaaaatcctgtaaacctggatttcaaaactagcctggtgaacagggtgaaaccccgtctctactaaaaatacaactatatagctgggcatggtggtgggccgctgtattcccagctactcggaaggctacggcaggagaactgtttgaacccaggaggtgaaggatgcagtgtgctgagatcgcaccattgcactccaaccgg

SEQ ID NO: 552215 - DNA, 1155 bp, Homo sapiens
tcccccccgcgcgctgcggcgcgttagatagagcgtggttttggtgctcgctgctgtttgttgggtgtactacttactctgctgtgtggtgttttgccgtcctatgttttgatgcgtgctcgtcggtatcctctctctcctgggtgtttgttttgtttgtctactttctgcggggcggcgctacttcattttttttttttctcctcggtgcgagatctggttgttttgttttatctgttctttgtctctctgtttttttgtggctgctcgtcttattgcccgctgtgttggttggtgttgctctcttcgagccggctggtgtggtttccgtctgctctgtgttttttcttcggcggggtttttttgttttcgtgtccgtctccttggtctcctgttgtgtgttgctttttgggtggtgggcccgctctcccccctcacattgttgtgtttttttgtgttgtggctcttcttctttctttggttgtggtgtgctcctctcttcctcgctcgctgttgggtgtgtttcctctctctcgtggtcgtctttcgattgatatgttattgattgtttgtggtccgcccgcccctcctctcctctcgtttaggagggtgtttctcttctctcttttctcccccccgccgcgtttttttttttgtgttggctctcctcgctcgtgggtagtaggtcctctctctttttttgtttgttgcgcactcttctctttcttttacaaaaggtttttttttttcttctctcttcttctttattatattctctctctttggtgtgttataaataaaaaaaataaaatatattttctctcccccctccccccccacataaacacccccaacccacaataagattgtttttttttcttgtgtttcgctccgtccattttatatttgttggtggtgggtgaggggcgcgcgcccctcttgttctccctctctcttcttcgcaccaccctctctctctttgttatgagaaaatgttgtgtgtgtgtggggtttttttctctcttttttttctcccccttctttttttctcctctttttttttgttttttttttttcccccccccccccctctctcctctccttctgtgtgtgtgtggtgatgatgatagaaaaacacacaccctcctacacata

SEQ ID NO: 552216 - DNA, 375 bp, Homo sapiens
gccttccaggtaacgggtgtgagagtaagacgctgcctcccaatgtcctgtacggcatgtgaccaagctcttgttcccctaacgtctcaacaggcgctcactgaagtgtatgaatatttaaagaaaggtttgtgcagtaagctagtcttcccctctgctttctcgaaagcttactgagccctgggccccaagcacgggccgggccatacgcagtttcctcttccacaagctgccgcttttctgggcaccttgaagcatcagggcgtgagatcaaactagatgtgcgccgggagagtgtcgcttacctgccctgctggggaggtcttcctgaaactgggtttaatgctttatagaaatgtgaacactgaatttatt

SEQ ID NO: 552217 - DNA, 306 bp, Homo sapiens
gcgtctctttcgcgtatgcccttgtacctaccactcagcaaaaaaagctatagttaatactctcgatctcagcatcgctgctagtgaaatcaaagagccgtctgaactatcctgcccgccatcatccgagtcctcatcgccctcccatcctctacgcagtcctttacagtaacagacgagatcaacgatcccgtcccttaccatcaagagtcaagttggccagcaatgtgtagtgaaccttaccagtacaccgactacggcggactagtcttcaactcctacatacggaagagaaccaacgctacg

SEQ ID NO: 552218 - DNA, 795 bp, Homo sapiens
ccagggcgggccccagatgagggtgcccttcgaccatcgagccgacgggcatccttaacgttcccggcccccggacaaggagcacccggcaaggccaacaagggtcaccatcccccacgacaaggccgcctgagcaaggaggagatcgagcgccctggtccaaggaggcggagaagtaccaacggaggacgaggtgccgcggcgagagggtgtcaacccagaacgcctggagtcctacgccttccaccatgaagagcgccctggaggatgaggggctccagggccagatcagacgaggccgaccagaagaaggtgctggaccagatgtccagaggtcatctcgtggctggacgcccacaaccctggccgagaaggacgagtttgagcaccagaggaaggagctggagccggtgtgtaacccccatcatccgcggactgtacccgggtgccggtggtcccgggcctgggggcttcggggctcacgggtccccagggagggtctgggtccggccccccccttgaggaggtagattaggggcccttcccagattgctgtttttgttttggagcttccagactttgcctttcctagtatttctgtttgtccgttctccatttcccgtgtttgccatgttgaaattttttggtgaagtactgaacttgctttttttccggtttctacatccgagatgaatttatactgccctcttacgactatttcttctttttaatacacttaactccggcccttttttaagttggttacttccaagtaaatcaacctttaaaattcca

SEQ ID NO: 552219 - DNA, 189 bp, Homo sapiens
ttacagctcggtaccgcaccaggcgcacttcttgggaggcggaggcaggtggatagaggtcaggagattgagaccatcctggctaacacggtgaaaccccgtctctactaaaaatacaaaaaattagccggacgtggcggcacacgcctgtagtcccagctactcgggaggcagaagtgcgcctgggtg

SEQ ID NO: 552220 - DNA, 365 bp, Homo sapiens
cagagagatcccagctacgctgcactgtctggccggagaaagagaaccatgcagtgacactggctcagtagtgcctttgcattggtttggctttgcgctacgcagcactggttgctatactggtgtggatcatatggctatgtaaaatgcaggcagcgtgccgtccctggctagcagggttagtctattggcagtctagccgggcctgagtgcttaccagctagtctcagagatccaacggaacgttatgggtattcctaagctacatcttggtaccttggctaggcattaatgggaatcgaggttctaccagatctggagaaattcatagcctgccaggtttacatttgcacggtagcccagtt

SEQ ID NO: 552221 - DNA, 1688 bp, Homo sapiens
  misc_feature (840)..(840): n is a, c, g, or t
tgcgtcttcgacatgtctgtgtggtgggacggtgttgtgttgtgtgggcgtgcgtgttcgtgcgcatatcgatgtgtgttggtctctgtcgtggggcctctaagtcgtcggcttttcgagcaggttggtgcgtggttgttcgaacgagcgctgatttctcgtcggcgtggtgtgtcgtcgcgggtgtcctccgaacgctacgtttgtcgtgtttttgtgagggcgttgggtccgttcgcccgcgtgtgatgtatggggttggttttttggtcggtagagcgctcagttgttcttggggggctgccacgcatagctgggggggcgcccgcagtgtgtcggttctggggtgtgtagtttggatctgtgtttgctccccgcgccgggcttgctccagcaaaggggtttttttcttgcgacacgaacgctctgggggggccgcttgtgaggtctatgtcacttgggaagttcgcctcgttgggggtggttcctctcgttggggggggttgcttacacaccgcttgtcgcacacccacgtggtgggcccacttaaagtgtggcgccacggcaaattgttaagttcgaaaggataagtggtgtttggataaaagggggaagcagccacagcgggagaaaaacggtggtgccgctcggagacggcaactgggtgtgatgttctgctcgagacaactggcagaggcacgtagcggctgtttggcgtcctgggaagaaggtgtgcttgggggcctcttcttgtggtggaaagaagcgggaataggtggggaacccaccacccacagctcttggtggtggtttggaaggaagtacaccacctgtgccccncccacttcgtcgtcggggagaggatcccaccgcgaagacctggtgcccaccctcgagcaccaccagcagaagagaagatgtgttcgagacgcctcggtggtgtggtttatgagagtggcccacgactggtcttgtgggggggccccgcacacgccccctggtttgtctgggcgcgcgctctggcacgctgtcctttgtggagggcactcttcgcgggcacataggcgcaacacacttgtcgtgtatgaggcacccccacttttcttttgtcgtctcggcacaggagtgtcgtgtgcccgtttatccctcatagaataaataagaagacacacacgccacacacaggcgacacacctatattttttctatatataacgcacctcggtatacacacagctctttttgcacactgttgtctcgcgcacacactattatgctcacgcccacatgtgtctatatataaagagataaggaaatatgtacatgttgtgagaaagaactctaaagaatagtgttttgtgtcttctgtgtctcggcgtgtgtcataaaatgagggcctcttgctggtgatataagatatgagaaatatatatcgataaactcgagagctcgtgtcttgttgttagatatgatagagcctcaaactctgttattcacacccactcggggatgttgagctgttgtttccctgagaattaagattcttttccacctggtgtctactacctgagccactataaacactgttctgcactttgaatttcttcttaaccctaaattctcgtggttctatgagaaaataccaatgactatttaatattattttctttactgttttctttcaccga

SEQ ID NO: 552222 - DNA, 759 bp, Homo sapiens
ggaagaaaatcacagtaacagtaacatgtgggtgtgggtgtagagggatatcttcttttccagcaccgtatctttgaatctgcccaccttcccctgagaattggctttgattaccttgatgttggttattctgatagacgaagctgcagggcagggctaatgtacattaatggagatgtgtgtataaatcatctcacagaatatacagacatcctctgtctctagaaagttggcctctttttgaacttctcactatgtcctagttgttacagaagtaatttagaaaccccagaagaaatatataacatagggtctattgcatactgggcctgaacaagctggagaggaataatttcacatttgatggcaggctattttacttgtttgtctttcttctccctttgcttcctgccttgctttgagtgactgcagaagctttttgtgattgtagggagccttggccaatgtgggaataggacccaggaattcaaatttctcacctgacatctgcagtaccttcagaatgcttctgaaactgatataaatgaacgaaatactccaaaagattactattgaacaacaaaataaaaactttcacatgattaaccatatttagtcgcattcttcccttttcaggcccaagtatatagctgagatgggtctagtgtcttacttttcatgtaaccattttaggcaagttctttctcagtttataactagaacttttcatcttcaaaccttcttatgtgggcacggaaa

SEQ ID NO: 552223 - DNA, 743 bp, Homo sapiens
caggagtcagcctcgcccccaccccctacatgtgttcagtagggttcagagtgtagggaaggattttactactactcatcttatgggagaccaggactgcctgctggcagctgcttctaagtgaaatcgaatctgatccccactttaacccaaattggggcttggaccgaagggaggtgagacactcccccaggtcccctcccctttcaaacgtccagtctcatttgccacttcatgccccgtgccctaaactgggtggacgtaacactgctttaaagaaacagagcgaccattcccatccgtatggcttcttgtaccctgtaaatagaccatgatttcgatcagtatttcttgtcccgaggcctgttcctataccgcagatgtgcccccatcccctgaaggagctggtgtctcagaacctggggtcgcggcagtatcaccgccggatgatggaggggagcgcgaaaccggagtggagacggggccagagtacggacagcttggcggccagcggcacaccccctgcccaagccagacgcggagaggacagcactcttctgataatataactacaatatactgctactgtattagtatcaaccggattggacggacacaatgccacacatgaaaaggatcgaagaccaataaaaagccaagcccccagaaaccaacaaaacaaacacggggcaccgctacacacaaaaacaccacaaggggcgcaaggataccacaacacaagt

SEQ ID NO: 552224 - DNA, 746 bp, Homo sapiens
aagttattttcatttcctgagctgggaaatttaccttttccagcaagacagaagattgatgagaaagagattatacatctattcagaattatctggcacagtgctataagtatttgaagatgatggtgataggaagaataagaaaataaaatagctgttttattgtgatgtgaataaaaatattgccatcaaagcttactcaataatgctttgagtttagatacattataaaaagtcaaaaaaccaggaaaagcattttacggtataaatacctcatagaattaataaaggaagccctgtataatttaaaaacaaaatcaaaaggaatccctgaacttcagtttacagacaggctataacagattgcatgatgtgtacacgtctgtatgattgggtaggatagacttcgcacagaatctcctggccaaggggggctgagccctggtggggctcacttagccaggaggacggagggccgttttccaatttgttttcttagaggaaataactttttataatccaaccctgtcaaagggggcgcttttcctaattcattaacaagtcttgcactaagttggtagtataaatattcaataaagaccaagaagagtccttggatagctgtagtagaacattggtctagaaatacgtaggcgcaattttaagtccttcctgcgtcactaaccatgaatgtggtcttagcgtctcttagtctcatttcctcatttgcaacattagtcggatta

SEQ ID NO: 552225 - DNA, 834 bp, Homo sapiens
  misc_feature (58)..(58): n is a, c, g, or t
  misc_feature (163)..(163): n is a, c, g, or t
  misc_feature (368)..(368): n is a, c, g, or t
  misc_feature (384)..(384): n is a, c, g, or t
  misc_feature (393)..(393): n is a, c, g, or t
  misc_feature (395)..(395): n is a, c, g, or t
  misc_feature (408)..(408): n is a, c, g, or t
  misc_feature (411)..(411): n is a, c, g, or t
  misc_feature (414)..(414): n is a, c, g, or t
  misc_feature (417)..(417): n is a, c, g, or t
  misc_feature (422)..(422): n is a, c, g, or t
  misc_feature (425)..(427): n is a, c, g, or t
  misc_feature (429)..(430): n is a, c, g, or t
  misc_feature (433)..(433): n is a, c, g, or t
  misc_feature (438)..(439): n is a, c, g, or t
  misc_feature (445)..(445): n is a, c, g, or t
  misc_feature (447)..(447): n is a, c, g, or t
  misc_feature (449)..(449): n is a, c, g, or t
  misc_feature (453)..(453): n is a, c, g, or t
  misc_feature (455)..(455): n is a, c, g, or t
  misc_feature (459)..(459): n is a, c, g, or t
  misc_feature (465)..(466): n is a, c, g, or t
  misc_feature (470)..(470): n is a, c, g, or t
  misc_feature (472)..(472): n is a, c, g, or t
  misc_feature (474)..(474): n is a, c, g, or t
  misc_feature (482)..(483): n is a, c, g, or t
  misc_feature (485)..(485): n is a, c, g, or t
  misc_feature (493)..(493): n is a, c, g, or t
  misc_feature (495)..(495): n is a, c, g, or t
  misc_feature (503)..(503): n is a, c, g, or t
  misc_feature (510)..(510): n is a, c, g, or t
  misc_feature (527)..(528): n is a, c, g, or t
  misc_feature (530)..(530): n is a, c, g, or t
  misc_feature (534)..(534): n is a, c, g, or t
  misc_feature (536)..(540): n is a, c, g, or t
  misc_feature (543)..(543): n is a, c, g, or t
  misc_feature (556)..(556): n is a, c, g, or t
  misc_feature (559)..(559): n is a, c, g, or t
  misc_feature (567)..(567): n is a, c, g, or t
  misc_feature (575)..(575): n is a, c, g, or t
  misc_feature (579)..(579): n is a, c, g, or t
  misc_feature (583)..(583): n is a, c, g, or t
  misc_feature (593)..(594): n is a, c, g, or t
  misc_feature (596)..(596): n is a, c, g, or t
  misc_feature (598)..(599): n is a, c, g, or t
  misc_feature (601)..(601): n is a, c, g, or t
  misc_feature (622)..(624): n is a, c, g, or t
  misc_feature (634)..(634): n is a, c, g, or t
  misc_feature (636)..(641): n is a, c, g, or t
  misc_feature (658)..(658): n is a, c, g, or t
  misc_feature (662)..(662): n is a, c, g, or t
  misc_feature (667)..(668): n is a, c, g, or t
  misc_feature (672)..(672): n is a, c, g, or t
  misc_feature (680)..(680): n is a, c, g, or t
  misc_feature (685)..(685): n is a, c, g, or t
  misc_feature (694)..(694): n is a, c, g, or t
  misc_feature (696)..(696): n is a, c, g, or t
  misc_feature (710)..(711): n is a, c, g, or t
  misc_feature (713)..(713): n is a, c, g, or t
  misc_feature (753)..(753): n is a, c, g, or t
  misc_feature (819)..(819): n is a, c, g, or t
tgtgtggcgagtgaaggggcatatcagtcacgaacgtgcttccaggttcgagcgattntcccgctcagctcccgagtggctgggattacagacatgtgccaccactcccagctaatttgtatttttagtagagatagggtttctccatgttggccaggccggncttgaactcccgacctcaggtgatccgcccgctcggcctcccaaagtgctgggcttacaggcctgagccaccacgctcagctcagcttcaccctgtctgcaaagaaaagttttaccaagaccagaagtgaaatatgacatttcctaggtagttgtaactctaacatagtttaaaaagtatgtggcttcagattgcctatactttnttcacaaacgtgtganttagatatnantgatttagaagtnaanaanttngtaanatnnntnnacnaaaannagtatncntnttgnangtantcagcnntcantnantaaagaanntnacattatnanaccaaatntttattnaccatcatttatagaanntntatngnnnnngantccaaaaatatanttnaataaaantaatattntttngaanataccaccgnnantnntntaatagctgaccaacttgccnnntgcctacaanannnnnngcagctaagcgatacanacanctctnnttanaacataancccanaaacttatnantattaatctctaannantatctaataaattcatcacaaaaaaatttattaaattccnaaaaaaatatctccacatataacaatattccaatattattaatacattaaccattcaatttaaatnaatctttaactaaaa

SEQ ID NO: 552226 - DNA, 356 bp, Homo sapiens
aaaattttgttttatttatttcttatttattccccccccccttttgctagtgggattagggagtgagggaaattataatcccgttttggatattttgaggttgaggagcctgtgggttccccatttggaaaagttttggaagcagaccaaatcccccgccctagaactcaaaggtggtcagggcttaaaatacaaatgtaaatgcccggctgcccatgatggccccaacctataatcctagctccttgggaggcttaggtgggaggactgcttaaacctgggagttttaggctccagtgagccctgactgcccccctgtacccccgactgggggcccaactgagatcttgtcccca

SEQ ID NO: 552227 - DNA, 180 bp, Homo sapiens
gcgctgggctttacatgatgctcgcagcggcgccatgttcatggatatctgcagcaatcggcttgcatccacttcaacattcgtcgggcatcccagctgcttcaaatatcgtgcaatcagcgtttcccagccgcacaccaaaccacgcaaccaaaattatcccaaatcgcatgcatgcag

SEQ ID NO: 552228 - DNA, 158 bp, Homo sapiens
tcgacaagcgagcgcttcgccagccgtttctctcgcttaatcgcgctggaaggcaccggggaggtgatggaggagccgggggaggacggcgaggtcgcctcgtacccggtgtacgcgttctgcagggtgagggcgcgcttccatggcgtcgagctcga

SEQ ID NO: 552229 - DNA, 590 bp, Homo sapiens
  misc_feature (28)..(28): n is a, c, g, or t
  misc_feature (41)..(41): n is a, c, g, or t
  misc_feature (46)..(46): n is a, c, g, or t
  misc_feature (278)..(278): n is a, c, g, or t
  misc_feature (402)..(402): n is a, c, g, or t
  misc_feature (421)..(421): n is a, c, g, or t
  misc_feature (426)..(426): n is a, c, g, or t
  misc_feature (504)..(504): n is a, c, g, or t
  misc_feature (586)..(586): n is a, c, g, or t
  misc_feature (589)..(590): n is a, c, g, or t
cgcagtgttccaggtcctaggatcagcncagagtggacccngttgncgccaccgattgcgttgcaggtgctgaatacctgctgggtgccggcggtgtttggcaggttgatccccagctccttggcaccggccagcgccaggttcaaatccttctggtgcaggctgatacggaagcccgggtcgaaggtgcccttgatcatccgttcgccatgcacttcgaggattttcgaggaggcaaaaccacccatcagcgcttcacgcaccttggccggatcggngccgttcttcgaggcgaacagcagcgcttcggccaccgcctggatgttcagggcaacgatgatctggttcgccactttggcggtctggccatcgcattggcgcccacagggtgatgttctttgnccatggctggaacagcggnagggnacgttcgaggtgtgcgggtcgccgccgatcatgatgtcagggtgccggccttggaccgattcaccgccggaaacgggngtcaaggtaggcgcgcgttcgtgatcttgggggaaggttggtggggaggtgagatcgatcattcgtcaccgatctttgtttncgnn

SEQ ID NO: 552230 - DNA, 792 bp, Homo sapiens
  misc_feature (230)..(230): n is a, c, g, or t
gtccctaagtgcgggagaaggaattcatagagtaattcatgtctgatgcacccaccataccattgcttccttgcaaacagtgcatgaaagattaggtgccgtcacactaagccccctcgtctggagttagaaaagtagttcttgttcaatatgtccctcacacgcgagcgctgcctaaagatcagtaagagcgttacctccccgacagacagatctagatttggtttcanatccgcgcaatgaagctcaatagtatgagctgagagatccggatctgagacccgaccgccatcctcacgtttttttaggtcttaggccggtctgaggccggtcagagaccagaattgtagaggggcgccgcgttacagggcccagtgatgtagtactggcaaagcggaaacacaaccttcaccgctctttgtttgttgttttgttgtaatgtgttttcctgctagaatgtgactttggggtcattatgttcgtactacaagtgatctgtaatccctatgagtatatatatatatatatatatatatatatatatatatatatatatataaaaacttagcacgtgtaatttattattttttcatcgtaatgcagggtaactattattgcgcattttcatttgggtcttaacttattggaactgtagagcatccatccatccatccatccagcaatgtgactttttcatgtctttcctaacacaaaaggtctatgtgtgtggttagtccatgaactcatggcattttgaatacatccagtactttaaaaatggcatatatattt

SEQ ID NO: 552231 - DNA, 655 bp, Homo sapiens
tgacgagggcggctccggcaggttctgggctccggacgcgggcgccaggtgcacatgccccagtcctgctgctgtggctggtgctgtcgacatctgccgctgtgagcgcgagctggagctacacctgctttctgtgaccctgtggatggcctgcttgtgatgctgtctggtgctcatgccatgctggctgctgtgcggtgcctgcttgcaatggacgctgtgtggcctcgtgagtgggctcctcgctggtgctgcgcgccgggccgtgtggccggatggctgttacttgcatggtcttgtgtgctgtgcctgaatctgtgctgctgcgtggtggagccattgtggtgcccatgaagttgttgtgttgccctgatggcctgaaggtggtgaatgactgatcctggcctggtgatggcccagtgctgggatggctacccctgctgccctgcgcccgtgcctacgtgagcccgcgggcgcccttctacctggcctctgtgctcctgtgagctgcgtggcacgccagctggagctgggctgccgagcactgcgttgcttgctggactgctgctggccaggtgttctcctggtggcgggggcaggcatggacagctgggccatgggaccctggatggcagaggctggagccacgggctgt

SEQ ID NO: 552232 - DNA, 375 bp, Homo sapiens
  misc_feature (93)..(93): n is a, c, g, or t
  misc_feature (97)..(97): n is a, c, g, or t
  misc_feature (159)..(159): n is a, c, g, or t
gaaagaaccatctacatagatactgaagtcatcaagaactatagcaggacatctggtagagagggagtggtgagaagagacatgagccaagantgangtcctcactgaccaagaggctgtagattaccatgccgagagcagagcagctggtggctagantttagctaattgcagctactggttagggacagcgtagagcagaggtctgcaaactttttctggaaaagaccaaaaagcaaatattgtaggttttgctggtgatatatgtgataggcagaataatgcctcctccaaagaggtccacgtcctaatccccaaaacctgtggaatatgtccgttacacgattaaaagggaatgaaggtagcagaggaaac

SEQ ID NO: 552233 - DNA, 902 bp, Homo sapiens
tactctaccatctttgcaggcacactcatcacagcgctaagctcgcgactgatggttttcatcggtgacgtatggcactagaaatacgacatgctagcttttattccagttctaaccaataaaataaaccctcgttccacagaagctgtcagcaatgtatttcctcacgcaagcaaccgcgtccagaatccttctaatagctatcctcttcaacaatatactctccggacaatgataccataagccaatactgacctaatgcaagtactcatcgatgtgaatagatcataatggtctatagcgaataaaactaggaataggccccctttcacgttctggagtcccagaggttacccaaggcacccctctgagatccgggctgcttcttctcacatgagaaaaactagccgccatctcaatcatataccaaatctctccctcaaataaacgtaagccttctcctcactctctcaattcttatccatcatagcaggcagttgaggtggattaaaccaaaaccagctacgcaaaatcttagcatactcctcaatttacccacatatggatgaataactagcagttctaccgtacaacctaacataatcattcttaatttaagtattatatgatcctagctactatcgcattcctactatcaagttaaagctccagcaccagaccgtactatattctcgcactgatacaagctaacatgattaaacccttatttcatgcacctcctctccttaggaggcttgcgcccggtaacggttttggccaaatggcattttggaagattgaaaaaaaaggctctatcccaatataggagctaccgctaactatttaagagggaaaaacataaaataccctttaaggaataggggggggaacacccttccatg

SEQ ID NO: 552234 - DNA, 332 bp, Homo sapiens
  misc_feature (36)..(36): n is a, c, g, or t
  misc_feature (49)..(49): n is a, c, g, or t
  misc_feature (70)..(70): n is a, c, g, or t
cttagtggattaatgagccagaggttgttttgaaanccaataaatagtncccacaggctgggtgtggtgncttatgcctgtaatcccagcactttcggaggccgaggtgggtggatcatgaggtcaataaattgagaccatcctggccaacatggtgaaaccccatctctactaaaaacacaaaaattagctgggcgtggtggcgcacacctgtagtcccagctacttgggaggctgaggcaggagaatcactggaacctgggaggcggaggttgcagtgagccgagattgtgccactgcactccagcctggtgacagagcgagactccatc

SEQ ID NO: 552235 - DNA, 101 bp, Homo sapiens
ccccctagcccgacaggttcccagcaccgcacgttcgtggggaaccgggcgctaaaccattcgtagacgaccggtcgggctagtcgggggggtaccgagct

SEQ ID NO: 552236 - DNA, 393 bp, Homo sapiens
atatggaaagattcccaagatgtatgataagttaaaatgaaaagagcaaggtggctgggcatgctggctcacgcctgtaatcccagcactttgggaagccaaggtgggcggattgcctgaggtcaggagttcgagatcagcctggccaacatggtgaaacaccatctctactacaaatacagaacttggccgggcgtggtggtacatgcctgtagtcccagctactggggaggctgaggcgggagaatcacgtggacccaggaggcagaggttgcagtgagctgagatcgtgccattgcactccagcctgggcaaaaagagccaaaattccaatccccaaaaaaaacaacaaaaacaacacaaaaaaaagaaacaactgtgttgggcgcgcgc

SEQ ID NO: 552237 - DNA, 467 bp, Homo sapiens
ctgagttgagtctttatcctcttattcagggtatgcttctacatgaatattaaggttggtttcctagttctttgaaaaatgtcattgagtctatacattatttggtgtcttgtgatattttgagcaacattaattcttctagtgcaaaaacacagatgatcttttcatgtttttgtttcagtttcatcattgtcgagacctctctctcctatggttaacattagtgacttagttgtatgatctgtgagtagggttatttttctgatttctttctcaacaactttattattattctttaaaatgtagctcacagcttcactgaatcaccattttcatcaattcaaatagactttggtgatgtctctttcagaagatgttggttttgagtacagcaaccagtcgtagtaggttacagagtttatgtgttctgcatggacacagaccttccaggatggaggcagcatgca

SEQ ID NO: 552238 - DNA, 260 bp, Homo sapiens
ggagggaggcagcgcgcacggtgcagccgggccgggcgggaggcatggcggggcccccggccctacccccgccggagacggcggcggccgccaccacggcggccgccgcctcgtcgtccgccgcttccccgcactaccaagagtggatcctggacaccatcgactcgctgcgctcgcgcaaggcgcggccggacctggagcgcatctgccggatggtgcggcggcggcacggcccggagccggagcgcacgcgcgccgag

SEQ ID NO: 552239 - DNA, 273 bp, Homo sapiens
agtctcatagaggatccccacgcgtcaatgtaacacgaattctcactttcatcgcagctatcagtttaatatgacatactctggaatgattttacaccacatatattatccacaattacttgctctcataggggtggatcgaagtcttcaaacttgaaaaacaatctaagaaggttatagtgatactcggttctgacatcttcatcagcgcctacacactgtggcaaacactgactaattacactgcaacaaggagtggaacgatgattccga

SEQ ID NO: 552240 - DNA, 225 bp, Homo sapiens
cgctacaaggccccgcaggagagccaggcaggacttggcctccagtgaaaatggcactgagtgccgcagtggctttgtgcggcataacggctcctgccgggtcagtgtgctgaccatcttcccaatgttacttgtcacaagtggctggccaggtgctaccgtgtgtggacgaacatatgggtgccttctgcagtgtgcaacactgcaggactactatctggcaca

SEQ ID NO: 552241 - DNA, 681 bp, Homo sapiens
agcgggaagacgtcaggtgcgctcccctaggagtgctgagcccgagaatcgagccatgagtgaggctgatgtgaatccaataggcctatgcccgttgccgatgcgcacacgtctgaccaagaagcctagtggactctcgattcatgcaactaactgtaacatagtaagcagcttctggacaacgggtagcctaagtgatggccaccgagagatagtctcgtcaacagaggcgcctctcggtgaggtgtcactcggtcgatggctgcacgacgtcgcgtaggcccactggggagtgatccatttcgtgtgcgagcgcgtgtaccgtgcgtgcccttgctgtttggagggtcatgcgagggagcaatggtggctccgtaatcggatgctatgcgggctggcgtgcttctcaaagttcaagtgtctctcttgtggtgttaactaaggcttcgttgcttgcgtcgtggtgcgttctccaaggagttgtcctgttgtggtctaagttgctggtgccatggccttgtcctgtggcttgccgtacacgtcttatgttgtcgaggacatcggcatcaggggggccattgcggggccgcaatatgctccttgggtacgctgtatcacccacttggatctcgcgcggataaggttgcccctgcagctaactttcctccctcgggtggctta

SEQ ID NO: 552242 - DNA, 152 bp, Homo sapiens
agctcggtaccccggcaaggcatccaattccggcactaagaatcatccagcgatgaccgccggtaccgacagcagccatcccacatgccgtgatggccaccggaaccatgcgcacatcgggggtcgaaacaacctggcgttgatagtcatca

SEQ ID NO: 552243 - DNA, 162 bp, Homo sapiens
acaaagcccagatcaacagctccagatatacaacaggtccagttacaacagctcagttacaacagctcagttacaacagctccagttacaacagcttgagctctagaggtccatgcatacttcatattatacttgaattcaatacgagctgtttaactggag

SEQ ID NO: 552244 - DNA, 314 bp, Homo sapiens
gtatgcacaacctagggtcagtttgcaggtggtaagccatttaccaagatagttgtaggtaaagaagggcggatttattagagaaatgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtttctaacaattgttcatacaataattgttcattattgttctcaacttggggctctccccaacctggggacccttcctta

SEQ ID NO: 552245 - DNA, 374 bp, Homo sapiens
cacgaggtttttttttgagacggagtctcactctgttgcccaggctggagtgcagtggcgtgattttggctcactgcaacttctacctcccaggttcaagcgattctcttgcctcagcctcctgagtagctgagattacaggcatgtgccaccatgcccggataatttttgtatttttagtagagacggggtttcaccgtgttggtcaggctggtctcgaactcctgacctcgtgatccgcccgcctcggcctcccaaagtgctgggattacaggtgtgagccaccacgcccagccgggcctagaaatctagatcaaggtcttggactagtcctaagtccagtggccactgaaagtataaaccatggtcatttt

SEQ ID NO: 552246 - DNA, 442 bp, Homo sapiens
gttattattaccatttatttattatttttttaaatgtgaaagcaatccataatttagggaaaattggaaaatataggaacctttaaacgagaaaatgaaccctttcatattccccttgcatagaaataccaagcgttaccattttcatatttttttctttcagtcatttttctatttgtggtataggtatataggtccctatatgtatttgcatttgaaattttggaatcctgctttatgtccagttttgtattatactttttaaatcttgacctttataaccattttttgaaatcattgatttttttccaaaaacatgtttttaaccagctgtaaaatattttatgatatgaatgttttatgcattatttaagcctgtttttattgtgggaatttcaggtctttttcataaatattgttgcaataaatatccttgacccca

SEQ ID NO: 552247 - DNA, 107 bp, Homo sapiens
ctccatgaggctccctcacgatcttctgacacctcctgcttaaaacccaaaaggtcagaaggatcgtgggagcctcatgtgtaggagcctcatgtgtaggagcctca

SEQ ID NO: 552248 - DNA, 134 bp, Homo sapiens
agtgttcgtacaagagctgttttagccttgtatactgttattagacctgtgatcacatacatgcagctgtagaggagcctcacaagcaagtctatgtaccttcacccatgctgtcccctatatttagcaatccc

SEQ ID NO: 552249 - DNA, 331 bp, Homo sapiens
  misc_feature (63)..(63): n is a, c, g, or t
  misc_feature (118)..(118): n is a, c, g, or t
tgtcattcttctttcctgagctttgactgaattaagattatggcatgtaggccgggcacggtngctcatgcctgtaatgccagcactttgggaggcagaggcaggtggatcaccctgnagtcaggagttcaagaggagcccagccaacatggcgaacccccatttactaaaaatacaaaaattagctgggcaaggtggcacatgcctgtagttccagctactcggaaggctgaggcaggagaattgcttaaacccaagaggcggaggttgcagtgagccgagattgcgccactgtactccagcttgggcaacagagcatgactccgtctca

SEQ ID NO: 552250 - DNA, 682 bp, Homo sapiens
ggggaccccccaataaatcttatgggtaggggtgttccaccaaaggactaaccaagggtgggacgggcataacagggtacttctgggacaaaggccatgctccccctaaggtcgaaaaaaaaaatttaattttcagcctttaccccaccaaaaccgaggaaagaaaagcatgagataatgcggatgtaaacccttcatgagaaggtagcaagaggctccaattaagctacttcagcattcccgagtacaattgtccacggaagcatttactcccgcgaatgaagttaaatgggcaaagcttttaattaaggcgtatggtaaggtacgatgcctagctgtgctttgaccacgagctcctcgtgtccactacgacatagggatccacaatatctaaagttcagaagagaatgtatcagtgatcccgtatacctccatctgtggatggagagagttctaggctataagtatgttcagttatgaatctaatcgtttcaaaagtagattccttgtttacaggtgtagctataattctgtgttttcgcaaagaggtaaaactgccagctagctagcatgttctgtgaatctaccattgctaaaaatttcatggacacctgatccttttctctcacaatggatcgctccaatgatcacacattgtgtgaatgcatccgcaataaatgga

SEQ ID NO: 552251 - DNA, 146 bp, Homo sapiens
  misc_feature (24)..(24): n is a, c, g, or t
cggtccctagtattaaccaaatcntcttgcattttggctgatagtatccaggttctctgatgtatcttcattcagaagttcttctccaactttgagagatttcacagtagtaggttccttagggctaataatcgagatggatgggt

SEQ ID NO: 552252 - DNA, 450 bp, Homo sapiens
aaggacaaagaagtagagcccgaagaggcacaggatgaggggcagacaaggcctggcacacagacggaaaagaggatccccttctccagcttggctgggaggtagccggaagtcgaggtagtgcacggtccaccatgtgcttgagcaggatgtacatgaggccaacatggcgcgatgatgggacaagtgatgctgtcggccacgatgacagtgaagcacacacagcatccatgcatacatggctccaaaactcgtactggaaggcctggttctgcttgacattcctgcggtcagcagccgtcttggccatgatcatgcggaaggtatagaggatgagacctggcagccgcagcagctccatgccattgccgatgaaggccgaggcgatgacatagttcacaaagaaggcaccctggtcaggcaggaagacgcactccaacctgatggagg

SEQ ID NO: 552253 - DNA, 187 bp, Homo sapiens
tgcttatcggataagccacaccctgagacggatgggctgcatatagccagtggagcaaggcgtcaaactgaacgccggcatgttcgaccggaaaactccgataacctggccggcaggctcctgtattgtaagcgtccagtgacatagaaagcagacacgagactccatgagccagttaaccatcatc

SEQ ID NO: 552254 - DNA, 811 bp, Homo sapiens
gggaaagaagagggcgacgaaccgcgggaaacccttgacaacagtgtagaaaccgtggaaagagcggaagaacccaaagggaggaaaaggagaaaggggaaaggaggaaaaaagggaggaacggaaggaaaccaaagggagaaacagggggaaaaaaggggacaaaaaagaggacagagaagaaacaaggaagaagagagagacaagagaaaagagaaggagagaaaagaagaaaggaagggaagagagaaaaaaagaagggaaggaaagcacgggggaaaaacggaaaagggacaaagggagaaacgagagggaaacgaagagagagagagcaacggaacaaaaagaggcagaacaggagaaagacagaaggcgagcaaggggacgaaaacgggggacggcaaagagagagagcgcaagagggggaaaaagccggaaaaccgacgacaaagaaaacgagcgacgaggaagagagaaacggacgagaagagaaggagcaaagaagaggcgatggagggcagaggcacagcaagaaaaaggagagccacggggagagagagaaaaaggggggagcaaaaggcgagacgccggagaagaggagagaagcaaggagggagaaaccagcgaaaaggggggggaaaacgggagcagaaaagagacagagacaacaggaacggagaacaggagaacagaagaatgaaagaggcaaacaacgaacggagaggagagggcgggaaagcgaaagaaagccagagagcgcagagcgacacaaacgcgacagagaagcacgaagggcggggggggacggacc

SEQ ID NO: 552255 - DNA, 986 bp, Homo sapiens
ggacgcgtgggtcgacccaacgcgtccggccccggggcagcagcggcagcagcagcagaggcagcagcgggcggcgctgagccgccgaccgccgccactgaggaagaagccggcccagccgccgccgcgtccggaccctcgcgcctggatcccagcgccccgatcccggagccccaaaaccaccacggccggcctccgccaaactttacaaggcatgacctcgggcgggccccgggacccggcatcgagggccaaaatggtaggatggcacatagctggacgttaagacgtacacaaggacgcaagaccacgacagcatgaagctgacgagtcaggcggagcggtgaaacatcaatccaacgcaaacaatcccagcgcaaagcgcaccgcattgcgcacgggctaggcgctggggcaacgcgggaccaaggcatcccaccggcgcccagcgaaccacgcgtatcagcgtccccccatgaacacacaaccgcgaggacaccagcagcacagataaccacgaaacgccgcacgtgactgaaagcaaaaacagaccccgctctctcgaccaccagacgcagacacgcgcctccccaggaaaccacaggcagccccgctcggccacccgcactacgatggcccccaacggctggcgacaacacccgtcctgatagcccaaggtcgcatgatcataggcaccaccgggcactgccgacaaacacgtgccaagccccaccctgtcaacaacacaacggcaacggcgcggacccgacaggaaaacagaatgcgacgaggagacgcacccggcgcctcgccccacagcggctagggagagacatataccacagggagccaaagccccctggggcgccaccccacgcgacaccaagttggacacctgaaatgcgcaccgccactatcggaaagcaccttggacacacaagaggattctgcgcgcccgaaactcaggcaccccaactcacgcgaag

SEQ ID NO: 552256 - DNA, 1096 bp, Homo sapiens
caggaatgaaccttccccacccaggccccatcacaggtatatggaggagtgacctactataaccccgaccagcagcaggtgcagccaaagcgctccccaccccgggaggactccccagccagacaacatcaagccccctccagctgaggtagtaagcaggggttccagattaatacaagtgtctgacatatgcgaagagtcggaacatcagtataaaaagcagcagaggtgagaactcagaagagaaatacagctggctatctactaccagaagggctcaaagatatagggagaggctcctaccagaaaacagctgaaagaggaggaccccatgccttcctctgaggaccaggcgcatagagagagggagaaacaagaggacctcgaacacatctacactcgttcacctgagataggctgtgatacgggggagcacgagagagccagacagacccaagcttctgagtctagatacagaagcccatgtctacatgctgtgctacacatactgggacactagaagatgtcatactgatacccacaggcaagactcactacctgataggtgaggcatactacagaggatacagaaaacaaggcccgggacgacagcatcccttaaatactcataagaaaggagaaacactaacggaagcaagaagagagtggaaccacctacgtcccctgcccgtagaaaatgaagagcacggtctaggtcatccaggcaagactaaggcccccaacaggagaaacaccgagggaacaactaacggggcaatcacaaaataatggacaaaggataggacaagcctataccataaccaagagcaaaacaacgacaccgcaccataaagataaagagagggacagagggagtaccaaggagaatacggaacgcccagttgaaacatacgaccctggtgagcgcacggaacggccgtcccggacgggcccgcgggggagcaaaagaccgccaaaggaaggagacaggcacaggacagtgacacatcgcagtgacgctaagcaacagcacaaaacagcacaggagggcacgaacgcagcggacacacccacaggcgacaaggccacgcagata

SEQ ID NO: 552257 - DNA, 160 bp, Homo sapiens
gtggccagcagcagctacaacatggtcatccgggaggcaaccagaccaaccgcctccaggaggctctgaacctcttcaagagcatcttgaacaacagatggctgcgaccatctctgtgatcctgttcctcaacaaggcaagatctgctcgctgagaagtc

SEQ ID NO: 552258 - DNA, 193 bp, Homo sapiens
actagataaggcgtaagtagaatagaggttaggagggtcatggtggctaagcatggtggggcatgatgaggctattgttttttgtgaattcttcgataatggaccagtgggggcaaaaagccggttagcgggggcacccctctgacatccggcctgcttcttctcacatgacaaaaactagcccccatctcaa

SEQ ID NO: 552259 - DNA, 402 bp, Homo sapiens
gctcctgtcgactgtcagacgcatcttcttttgcgtcgccagccgagccacatcgctcagcacgaccatggggacaggtgaaggtcggagtcaacggattggtcgtatggggcgcctggtcaccagggctgctatttaactctggtaaagtggatatagttgccagtcaatgagcccgttcattgatctcaaatacatggtgtacatgttccaatatgattccacccatgggcaaattccatggcaccgtcaaggctgagaagcgggaagcttgtcatcaatggtaaaatcccatacaccatcttccaggagcgagatccctccaaaatcatagtggggcgatggctgggctgctcgagtacgtcgtggagtccactggcgtcttcagcaccatggagaagg

SEQ ID NO: 552260 - DNA, 447 bp, Homo sapiens
acacgggcacacacagtctgcccccctactagagcccaagggccaggtagaggagcaaagctaaggtcagatgccctcccggtgcccgggtggctggggatgtgctcacggggagcacagagcgtgacctggctttcttcctgagcaggtcttaagctccacacgctgtgtggtcttcccagggtactcaggttataaggttcagagcagtgtgcagcatgggtgcaatgttccctcctcctttctgggccctccccaagttcccacatcaccttccagtacatccccgacatgggagctaggcccaggctacctgagctggaagacagcagatcagccacttgcccctgagggggtcttctggggtgctggtgatgttctgccccctaagttcagggctggtgacactggtatgtgacttgtgaaagtgtatcaaaggaatattta

SEQ ID NO: 552261 - DNA, 338 bp, Homo sapiens
tcctttgtggttgctgcaaaagccattattttgttttgttttatggttaagtggtattctatggtatacatatatatatcccattttatttatccattcgttggttgatgggccctttgggtggtttccattcttttgccactgtgaattgtgctgcaataaccatacttgggcatgtgtttttttcatataatgactttttttcctttgggtagatacccagttgaatcacctggcagttttccttttatttttttgggaattttccatactttttttcatgggggttgtactattttccattttagcggggtttaggctttccccctccaccctta

SEQ ID NO: 552262 - DNA, 219 bp, Homo sapiens
agcaggtggagtttatggggcggtacaccttaacggtaacgcaggtgtcctaaggcgagcaggaggagaacctcgtggcagaagggcaaaagctcgcttgatcttgatttcagtacgaatacagaccgtgaagcggggctcagatccttctgacctttgggtttaagcaggaggtgtcagaaaagttaccacagggataactggcttgtggcggccaag

SEQ ID NO: 552263 - DNA, 757 bp, Homo sapiens
  misc_feature (110)..(110): n is a, c, g, or t
  misc_feature (180)..(180): n is a, c, g, or t
  misc_feature (184)..(184): n is a, c, g, or t
  misc_feature (212)..(212): n is a, c, g, or t
  misc_feature (314)..(314): n is a, c, g, or t
  misc_feature (378)..(378): n is a, c, g, or t
  misc_feature (416)..(416): n is a, c, g, or t
  misc_feature (443)..(443): n is a, c, g, or t
  misc_feature (449)..(449): n is a, c, g, or t
  misc_feature (459)..(459): n is a, c, g, or t
  misc_feature (476)..(477): n is a, c, g, or t
gttctgtgttagttgctaaggataatggcctccagctcagatggaatatctctatcatatagacctgtgttacagggcaggatcggatgatggacactgaagtcctcagnttgctaagttcagttgctctccctagcctcctttggcttcagagtctttgattccatctatcctggtatntttngtgtgctgatgtttagttctggattggnttcagctgtgctaataggaagggcgttgtcttttcaagcaatcttaaaaggtggtcaatcaaaaggccagagtctgaatcccttctgtggcttaaataattngaggatcaagtccagtgtcttgttaatccctgttctactgtgccagacactatcttgaatgctnttatatgttcaaggttcaaaatcgctctttcataccangggatgatagtaacgtgtaacttgcantagatnccttcatctnagtaataagatgatcannctagttaggacaaaatagagaatggattaattaacttttcccagttacagaagtaaaatgaaccgaactcttgctgggtttgtgaaaaaaaattaacacttgttaataggataattttacctccacaccaatcttttaggatattatacccttaaacacggagatatggcacacgaatctttctctgggggaattatatgtggacctgcggaaaaaattaaaaatgtttttaaaggcccagtggggggctttattttttcatttcccgattctttaagat

SEQ ID NO: 552264 - DNA, 328 bp, Homo sapiens
taaattgactcaatttaaatggaacgaagtggaatgcacttgaacggattggaatggaatggaatggaacggaacggaacggacccggaatggaacggaacggacccggaatggaacggaacggacctggaatggaacggaacggaatggaatggaatggaatggaatgaagtggactctaatggaatggaatgggatggaatagactcgaatgaaatgggatggactcgaatggaatggaacggaatggaatcgactcgagtggaatggaatggaatggaatggaatagaatggaattgactcaatttaaacgcgatgaaagtgagc

SEQ ID NO: 552265 - DNA, 302 bp, Homo sapiens
cacttctgggaggtgaaggcaggcagatcacctgacctcagcagttcgagaccagcctagcccacatggtgaaaccccgcctctaccagaaatacaaataattagccgggcgttgtcgcgggtgcctgtagtcccagcctactcgggacgctccggcaggagcctggagtgaacccctggaggcggaggtttgcagcgagtcgagatcgcaccactgcactccagcctgggcgacagatcgggactccgtctcacaaaaaaaaaaaccaaaaattccccaatcccccccgccctcagtcccc

SEQ ID NO: 552266 - DNA, 647 bp, Homo sapiens
  misc_feature (140)..(140): n is a, c, g, or t
  misc_feature (435)..(435): n is a, c, g, or t
  misc_feature (504)..(504): n is a, c, g, or t
  misc_feature (594)..(594): n is a, c, g, or t
  misc_feature (623)..(623): n is a, c, g, or t
gttcgttcgctccgcgccgcccgcctgctacgagtagaacgctgtccgcagcttgcgcatttcgcagccgctgccgcctcgccgctgctccttcgtaaggccacttccgcacaccgacaccaacatgaacggacagctcnacggcttcacgaggcgtcatcgaggagggcacattccttttcacctcagagtcggtcggggaaggccacccagataagatttgtgaccaaatcagtgatgctgtccttgatgcccaccttcagcaggatcctgatgccaaagtagcttgtgaaactgttgctaaaactggaatgatccttcttgctggggaaattacatccagagctgctgttgactaccagaaagtggttcgtgaagctgttaaacacattggatatgatgattcttccaaaggttttgactacaagacttgtnacgtgctggtagccttggagcaacagtcaccagatattgctcaaggtgttcatcttgacagaaatgaanaagacattggtgctggagaccagggcttaatgtttggctatgccactgatgatttgttggcctactggaaaaaaaaaactgaggaatgtntgcctttaaccattgtcttggcacacaanctaaatgccaaactggcaaaacta

SEQ ID NO: 552267 - DNA, 899 bp, Homo sapiens
aataagtgcaaattagattagggtatagggtggaaaaaaaaacctggccgcgacactttttattctgttctggctaatactttacttgtatcatttatgagtcctcactagtcttcagtccttaatctgatttcaaaaactatggaaatgggaggttcaaaggggtcatagcacacgtcgggctggtcacttcctggattacagactttgtactgagtgttattatacaaacatgttccttttggaattactaggcattcataataactatagaacagaaaaaatgggcttaacgtgttgtcctacctcagggacctgatatatgcactgaaagcagttctctgtgtgggaagaatcattggaaacttttaccacaccaatccatgttataaggaaaataagtcccacgactatttttctcatgctttcaccatggcttgaccagtcaagtttctgtttgtactggaaccaggctggacaaactcgtagggttattttggagagattatcgaatctcggtaggcctccaaggtcacttggattcgggtataatgtggtcgaggaaatccaacgtggaatgcctttacgccttacagcccgcattttcccagcaattgtttttttttggggactgaggataggtattgcatacaaggataattccattacaactgtggccttggataggtatatgcgttggtttctaattaccatggggcaaacttactcacaattgggaacaatgcggggtgataaaaatttagggtcagaatctatgggcacgggcctccaaattctcgcggagcggggttcgttaataccccgaaatctacgtgttggaatacccttcgaaacgtatttgtttttttgcataattgtgggccaaaaataacggagga

SEQ ID NO: 552268 - DNA, 193 bp, Homo sapiens
ctacgcgctggaaaacggcggccgcggctcgatcaccgagcaactgctgaaaacccgtgccgacgtcacgctgggaggcggtgcgaagtccttcaaccagctggcgaaaagcggcgaatggcaaggaaaatcgctgaaggaccaggcggcggcacagggttatcagtgggtgagcaacgcagatgaactgcag

SEQ ID NO: 552269 - DNA, 289 bp, Homo sapiens
  misc_feature (114)..(114): n is a, c, g, or t
cttctccctcctctgcagcatactctacatgcagatgttgtggataaagatctttatgatgatctacttccacctaatgaatagtaaatgtattttctcttccttaggattttnttaataatatgctcttttctgtaacttattttactgaaagagtacagtatataatacatataacacacaaaatatatgttaattgactagctgtgttatcagtgaggctccttctggtcaacagtaggctattagtaaagttctggggcatcaaaagttatacacaattatttta

SEQ ID NO: 552270 - DNA, 313 bp, Homo sapiens
tgggaaaaattccattaaagcccccccctctggaacttttaaatgtttaaaagggcaattttaaatccaaaaaagaatgatgtttaaaattgctttgagtgattcatccaaagaggtatatatgcatccatgtatatattcataaggaaaataagcttcccccaaaagggattttaaatttgattttttttttaactctaaaaatttaagtaaaaagtaccaaaaactctgcaaccaagggaatttttttgtccggtaattttgaatggaactgaaaaattatgcccgaataaaggccttttttcatccccta

SEQ ID NO: 552271 - DNA, 261 bp, Homo sapiens
gacccaagataagagcgtattttttttatttctgtaggatggttattggcttgtttgaataatctcacaagtttactgccatatattcctctactcagtcgagagtctaccaacacagccagttcttctatcaacacaccaactgtattctacctgttactcattctctgatttcacatcccatgctaacctgtgaaattattcaaacaagccaatcacaccctcctacagaaagtaaaaaaatcagcgcacgtggtcatt

SEQ ID NO: 552272 - DNA, 215 bp, Homo sapiens
tcctccccaggcagatcttcagccagtggctagggcagcaggagagccactctcaccagccctctggccactgtggcctctgcccagctctaacagcccaccctgctccgcagctgtgcccttgcgtcctgtcacaggggaccccggcgggaagggcagggcctgagccggtctgcactacccatggaggttggcctcgttcttcttgctgtggt

SEQ ID NO: 552273 - DNA, 921 bp, Homo sapiens
  misc_feature (592)..(592): n is a, c, g, or t
ggtcgcggagacgcgtgaaggtcggagcggagtacgtctctgcaagcttggtcgccctggggatgtgattcctcctcctcttcctccgcggcgggtaagggtgctgatggacccgcgaggttgcagcattctcatcgaggtagatactcgagaagcagcgcttccagcagctggtgcaccagatgacgtgaacttgttgggagacgtgcatggacgaagcctgggccaaagttgtgacagtcgggctgaggcctgttggtgaactgcgattgagcgcttcatgtgatacaagccagttcatctgtgaatcgactggaagcatggaccaatgaaaatccaagccagtgtttctcagaaagcctttctgactgatctcagcattacctctttggaaagaggaaggtagttcaagaaatgaagagctgttgatgggatgattgaagcaaacagctatgcacgaggattggctcccatctgttggttactcttgggaccatcctgtcatctgagaatgaacaaagaccaatttttgtgtgtgagcttcagggtcatatgttgctgtaattttataactgctaatcttgtgaccaantacttgacaggcgaacgaaaactctatgagcactgcctattactgtacattgggactatgctttctcaaagacccattaagtgctactaatatttgataggggcaccacttcgttaaagtctcccatggtgcatcccctgattaggggaacctgtgttttacaacggcaacataggcgacacacctggaaccactctcgctgcggccgcgcccactctgggagtttactcaccgcttcacaccccaagacctgcaacacaacaccgaggagaaggagacaccacacagactcaagcatacagcagaacgcgaacgtgcaaccacatgct

SEQ ID NO: 552274 - DNA, 246 bp, Homo sapiens
tttttttttttccagtagagatgaggtttcaccgtgttggccaggctggtcttgaattcctgacctcatgatccacccgcctcggcctcccaaagtgctgggattacaggcgtgagccactgcacccagcccccagatcaaacatctttcaaggcacttggagcagtgcctggtctccagggtctttaggctgtaaccacagcaaagcactcaaatcacagccactctcccttctgtcgtcttctc

SEQ ID NO: 552275 - DNA, 1061 bp, Homo sapiens
gaagcggcggccctgctcctggccgtgaccactggaaccctctggagacgcctatcaaggatggcatgctctaccagcggcctgctcaagttgtggcaacaagtgctggcgtaaggtgtgggctctgctgtatgcaggaggcccatcaggcggtggccagcgggtgtggagagctgggaggtccgggatggtggcctgggagcagcgggtgagaggtcggcagggcctggccggcgaggggaactgatgggtcatcctcgctggctgactgtgtgtccgtgcttcctgactgacgggcgagagctagcccccggagaaaccggtgcgttcctgctcacctatcacgcagagcgaagcacatctactgggctgctcagcacctgttcatggctctggatgggccccgatcgtgccaggctgggcttccccggatgacaggggagggctcctcatgatcccacgagatgacccagtctcccatacgatggggcctggtccccattgggaggaaaactccaatctagcttcctcctgttgcacggaagtgcgcgccgagttttaccgtggggggatgcacgaggagctgaggggccgcgatccgttagcctagactgaaagggcctgtcctgctggtgctggggcccgacgccatccagtctgactggactggcactggaccgcaggcctcctaaagctggccgtacattcctgagcaggttcggctcgtgcagggcgtgttctccttggaggccggacgtcgcttggcaccggtgtaaaggcactctaaggcattcgggaaccccctgtgccactgactgtgacggtgtggccggggcatcgcccgccatcggacacggcggcgaaatagacggcccacgctagcccaggagaggggccccatagcctacttggaagaccagtagattgtggaaccctggtacaggatacctccggaagatgaaactagacagagataataatccccaactcggcgaatatcatggctcctggcgcgcaggcaccacgggcacaagagcccacgtatccaacacatccttctg

SEQ ID NO: 552276 - DNA, 116 bp, Homo sapiens
tccaagagaagatgcaggcaaagtaatttcctcctgatcaaacttaattttccccatctgcaaatcggaggttacttcctggatatgtttctctccttactattgccccatgttca

SEQ ID NO: 552277 - DNA, 546 bp, Homo sapiens
agattagcacagagggaagaaagaagatagctatctgcaaaccaaggaaatgcctcagaagaaactaatcctgctgacaccttcgccttggattttcagcctcgtggaaatgtgaagaaataaatttctgctgtttaagccacccagtgtgtgatactttcttatgaaagccttagcaggccaggcacagtggcaggcgcctgtaatctcagctacttgggaggctgaggcaggatagtcgcttgaacctgggaagcaggggttgcagagaggcaagatgacgccgttgcagtccaatcagggcagcaagagtgaaactctgtcccccccaaaaaaaaaagaaagaaaattgggttgggtgcagtgactcacacctataatcccaccactttgggaggccggggtggatgcatcacctgagttcagaagtttgagaccagcctgggcaacaaggtaagaccccatctctacaaaaaataacctgggtgtgtggtagcatgtattagtggttccagccaccatgtagactgaggtgggaagatcact

SEQ ID NO: 552278 - DNA, 222 bp, Homo sapiens
attcttgactttgatggctgctgactgcttagggtggtggttgctgaaggtggggtgacagtggtaatttcagtgattttggtttggtttggtttcttaaagagacaggtctcattctgtcactcaggttggagtgcagtggtacaatcatagttcactgcagccttgacttcccgggctcaagcaatccttctgcctcagtctttccagtagctaggaata

SEQ ID NO: 552279 - DNA, 724 bp, Homo sapiens
tggtaaaatttgacaaggtgaccctaacattcatatgggaagggaagggccccagaatatatccaacaccaccttgaaaaagaagaagtgtggacctcacacttctcccaatttacaaaacttactacaaaggcaaggctcaacgagacgtggggttggatacgtggcataaggacagacattatatagactcaggtggagacaaaaagtgagagcttcagaaataaccccctccaactataatggccagtgtgatttttgtgacaagggggtcccaacgacaatttcaggggggaacaaaatgtgaacaaatgtggtgtgtgggtggacgagaagactagttcctcgacattttttatttttttattttatttttttttttttattatgtttattttttttttttttttttataaaagcacacctctcatataagatgagaggagagagaacaaataaaaacaaaatgtaacaccacacactatttctaaaaaaggcacaccatattatgcgcggacgggggttagcacaatacacaacaaacacaagaggtattgtgtaagctataattatatattaaaaaaaaaaaaaaaatataaggggcggcgcttagtaaccaacaaaaataagagtgagagaagaaaagaccctcaaaaaataagatcataaaagaccggctgaacaacgtgtgtttaaaaaaaatgtttctccacaaaataacgag

SEQ ID NO: 552280 - DNA, 319 bp, Homo sapiens
ccccccaaaaaaagggggtttttcccccctttttttaaaaaatttttaaggggcccccttaggggtttttccccccccccccggggggggggggagaaaagggaaaaccttttttttttttggggttcccccccgggggcggggaatttttagggggttcccccccccaaaagaaaaggagagatttttgggttggggcgggttgccccccccccggggcccccccccccccgggggggggtttttttaaaccccccggggggcggtttttttttttttttgggggggggttttttttttttttttttgggggccccca

SEQ ID NO: 552281 - DNA, 362 bp, Homo sapiens
tacaccgactcccaggtacaagcgaggctcctgcctcagcgtcccgagtagctaggataacaggcgtgcaccaccatgcccggctaatttttgtattttagtagagatggggtatcgccatgttggccaggctggtttcgaacgcctgacctcaggcgatctgcccgcctcggcctcccaaagtgctagggattagaggcatgagccaccgtgcccagccaaggaagtagggtttcgaaggttgaataggagtactccaggtgcttttccctgaaggtagtaagagcatagactaatgctgtcatgggagactcagcaataacacatgcacggcccctgccttcctgacgggcacacccagt

SEQ ID NO: 552282 - DNA, 132 bp, Homo sapiens
tcgtcgaacgtgttatccccatattgtaacttactactccggaaaaaaagaaccattgggataatcacgtttcgcgagagataacacgctcgcgagggataacacgttcgcgagggattacacgttcgcgag

SEQ ID NO: 552283 - DNA, 1502 bp, Homo sapiens
  misc_feature (404)..(404): n is a, c, g, or t
  misc_feature (672)..(672): n is a, c, g, or t
  misc_feature (1501)..(1502): n is a, c, g, or t
ggaaggtttaagtccaatggtcaatggcagaacatactgaggttcatgcgctcaggactgtgatggtgagcagagaagggaacgtggaaggcgctagtacaggaacccgtaatacaggaatctgtcactatggatgaggctcagtagaggacattaagcatcgggggtcattagtgagaagccatggccgacggcgagagagggaacgcgtatgacaggttgccggacggctctacaagcgatggccacatggctcggcagatgaatcaatcttcgttgcctgcgagagagatagtcgggcaggactccgttggagagggctgtgtgtatggccttgtgaggtgtggcacactccatgtggctgagagaccctcgaattcacacgatgtatgaagtacgtccantgcatgcattatcactataaggtagcaactgcccatctgttcctactgagacattgtactcgtgcatagtataactcgaattcgacagtgtcttgtgataaaagtaatgaacataaaaaatgtaatgccaaataacatagatacgataagggtgaggaagagggggcgctattggaggtgcatacataggaagatggctcgatgtgtacatcggtatgaaccttgaggatgtattgcatcaagaaaaagtggagggtagacaattagnaaggaatcaattgattaaagtacgagagattcgaaaggcgaaggattacgactttagaatagattagttcaatttgtgatgcgatgataagagggagaactagagcagtggataagtaatggaggagaagatggagcgatcccaattggtgggggggtggcgcacaaaaacaatgggatgtgtacattgcattggaataggaggttttaaagaattgcgtgtgatagtagaattggcattgtcagggggttcctaataggggggtggaaaatatcaaggggtacaaaatggagtagggaagagtgtgaaaaggaagggggcataacggggaggatagagtatacaagaggaaagaggctataatcaacgtgggtggtgactatcgagggaatatacaattgtgatgagaacacatggacttatgggtgggacacagatggcgaggagaccaactggtgtaacgcacggggaagactgcgacgacgcaatgaggcgaacagcgaaaaagaacatcgaacaggtggacacacacataagggaaaggcgagagaagagacaaagagagagaaacgattcaaccaaagaggagagacataacaacagcccgcgcagcgcgacaagcaacgcacggagagacaacagaaaccaacgagacgaaagggaagaacagaaaagaaagagaacgaggacggaggaagagagagacaagagaagaaaagaacaagaaccacaacaacagaaacacgcaagaacaacaagagacacaaagcaacaaggacagagcgaacacatagcgtatacgtgcaagactgcaatgcacacagacggnn

SEQ ID NO: 552284 - DNA, 1064 bp, Homo sapiens
tggccaaccgctgttctcagcccctacgctggattccagccattgcatgcagctgcatccacagcccttttcaggacccaaacaaccgcagccgctgttcccaggatggtgatccgtgtctttcttgcatcttccatctggctctacagcgattaagacgaaacaacaagatgctgcttggtttcctcacaagcccaacaccaatcaggcatttgcagcacacccagatatcgcagcccaatgaagcagaatcggcaagtggcatgcagcagacaacatgtcacctgcaaaatagtcgaccagccaccaggttacccccatgccacctcacgacttttcaagtgaaagccagtatcgacggggactatgatgccttctttgaagccagagaaaataatgcagtgtatgccttctataggcttgcacagcccacctggttcaaaggaaagccagaagtgcaagcccacgcacgcaagcattgaaccttaacgcactgtgctacacagcatcctgaacaatgagtctcacaatagcataataccatacaacactagccagacttagcatatgcattcaaacgaaactagggcattaacatgccgaaatacatagattcgcacgagcttacaaccatgcaacacatcacaatcgactacccaactcaccacgaacaatcatggcggactactggctgaggaccgaatgggatatttctacctaacactcccactacctcagccacgacccctcacacaactactggatgttcacgcccaacccacacgatctccacacaccacccctacacatcacacacttgcccctagcgcatagaatggacactatgctatagagcgccaataccacacgcaacgaacaccaccgcaccacctacagttgacaatacaacaaaacaaaaatgccctataccacatatttaaaataatcacaacaacacaaaataaccaaataccagaccacccaaacccaccacacataaccaaaaacaaaccgacaaacaacacatacccccacaccacaatctctatccactctcacctcaa

SEQ ID NO: 552285 - DNA, 227 bp, Homo sapiens
aaaatgaatgagatacaatttggtatccatatgggaaaagtttacttggccccaacctcacacatgagagataaaatcaattctgggtagattgtagatctaaacatgaaaggtaaaataataaagctgtaagaagataatgtggaaatgtttacttaggaaaagatttcttaaacatgacacaacccccattaaccacaggaggaaaagagtaaaaaatttgcctc

SEQ ID NO: 552286 - DNA, 747 bp, Homo sapiens
agcggaattgcttgaaccaggaggtggaggttgcagtgagccaagattgtgccactgtacaccagcctgggtgacagagcaagactcttatctcaaaaaaaaaaaaaaaaatgctccagggctttaaatgaaaagtaaaattttctaagttaataaagatgaaaaaggggtgactattatgatgaacaataactaaatgtcttattaaagcaactgagtgtctagccctaaattacccaggtaaaaacggttaacactaacctgaagtttggtgaataactgttctttaccttattgagatgttgcagaaatgccatccaggtggactgggagctatgaatgactaaattcctccttgcagtgtttcccttcaagatgtgtataggtatctctcctcttcttcccccagtccccattacttattggcccactggttttacctgactcctgttggatatttatcaccaagaccttaaactcttcatatgaatttctggatgtatactccgactgtcttgatttatgtccctaaattttttagatagggtatgtgggctgtggcagaattcttttgggcttaattttacttcctttcccagcttgcttgagtcttccttaaccgtggttttctcttaacacccaatgatgaaccctgagaaaaatgcctgattgggccttggcctagaaccaggagctgagtatttaccgatgtattatcctcgggtcatcctgaaattatgtatccct

SEQ ID NO: 552287 - DNA, 203 bp, Homo sapiens
  misc_feature (19)..(19): n is a, c, g, or t
  misc_feature (57)..(57): n is a, c, g, or t
  misc_feature (76)..(76): n is a, c, g, or t
accgcgcccagcctatttngttcattttttgtttagttgatttctgctcttattttntcccttttttgaattcagnttgtccctctttctagttttatgtggaagcttaggttattatttgtaatctttcttcttttctactactaatattaaacactataagtttccctctatgcactgcattagctgtatactacaaatgt

SEQ ID NO: 552288 - DNA, 404 bp, Homo sapiens
  misc_feature (76)..(76): n is a, c, g, or t
ggggtttccccccattttgggggaaaccggttttcccccctttaggggagttaaaccccctccccccccccaaagncccggggcaaggggttttttttccaggaaaggggaaaggggcccataaacaaaacccccctcccccgggggtggggggtttttttaattaaatgggccccccgggtttccccctttgaaaaggggccgggggggcccccccattttttttggtttggtcccccctttgggccccccggggtttcccctttttttttcgggttgtttttttttggggattttgggggggaaaccatttttccccggggaccgcttttaccagattttggatttttttacccccccctttggggattttggcccccgggcccaaaatttgggcccgggga

SEQ ID NO: 552289 - DNA, 103 bp, Homo sapiens
cccccaccttagcctgtggggacaggcgtaggaatggaaggtggagtaagtgtgaatacaggtcaatgggcagagatcctggcctctgggggcagggcgaggt

SEQ ID NO: 552290 - DNA, 457 bp, Homo sapiens
cggagtagctcataaataggatgaagagattatccttcatgtttccaaggtctaatactatttgaatcgagcttgatgttatagatgcatagcgaagaaatctacaagtgaaatgatatgataactaagcactcgctcgaaaatcacatgcggaacatcactggtagagtactcaggggtaaatacttcaagatgggcacaatgttcatgttaaatgcatggttggccgactgtgggttcatttaattcaggttctctgtttgggggtatgttgaaaatttgtcataagaaaatattattcagaggtctcaagaggcaggctgccaagaatagcagttataaatagctagtatcaggcctggtgtagtggctcatgcctgtaatcccagtggcttgacaggctgagggaggagaacggcttgagcccaggagatcgagaccagccaggataacataa

SEQ ID NO: 552291 - DNA, 333 bp, Homo sapiens
ctctggcttctgtttgggtttgaagatcagaaggtagcaggataaaaaggtcagggtatatgtatacctctagtttccccattgccaagatctccttcagaagtacttatatttctctacttaagaccacagccaggggcagaactagttttttgaggtgaggtggacatttacacaaattttggaccctccttcaaataataaaaaattggctgggtgcagtggctcactcctgtaatctgagcattttgggaggctgcagtgggtggattgcttaagctcaggagttcaagaccagcctggacaacatagttaaacctcgtttctacaaaa

SEQ ID NO: 552292 - DNA, 152 bp, Homo sapiens
tatgccgtctcttcgtgatgcctgtgactccgatgggaatactcttgcgagtccaaactctgaaactgggcctggacaaccgaactctggagacgaggacattgattctttgcagaggatggtccaagagctacgaaaggacatagaaacac

SEQ ID NO: 552293 - DNA, 252 bp, Homo sapiens
cccgggaagcgcacggaggcggagaccccgcacagggcggccgacgccaggtggaggaggaccccgcgggcggggggcggcaagctgagggagcggaaacgagaagcggataaagaccgcgggccgatgcaggaggccgaacacggatgctacaccagctggagcacagacagcgaggcgtggcagggcgccaccagcgggcgcgacactgggggcgagagcgccacacggagagcggacatgatgcgggca

SEQ ID NO: 552294 - DNA, 232 bp, Homo sapiens
cgctagcggcttagtgaacgcgtcatctctagaaggagaatccacatcacacccactggaacgggagagagagttaaagtgctgactcagagagaagcaccgggagcctctgtgcgtccctggtggccgtgacccaccttgtgccaggaacacccctacggcatctcttttcattgcgtggaggaatatgctgaacagcgttgtggatacgttcacttaatgccgctagcgc

SEQ ID NO: 552295 - DNA, 507 bp, Homo sapiens
  misc_feature (472)..(472): n is a, c, g, or t
tcagagccgggcaaggtctgccttatattcttttttttttttgagacggagtctccctctgtcgcccaggctggagtgcagtgacgcgatctcagctcaccacaacctctgcctcccaggttcaaacaattctcctgcctcagcttcctgagtagctgggattacaggcattgcgccaccacgcccagctaatttggtatttttagtagagatggggtttctccatgttggtcaggatggtcttgatctcctgacctgtgtgatccaacctgtgccttcggccttccacaagaggtgccgtgggatttacagggcgttgtagccactgtgcaccgtgggcgtttggctttggttgtggttgtggttgtggagacagagttttcgcctcttgttgcccaggctggcgtgcaggggtgcaatctgtggctcactgcagcgtgggtttcaaggcgaattcttccgtggcctcagncctttccaaattagcctgggattaacccaggttgc

SEQ ID NO: 552296 - DNA, 150 bp, Homo sapiens
ctagttttagaagtttcaatagcacctagacagacaaaccccaggcagcaatgacatttgcaaagctttgatcttgctgagaaataagaatctcatcaatccatctagcctgctaaaaacttctaaaactaggtgctattgaacttctaa

SEQ ID NO: 552297 - DNA, 189 bp, Homo sapiens
ggggggggggggggccccccctttttttccccccccccggggtccttttccgggggtttttttttttggcccccccccccccccccccggggggggggggcccccgggggttttccccccttttttttttttggggggggggggggggggggttttttttttttttttttttttttttgggggggcgga

SEQ ID NO: 552298 - DNA, 381 bp, Homo sapiens
  misc_feature (42)..(42): n is a, c, g, or t
  misc_feature (45)..(45): n is a, c, g, or t
attatggccggggaggtgagggaggaagggatcgcctactcnaangaagtgctggagtcgtgtgttttgggtgctcgttatcctgcgtgggtcggcaggtgattctgtgaaaagccttaagattagactgtaagaaaagtagaagtcatgtttcgaagaccttcatcacagtacttattcagcttgttagacatgaatccgcaactatcagtttgactcttgtaagaaccctgaatctgtgtgcacttacttgggcgagtgggtcatgaccttggctttgtgacatgtcgaaggatatattgaatgttaccaattggttgttgttattctacagataacattgtctatattccttatttccgtcatgtcttacttcctgcg

SEQ ID NO: 552299 - DNA, 292 bp, Homo sapiens
  misc_feature (58)..(58): n is a, c, g, or t
  misc_feature (104)..(104): n is a, c, g, or t
  misc_feature (125)..(125): n is a, c, g, or t
  misc_feature (127)..(128): n is a, c, g, or t
  misc_feature (140)..(140): n is a, c, g, or t
  misc_feature (148)..(148): n is a, c, g, or t
  misc_feature (156)..(156): n is a, c, g, or t
  misc_feature (250)..(250): n is a, c, g, or t
  misc_feature (252)..(252): n is a, c, g, or t
aggactgagcagattgagtgatgctggggcaaaaaggcctgggaggaaaggtgttcanccagtcgtttgtaaggcgcttgtgggcccctgttgaaacgcccccncctgacagccccatcctcaangnntgttttaattantcagggcnggttttanagacttaaggggaaaagctgctttcaaggcccccacatgtttgggctccccaaccagctctatttgccttgggttcattttgttattttgtgangngagactgcaaagaccaataaaaacatattttataagacca

SEQ ID NO: 552300 - DNA, 276 bp, Homo sapiens
  misc_feature (76)..(76): n is a, c, g, or t
  misc_feature (113)..(113): n is a, c, g, or t
  misc_feature (148)..(148): n is a, c, g, or t
  misc_feature (165)..(165): n is a, c, g, or t
  misc_feature (171)..(171): n is a, c, g, or t
  misc_feature (173)..(173): n is a, c, g, or t
  misc_feature (177)..(177): n is a, c, g, or t
  misc_feature (220)..(220): n is a, c, g, or t
  misc_feature (230)..(230): n is a, c, g, or t
  misc_feature (250)..(250): n is a, c, g, or t
aggcccggaaccgttggcccgggccggccttgccctattcctttcctcctcctcctcctgggtcccccagggtggntgggcttgggctatttgggtggtggtggcggggggtnttgggggcctttcagctcccgcccatgcctccctnatgggtgggcccagggnggcctntntttnaggagacctcacccactcctcgctcagtttgacccctgtaagngcctgccctntgtattttattaataaactnaaataaagggaagacgctgctggtga

SEQ ID NO: 552301 - DNA, 854 bp, Homo sapiens
  misc_feature (538)..(538): n is a, c, g, or t
tggaaacagtctgtgctgtatggcccaggctggagtgtggtggcacaatcacagctcatggcttcctcaatcacccaggcctaagcaatcctcccaccttgtagctgggactacagctcacagcacaccgggctaaaatttttttttggtggagacggattctctatgtggcccaggcgggtctcaggctccggggctcagatggtcctcctgcctcagtttccaagggcacgggccaggtggtagcttggtccctgtgccatcttgcccaacaagaggttctatccctttaatgaatggacttccataaatgggttatgtgggggggcaagtcctttaagcgggaattggtaaatccctcctgaaatggtttttccatgcagttaccatgaactattactacaataagggatgggtctggggttgtcaacaaacaaacaaaaacacaaaaaaaaaaaaaacaaaaaaaaaaagggggggggggggaaaaaatacccccgggggggaccaattttcgccccccttttttttgggaaanggggggcccaaagagaggaggtaataaaaacgagggagaggcgaggataaacccgcgtgcgtggtggcaaagcgcgcccggcggctctgtgggaaggaccgcttgcgtgcgggtgctctgcgcaccccccacggaaattagagcccgggaaaacaactcggtgttcgttgtaaccggctttgttgcgtcgactgttctctttttttatactctccaccatctaatacaagaggaaacacaaacaaacagaacagtgactcactcaaacagcaacaggcgacaatctcgcgcacagacacccgtcttaacgctaccc

SEQ ID NO: 552302 - DNA, 419 bp, Homo sapiens
gaaataagcactttattttttggagatgcagtctccctctgtcgcccaggtgaagtgcagtggtgcgatctcagctcactgcaacctccgtctcatggattcaagggattctcctgcctcagcctcctgagtagctgggatcacaggcgcacgcaaccacacccagctaattttggtattttaagtagagatggagtttcaccacgttggtcaggctggtcttgaactcttgacctcgtgatccacctgcttcagcctcccaaagtgctgggatcacaggtgtgagccaccgaactcggccataagaatatatctaaaggtatctttttttttaccttttgggaacagagtctcgattgtcgcccaggttgaagtgcagcagcgcgatctggggccagtgagggctccgcctccggggg

SEQ ID NO: 552303 - DNA, 113 bp, Homo sapiens
actctagaggtccccacggttggctactagtctacgctgatggaattgggccaaccgtggagccaaccgtggactcgtagccaaccgtggactagtagccaaccgtggcttag

SEQ ID NO: 552304 - DNA, 105 bp, Homo sapiens
aatcttcacagcagcacaagcctgcgtgcaggctgcagtgcacttgcagccccagcaggcatccattgcagccccagggtacctgcagcgtctgcaattctgtca

SEQ ID NO: 552305 - DNA, 84 bp, Homo sapiens
catcagcggcttttaaaatacagatctcttggtagccatccggtgagattggtaaccaatctacttaactggcatcagcacttt

SEQ ID NO: 552306 - DNA, 939 bp, Homo sapiens
  misc_feature (297)..(297): n is a, c, g, or t
aagcaccgagatcacagtaagtgatgtctatctgcgcataggttgttatagccggcatatgctctgttcaggcagacacgctcctccctccgtacacgcgataatagttttgccgcgcccaaaattttggtggccccaatacatagtatactcgccactcaaactcggggcctcgctttcataagttggagtcattcttattagacagtggacggacattcaaaggggttgggttcggaccctgttcgtgcagcagatcggattgtggcggcccgtgcaggcggtcccacacataantggtcaggatgaactgggatgtaaaaattcctctgtggtgtcggctcccgtttccggagttgtcccccctcggcccccgtggactacggtctgtagcgagcctaggagattcggtatagttgtgtttcccagtagggctgtccccccagtttgcatataatggcccttcacgggaggccataccctatgactcgcccgtggtccgcccacccgttgcacgcccgcgccgcctcatgccgacgcgcttcaggtgtcctgcagttgcgccaaccgaacaggttgagattacggccctccctctgataatgtaggggggcccgctcccagtatgtgcggcgcccttgtccgtccaagttatcggctgcgtcgagtcattcccctccgctcccgagctattatgtgtgcgccccgcatgacccgccccgccctgttgtgttcatggttgagtccgcgcactgcctaacggtattaaccctcgtagctggggggcgcagcgcactcagagcaggccgccctggggaacgctgcagctctggacgacagcgatcactcgccggagatattgttcttgggcccggtgtgaaaacgttttcccccttacgccaaaattcccaagggggggcaaaaaaaaaccaacaaaca

SEQ ID NO: 552307 - DNA, 206 bp, Homo sapiens
ttagcagattcatgtcatgccttctccccgttcgctgccaaaaaaggtgtcagagggatttctgccaccgaaggactcagcaaacatggcatgagtggtctccatggaatgtgtagctgaaagaggtaccattgtgtaccacctgccgctatcgccactggggccactcccctttaggccttcctccccgtagcggtcgacggacg

SEQ ID NO: 552308 - DNA, 218 bp, Homo sapiens
ttttttttggggggggcccccccaagaatttttttctttaaaagggggtgggggggggttttgggcccttttcccccccctttggggggcttttttgggggtgggggggcccctccgggcccccgtttttttggttttttttggggccaaaattgggtttcttttgggggccccccccccccccccttgggggccccttaaggggggggggcccttta

SEQ ID NO: 552309 - DNA, 350 bp, Homo sapiens
  misc_feature (24)..(26): n is a, c, g, or t
  misc_feature (223)..(224): n is a, c, g, or t
  misc_feature (287)..(287): n is a, c, g, or t
  misc_feature (299)..(299): n is a, c, g, or t
  misc_feature (315)..(315): n is a, c, g, or t
tccaatttatatgtagtagatgcnnnaagtggaaaatagtgttatgatgacttattaagcaatgaagtcagcacagtttctatttggacagaaattctgactttatatttcttttctctctctaggtctgatagctgttgtgatttttatcttgctttgcatcactgccatagctgttcgcatttatcagcagaaaagggttatataaaaagaagtgaggcannaaggtcagaggaatggtagacagtgctgaggctgttcctggaaaaggtggagccttaatattncaaaatgccagncaatggaaaatccagnaaaggagtaccttccttcctgaattgggcagccta

SEQ ID NO: 552310 - DNA, 218 bp, Homo sapiens
tcagcgcgtaacatgatgattctgtctttgtagggcctggatgaattggaaatcatcattctcagtaaactatcacaagaacaaataaccaaacaccacatattctcactcataggtgggaactgaacaatgagaacacatggacacaggaaggggaacatcacactctggtgaacccgacgtgtctataggatttaacaaagggaggggtaccgagc

SEQ ID NO: 552311 - DNA, 977 bp, Homo sapiens
gcgggattttcccctctaattgctttccgttcgccttttccccctctctcgggacccaccccttgggaagggtatccccaccccggggagtttacatttgccacggggggcacctttttcagagcccctgggaccattggggcccttgaattgtgaggattgggaaaaccgagggcaggccccagaaaggtttcttcttcagcacaaggctggcctcccccttggcactgccccctgtaaggcttgggcctgcccccacgttcccccccacgggggcttccttctggagattgttggggaaggattcacggctgcacgaaagggccacaaccccccttggcacaccacgggcagctttttctgcctttccgcaacaacggcgtcttctctggatcaccacgctgcaacattccgagccccgtgtccccacccgcggaacccacacacaatggcccgaggcccctcctttgcacatgggcacacccacgcctgtgaactataggagattgtggaaagggcctcggagcacctcaccacgaggccccctctgtcaatcacactccttggcaccccaccccaacttcctgcacacacacacactggcacagagaaggggcgcctgggagaatcacccccacacacagggtggaaggtttcctgttggctacacctctaaaagctgctttgccttcaatgttcacaacacgagttcacggcacccacccccctccacccgcccggccaaggttatgggcactaagaagttgtctccttccccaccaccggagcccacgagaccacgcccttccctggctcaaagcctttccgcacccctcctgagctgtcctggaatgtgcaaactggtttgcacctgcaacacaccccccggccacatgtaaactttcctgtccacacacataatgataaaacccttttgcatagtattactgaactcagttacgagctatttcccggga

SEQ ID NO: 552312 - DNA, 909 bp, Homo sapiens
  misc_feature (617)..(617): n is a, c, g, or t
  misc_feature (645)..(645): n is a, c, g, or t
  misc_feature (673)..(673): n is a, c, g, or t
  misc_feature (710)..(710): n is a, c, g, or t
  misc_feature (724)..(724): n is a, c, g, or t
  misc_feature (726)..(726): n is a, c, g, or t
attctgtggtgaggagaaggcaaaataatatcgccagtgcgtcaggctgctgagtcgtttaccggtcgtctggatatgacgaaaatcctcactgacgggctcaaaaagattcagatattcatcattatgtccactgatacctgggatccagtctgcaagtgtcagaaacgagtctgcatttgatgccctgaacgtcttcatacatctgataagcccctcccggaagtctgctttctctccgtcagaaagcataccctgaccggtttcaatcacggaccgttctgtcaggtaatgctctgtccagtcatacagagccgggttgtcacccgtataagctgaagcaggcacaaatcagggaaataaacaaaatcccgcatccccggataaagaaaaatcagggaattaatggcctgatggatttcccgtggcgtcgaaagtgcggcaccataggtatcagtcaccgcgatgagatcccttaccattccagagtctggcggttgattattaatttgctgatatagagcctcagccgctggcgaaattcattacgtaaatcaaaggcttcaggtcggggtaatttaaaactaagctgaatgattttctggagataacggtgncatcttcgatattcagcgcatgttcaanggcatgagtgataatctggctgtcatancagagaatatgggtaaagcgggcagatcgggtactgncgcacaagcctgananttcgcactggatggccagtcggtccgatcatccctgcaccatgatctactcagatcacaagtggctgaattacccgagtgcgggttctgtaccgccacgtgtgaaactttcgcggacagatagggaccgcattggccggaaggccaaatcggcacagctggtcactaatagcatacggggtca

SEQ ID NO: 552313 - DNA, 120 bp, Homo sapiens
atcatacctacctccttcatctatactacctccttcatcatacctacctccaatggtcatgctttttgcttggaaagcctttccctgtttttcgcctagtcaaaaggtgactttacttct

SEQ ID NO: 552314 - DNA, 440 bp, Homo sapiens
cgagcggttgggtgttacagcttttaaggcggcgcgtctggagttgttccttccccccagtgggctcctgggctcgctggactcaggaatgaagctgcagatcttcacggtgagtgttacagctcataaaagcagcatggacccaaagagtgagcagtagcaagagttattgcaaagagcaaaagaacaaagcttccacagtgtggaaggggacgcgagcaggttgccaatgctggctcgggcagcctgcttttattctcttatctggccccacccacatcctgctgattggtagagcccagtggcctgttttgtcagggtgctgattggtgcgtttacaatccctgagctagatacaaaggttctccacgtccccatcagattagttagatacagagtttggacacacaggttctccaaggccccacccgatcggggta

SEQ ID NO: 552315 - DNA, 1141 bp, Homo sapiens
  misc_feature (1141)..(1141): n is a, c, g, or t
gagctgagatggtaccagcgcactccagccgtgggggacacagcagaaactcagtctcaccaaaaaaaaaaaaaaacaaaaaaaaaaaacaatttgtgtcgcgcgcccgcccgggcgccccacggaagaaagtttcataaacacacaatccggttgggcggcgcgcgcgggcgccccacgagggtgaaatggaacccatggggcccataacgtgggtctctcctagagagaggaacctccggggccaagagagaccatagcgtcgctggcggattctcctcacccgaatataaaaaaccagcgcccgggggggggcacccgcaggcacgcgagtttctgagaacaaacaatcccagaagatgggcgagcgctcacaaggagggggcaacataccaacgagggagactctcattcaaccaaccaaccagggagagcgctcccagcaggcgggaggccgccctagcgaaatttaatctcaaaaaattataagcgacgcccccgcgcccaccggttggagtagaacgaacatacgcaacgacggaaagcacagagacggacacaaccaaagacccaagagacagcgacagaccagaccgagacacgacaagaacacaagagccagaaccgcagacagaacgaacggcgtagacagaagccaacgacagaccaccggagcgcaagacaacaggaacctacacaagactagccaaactcagaccgaacaagtagacaaagcaagcagaacacgagagagaggagaaggagaagcgcgcgacccgcagcaggcgacgcagcacaggcggagagacgagagacaacggagcggacgaagacaggggggcaggcagcacagagacggcagtgcaggaggccaccgacagcagagacaagggagccggaggacaggagcagaggaagagcacgcaggcagaggcacgaagcaacgcgagaccacagaagaggaagagagaacgcggcgcacgacacaagcagacaagagaaggagagacggccaaacagcacacagccgacgcgcgagcacgacaagccccgagagaacgagagaggaaggcgagagacgacagagaaagagacgcgaagggagcgacaggagagagcacggagcaaagaagaagcgagn

SEQ ID NO: 552316 - DNA, 280 bp, Homo sapiens
agagttcattacaaatacagcttcccaggccccacctccagcacttctgcctggccctgggcgtccctaggacgaaactgtaaattccccagtcactccacggcaggcaggctgggccacccttagtgggcactgcttgggcttgtctgttatctcccagaggcatttcagaaatcagggcatttcggtttcaggatggctcttctataaggtttccatataaagtaatggttttatttcaagttggtcttcaaatattttcatttgggtgtgtacttca

SEQ ID NO: 552317 - DNA, 386 bp, Homo sapiens
acaacgttcatctgataacatattaggcaaggccatagggctgcttccatacctctagaaaactgcctcgtaggtcagggctgagtggtagtacaggcaggtggagtaatctgtcaagatgctgctttaagttgttttgagatgtggttcaagggtgtttgttgatcacacaccaagagctagctattaccaagaataataactagcatttgtcaatctccagattgacagtttgcaaagcactttcaagtattatttgatccttggaacaaccacgtatctcctgcaaaaatatgggaatgataatacctgctcattagggatcttgggaggattaaatgagataatataggtccaagtgtctagcctagcatttagtgggtggg

SEQ ID NO: 552318 - DNA, 510 bp, Homo sapiens
ctgatgctggcaccaggtttgctgccccaccctacctagattatgcaggctaccaccagtacatagaggagatgcttcctccagaaagcccggcactgtatggcctccacccaaatgctgaaatagaattcctgacagtgacatccaacactctcttcagaactttgctggagatgcagcccaggaatgcactcagtggtgatgaactggggcagtctacagaagaaaaggtagagggtctttccttccttttctttttcattgaagtataacttacttgtactggagtctactaatcctaattgtgcaaatcaataagtttttacctaggttttactcatacaaccaccacctagatcaaaataacatttccaacactccagaaggatactcatgccccttatcagtcaacatacccctcacctcccccagagataatcagtatctttacctctatcatcacagattagctttacctgattccaaatatatggaatcatacagtgcgca

SEQ ID NO: 552319 - DNA, 352 bp, Homo sapiens
gccaagccaagatttcgatagatttttgtgtgttgttgtgaaacatgctaatgattgaattatcttttccaaagatttttttttaaactgtgactgctcgcgctaacattgacaataacactaattttttaaaacttggatggcgagatgacgaacgcattccaccaaactcatgttttccacacggagggttcacgtgtgcgacgacgcacaaaacaccacacaggcctttgaaactctttgctttgcgattcgaactcttttttgctttgaaagcttgccctttgtttgtgcccccaccggcgcacacgggcaaagttctcagcgttgtgcccctgctgttcccatcctg

SEQ ID NO: 552320 - DNA, 408 bp, Homo sapiens
actgcattgcagcctgggcgacagaacaagactctgtctcaaaaaaaaacaaaaaaaaaaaccataatgttgccatggctattttagtggggggttttttgtttgttttgttttttttagtatttttgttgggctcagtggctcacacctgtaatcccaacactttgggaggccaaggtgggcagaacacttgagctcaggagttcgagaccagcctggggaacatggcaaaacccccatctctacaaaatacaaaaattagccaggtgcggtggtgtgtgcctatagtcccagctacttcagaggctaaaatggaaggatcacttgagcccaggaggctgaggctgcaacgagccatgagcatgccactgcactccagcctgggtgacagagcaagatcctatctca

SEQ ID NO: 552321 - DNA, 205 bp, Homo sapiens
  misc_feature (32)..(32): n is a, c, g, or t
accggaagtatctggggcatgtagtacagatnaactatatggcgaaaatagcctcaggctagcagttgatattctcagcactggtttccagaccttttcacctgggaaatatgcatgaactccactagatacccaacactagcccactgtgatattctgcaccctcctcccattctccctgattaactcagcccacagatccttg

SEQ ID NO: 552322 - DNA, 818 bp, Homo sapiens
cgggcgcatccgcctaatccgggagacctgggagacttgaggctcagtggaagaggacgatcgttatacgtgttgtgttcgggctatgctctgtgtatgtaagtttgtcttcgtgagcattcaagactacttcttggctctgtctcggaattccaccacgtcctgtccgccagggctattaagagattgggcgcgcaggacagggactttcctctgccggctgcgtggagaaggaagcggctaaaaggtattgccccggcagagttccgccattcgttgatccggggagggagggactagtacacagtacccactcaccaggaatagtctagacacgcgcttacagggccaggagtggacgtttcgcagcacaggatttcctaacgagcgagagggatttagccaagagcacagacttgggattccttctgtccgctccccaccgtttctgctcccaatgaagaaagcgttaatatcctgtgattactgctaggaaaggggcgtattaacggtcctgtgcttccccgacaggggaggataagctagacgaacttcacagaagagttcaagtattggagaactaatggagtttagtagagaataagatactatttttgagagctatagagtaagaaggaaaacacagtgcttttaaaaagtgtttaatgagagttaacagacagaaggctcgaagtggaaagaccttaatggtttatgtgagataatggtgactcgcagtctgttgttgtataaaggttgggggagctgataaggtttttgtacagtattttctcgttactgcatgggtctgtaatgaa

SEQ ID NO: 552323 - DNA, 948 bp, Homo sapiens
gggctcgggatgcggggctgagaccctcgcgattccggggcggattcgggacgcatggagaccggccataacttggtgccgtggtggggcttctccagatgccggggctgggtccttcccaaggattgagacaaacaggatggctagcggagaaatgaaatgatcgttaaaggaagtcgtccgaatctcggaacctggagaagaaggatgtggaaactagcaggttctgtacagtgtgaagaggaagcgtagacttgaggatgcattcattgtgatatccagatagttgatggaccgaggaaccaaatagggacggagacaatgggtatgcaggaaaaccgaacgacgaaaactagtcagagatatgagcacaaagtgtggtcggcgcgaagagagtgaaaaagttgtagcaggatagacaagaagaaaggaacaagtgctgcatctaggattcctctaacaatagcagtagagcccgggtagagctcagtgggatggtcgaacaggcaaggcacggagggatagaacgcatggagcctcatcgaaggggaagcgccattgggtgaaaggccgtggatataggtcgccgggacccttcgccgttgaatggcctagccccgcgatacacaaaggaatcggtcggacagcggtactggtccaacgtgggtaacgcggatactatagcgtcaagtaggcccaatacgaaaggaacgacaaaaagccagcaagaaccttctgagggactcaacttgacagaggggcgagttcttgggcaagggtggggtaacgcgttacagaaatccagatgggtatatgacaaagggggtgcgaccaaatagttcagagagtcgagggggcgaaacacgaagggcatggagggaaaaggaagaagggaagcactttgtgggaacacatggcggtagggtgaggcacgtgaaaggaaggagg

SEQ ID NO: 552324 - DNA, 546 bp, Homo sapiens
cttttccgtgccaaatcctccgccgcgctcttccagaagtgcgaaacccccaagcgctcttaccattatttatccccgggagagaccccgtaccacgcccatgccccaccaatgtattgggcccctcctgcccacccaacaactgtgatgaaatctcagaacccgtctcccctgaggtctttccccaaaggcgcacaaaaatgttttttgttctcgatcaccccgccctttggtgaccaaggtccaaaggcaccagattgagagagaaatcctgatttgggagaaccctcttatatcccgatgcctacccctacacctccctagcttaccttctacaaaaagtaggtttaagacccggcaaagcaccaaccaggtttttagtcttcaccaccacctaaaattccttagcacgccctaggaaaggacccccttattacatttattatttcttaattttacatttgagaagaacatcttctgtcacacccgcgccgcgcaggtcactgaacccaaccccccttggagcccagcgagactccgtctccg

SEQ ID NO: 552325 - DNA, 148 bp, Homo sapiens
  misc_feature (129)..(129): n is a, c, g, or t
  misc_feature (136)..(136): n is a, c, g, or t
gcctttctagcccagcggcgtgccacagagaaggctacacgagcaggatgccatgccccaatacaggccacctatgcgcaggcctcggctgggtcttggcggggcagctatcttggtagcgccaacganctggtgnacccctattgta

SEQ ID NO: 552326 - DNA, 511 bp, Homo sapiens
ccaaagggatgtttggtaacccagcctggagggcaggggctcgatctcggttcattgaaagctcagcctccagggttaaggccattttcgggctcaacctccccagtggctgaccttaaagcctccccccacaagactgggtggaaggaatcctggccctttggaaggtaagggggggagggggtttcccccgttttggccaaataggtttgaattacctgcccagggtggcgagcgaccaagtccttcgaagggcttgggttactggttttggacacaaagaacaccccctttcaaagtagtttgtctccagagtgctaaaaaatttatgttagacacatttattttgcgaagcaaaataaaattcaattggaatgggagcttgttttccacatatccaaccgtgcgagggcatagaggcggattcagggggacacatccccttagatatcactacatccccaatttcccactcgggaggctcacgggcagatgatattgagcactctcc

SEQ ID NO: 552327 - DNA, 852 bp, Homo sapiens
cgtacaacattcgaagaggaattgagaactacatatgatgatcatggatcttcaatataacatcatggactttgttcagaatatagttcaagtgctgtggcggggaggactaccgagattggagcaagaatcagtaccacgattgcagtgcccctggacccctggctgtggggtgccctatcacctgctgacttcctaggcatacatgactagcaagttcgtacaatcaccatcgtggtggttgacaaaactatctcacaaaggtagcgtgtcacggtagttgcagcgatggtcatctaacgtagctgagggctagcagcaacgccgatgatcatcttgtgttcatggacaactaacaccatcatggaagtgggcatcctcctgcagcatcctgcttccccagttgcctgtgggtgctgctagattgcttgcatgtacatcacccgggtgtaggacatcatcatggagcactctgtcacttgatgggctcctggggccaggtgtcaagcccatcgtgtaggcggcaggcacgggatgctgcttgtgctaccccaattagggcccagcctgccatggcagctccaacaaggaccgtctgggatagcacctctcagtcaacatcgtggggctggacagggctgcgggccctctgcccacactcagtactgagccaaagccagggctgtgtgtgcctgtgtgtaggtccacggctctgctccccagggagcagagcctgggctcccctaagagggtttcccccgaggcagtctggatctgtgcccacctggggccggggacaaggcctccttctccagggctgggctcggggggggaaccgaaggctgttcagcc

SEQ ID NO: 552328 - DNA, 277 bp, Homo sapiens
tactgaggcaggagaatcgcttgaacccgggaggcagaggtttcagtgagcggagattgcccactgcactccagcctgggcaacagagtgagactctgtttcacaaaaaaaaaaaaaaaaaggaaattggtttctaaacactttactttaaaacaacagatttttgccattatgggatttaatccgtggctaatttttgtttttttggtacagacggggtttcaccattgtttggtcaggcgtgttcttggaccccttaacctcgagttggtccgcc

SEQ ID NO: 552329 - DNA, 612 bp, Homo sapiens
gtgatagagttgcagtgatgttggccatttgctggacaaccaagcacccgggtagctcctttgattagagaccagatcagataacttatgcttggtaaactgattacgttgacattcttctcttttctatgaagggcagggcaagaacagaagtgtgcacaatggctctcatgtacttttaaattatacaatgatatccaagtattaaaagattataggaacctgaggtttacatacgttgtgtggtgacattttagaatgtcagtaaattgctgtttggagatgtgagaggaacaagaaggtggaaggcaggttatttattgctttctatgcttggaaccacgaatgaggtaggcacaaatacattcctttagagttaagaactatgacgtagctgagttagtgagactagacatagtaccgaattgagtgtcatgcgatgggtcttagagggtgaatggaacaagagaagtactatgcttgtgtgcgagctcaaaccaaaagcaatgtgttgtaaaaatgtctttcatgtaaaagtgcagtaaatatgtaactatttataaatgaataagacagttgatgaagaactttgacaacagagaaagaaacagg

SEQ ID NO: 552330 - DNA, 402 bp, Homo sapiens
  misc_feature (30)..(30): n is a, c, g, or t
  misc_feature (139)..(139): n is a, c, g, or t
  misc_feature (207)..(207): n is a, c, g, or t
gtatttgtgacacctttgataataaaaagnagggcttcttttaaaataaatctgatgttggccgggcgcggtggctcacacctgtaatcccagcactttgggaggctgaggcgggcagatcactagaggtcaggagttngagaccagcctggccaacatgggaaaaccccatctctattaaaaatacaaaaattagccaggcaaggnggtgcatgcctgtaatcccagctgctcaggaggctgaggcaggagaatcacttgaacccaggaggtggaggttgcagtgagcctagatcgcaccattacactccagcctgggtgacagaatgagactcctccttcttaaaatacataagctaacatctcttaaaaagacattctatcataccattaatgctatgg

SEQ ID NO: 552331 - DNA, 158 bp, Homo sapiens
tagatcgagctcggtaccgtgtacttctgctgcccctgcgcctcagaggtctcgtagggtctttcttgggatagtgtacttgctcctgcttttctgtcctgggcatgggtccaggcctgacaccccctccccgcccctgtggccctggccactaaagc

SEQ ID NO: 552332 - DNA, 931 bp, Homo sapiens
tcatcatcaagatccatgacatgaatgagaatgaaccaatattcaccatgtaggtttacacaggcactgtccctgaaatgtctgatgtcggtactaacttggtggtccaagtcactgcgaggatgcagatgatccaacatatgggaacggtgctaaagtggtctacagtgattctacagggtacagccgctatttttcacggtgaatcagaaacaggtattgatcaaggacagcttgctcaacatggatcgagacaacagggagcagtaccaccgtggtgattcaagccgacacggatatgggcggccagatgggaggattactgctgggaccagccaccgtgaacatcgacactgagctgatgtcaacgagatcctccccgatttgccccagagtacataccagtttacaactcctgaatcttctccaacggggacatgcaattggcagaagtcacaggccagcgatgctgatgtgggacgaacaatgctgaaactgagtacagcatcacagacggtgaggggctggatactgtggatgtcatcagcgaccaggacaccccagggaagggctataacgtgtcaaaaagctcttggcagtgcgaacacgcacagaaacgcgtacaccccttacaagcggcaagcctcacgtgctcaccgtagacgccacgacctcgactgggcgcttcccaagactccaccccacgtacgaactgcggccaccggctgtccactaaccccacgctgccctcacacacccgcctcactctcacactaccgcgacactgcccactaccccaccacacccccccacacgccacaccccacacgcgccacgacccccgccaccaccctccgaccgccccgctcgcccccctccccctgcccgcaccgccccccaccccccggcccgacccgccgccccccacccc

SEQ ID NO: 552333 - DNA, 81 bp, Homo sapiens
  misc_feature (5)..(5): n is a, c, g, or t
  misc_feature (39)..(39): n is a, c, g, or t
cccanacccgcacgcagcccccaggtagaccccgggttnctccgaggtccttaggtcgggacggtctcctcgggcgcttgc

SEQ ID NO: 552334 - DNA, 315 bp, Homo sapiens
atagcgttagctcttcacgctgggagctagtagatccggatctatacctattcggccatctaggctacctctctccaattctaattgggtatatatccagcagtgggatatagctggatcacataggtaatattttaatattttaagaatgaatacatacataactagtatttccagcggacagcgagctaccatattatatgtatcccactcaagcagtatcatatactagtatatctaccacatacctatggccaatcactatgctaatatttctacttatattagacgagtaacccatacctaaatagagta

SEQ ID NO: 552335 - DNA, 256 bp, Homo sapiens
tatgctaggagccaggaagactcacggattcttacttcgctagtacaaatgatacacctacgaagaggaggacaggaagtctcacggctacttactatatgctagtagaaatgatacacctacgagaggaggacaggaagtctcaacggctactttctttgctagtagaaatgatacacctacgagaggcggacaggaagtctcacggctttctatagctagtagaaatgctacacctacgagaggaggacaggaa

SEQ ID NO: 552336 - DNA, 994 bp, Homo sapiens
tttgtttgtgctcttttcgctgtggtttttgtctcttggctgtttctgtggtattgctttggtgctcttgattctggtcttgttgtttcgtgtgctggcccgtgggggcgtgtttctgggtcttatgtgtcactgttgtgtctctgctctccgctcctgttcgtgtgcttcctcggcgttaggttagcttcgtgcttccctcctgcctttgttggtattcagtctctgtccctgtgctaacctaacatacaatgcaagtttctggttgttgtgacggatacatctcttgggcccatagtctgcttgtggctctctatgtagggtgctaatttgcgtgtttaactttctctctctgctttttcagtccttggtttggtgttctgtcacaggctccagtctagccgtcttggtgtgttatctctcacagctagtactaaggtgggtctttgcgtgtttggtatggttccgctggcgggcactttggttcactgcttccgctcagagcgttccattagcgcgatgctctgtatgtagttgacgtagtgtgtgttctgatgagattgttaagtattttatttgttacatatatctccagctgatagtatagtgaatgccttcccctatagtgtccgtgctccaactctggtgcctggggctctgctctgctgctcccaggaagggggtggcgtgtacatggctaggtacttgtgaagtcctagagtcctaggcgtggagcgcgccagcatcagccccagagcagcacatgacagccacagtgtgtgcatctcgatgatgtcggccctgcatacggaggaggacagtgagacgatgccactgcgcctacgctcgcccctgcatacttacatatgtggcaaccctccctcctaaggttcctgccaccatgccatattgggacacacaatcagattaacccttcgttgacaagctcggtcagggattatttggtgctcctcatgaaggtagactatctgtt

SEQ ID NO: 552337 - DNA, 101 bp, Homo sapiens
gaaaagagcagtgtgtggagatgtacacagatggtcagtggaatgacaggaactgcctgtactcacgactgagcatctcatgatcatcctatgcatgtagg

SEQ ID NO: 552338 - DNA, 107 bp, Homo sapiens
tggtgatagatgagggagtcttgggatctggtcactacagaatgctggtaggagtcacaagatggggaaccctggagcaagggcaggtagggaagggtcccaaatca

SEQ ID NO: 552339 - DNA, 501 bp, Homo sapiens
acaggatatgaaagttgaggatggttgaaagttgggcgaggctgactaaattgtgtgtaatagccaacgtgtgaatttaaatgttggataagaggacgatgtaaaatggagaggaaaaggtccaaatgaaggacatatcaataatcccagcaagtcgggaggctgaggcaggaggattgcttgacctaggaattgaagaccagcctgggcaagatgacagaaccccatctgtatagaataatctttaaaaatttagctgagcatggtggtgcatgcctgtagtcctagctactcaagaggctaaggcaggagaatcacttgagcccaggaattcgaggctgcagtgagctatgatcatgccattgcactccagtctgggagacagagtgagaccccatctctaaaaaacaaaacaaaacaagaaaacatggaggtcttagtaattcaatggacattgttgatgataaacaaggggagattcgggtttgaggctggatggca

SEQ ID NO: 552340 - DNA, 600 bp, Homo sapiens
taagagctgtctgtttagttgcctgcctctcatcccaggcagactcatgagccagggcctgcagctgaggacagtaatgggctcctctctgaataggggctgggggagctagcagcagcctgagatcctccaaatgtgtcttcccccaggcctggaaccacctcatatctaggacggggttgaatggggccccagtcttctccgttcactgggcggcgtccttgcagaggcttaaaccgtactcgtagaatggagccaaggtgaagccttcattctacaaatagggtctgagcagaaaggagggcccctcttctcaatcctactcactcaggacctggtctcagtcacaggtgggatgagagcagaaagggaagcactgctatcctgcctctcctgggaagacaccccgctgcctgggagctggggaggtggccctgtgttcttggctgcagcaggatggagctcaagtgccacagactctccgtgtccttaccaaatgtatgtaggtgttctggagcaagtgtttcttcatttgctgggtgcccataggaccatttccaaaggctctctaaatggctgttttgggactgctcattactc

SEQ ID NO: 552341 - DNA, 200 bp, Homo sapiens
cacgaggcttctgctcctggcccttgctcgccgcctccacggcgaggccgaacatcggcctggggaactcgaacggtgcgagatggatgtggtcctcgtcgtggctgtcgtgcaccaccgcgtcgaaatgcagctcctcgaccttggcgacggcggcgatgtcgccgggaatggcctgctcgatctcgatgtgctccttg

SEQ ID NO: 552342 - DNA, 125 bp, Homo sapiens
agcgatctcgaggataactctaaagcattcatgcaaggtgctttcatgttagttggaaacaggataatccttagtcaggatatgtaggcacagcctaaaataatctttgaccacagaagataatc

SEQ ID NO: 552343 - DNA, 436 bp, Homo sapiens
  misc_feature (49)..(49): n is a, c, g, or t
  misc_feature (100)..(100): n is a, c, g, or t
  misc_feature (306)..(306): n is a, c, g, or t
  misc_feature (348)..(348): n is a, c, g, or t
  misc_feature (360)..(360): n is a, c, g, or t
  misc_feature (411)..(411): n is a, c, g, or t
tcatgcctgtgaatctcagaactttgggagcccgaggtgggtggatttnttggggctgggagtttgaggccagcctggccaacatgatgaaaccccgtcnctgctaagattacaaaaattggccgggcgtggtggcacacacctgtaatcccagctacctcttgaggctgaggcatgagaattgcttgaacccaggaagcagaggttgcaatgagccgagatcgggccactgcactctagcctgggcaacagagtgagactctgtctcaaacaaacaaacaaacaaacaaacaccaaaaaccaggnagttgatattgatataatactattaactcatctacatatgtnttacaattttgnctcttgttccacttaatgtctttttttaggttcttgagtcaatccaggagnccatgctgcaatttcagcctggggt

SEQ ID NO: 552344 - DNA, 223 bp, Homo sapiens
agcattataaaaaaacttaataccattacgatattcaagaaccaaagtcacggccgggggcggtggctcaagcctgtaatcccagcactttgggagactgaggtgggcggatcacaagggcaggagtccgataccagcctggccacatggtgaaaccccacctttattaaagacacaaaaaaattaaccgggcatggtggaatgcgcctgtaaccccagctat

SEQ ID NO: 552345 - DNA, 109 bp, Homo sapiens
  misc_feature (39)..(39): n is a, c, g, or t
tacaattcagctctgtacccacggcttcttgtggttacntgaccccaggctgacaccagcctctcacggaggcatcttatgttaacctacctgggttaggtctacctgg

SEQ ID NO: 552346 - DNA, 231 bp, Homo sapiens
atagtgagatcctcgccagtatctctcacgtcttcaccaccagcccttacgaaccctcctgtctggcccagctactcaccaaccacgcccacatttcagccccagccagttccaggaatccagggatcaccaccaagctccccactttcagctgtgttactccccagtctctagcacgtgtttatctccaaacctcagggactctcctgtctgtcccagctactttccaac

SEQ ID NO: 552347 - DNA, 208 bp, Homo sapiens
  misc_feature (69)..(69): n is a, c, g, or t
atttcccccccccaaaaaagccttttaaaaccctcttggggtttaagcattttgcccccctttttaaangcccgttttcccccccttgggggggggaaaaaacgggggattttttaggggggctttttttgttaaaaagggaggggggccgggaaaaaccccctttttaaattgttttgggcaaaagggaaaaaaaccttttttccca

SEQ ID NO: 552348 - DNA, 159 bp, Homo sapiens
  misc_feature (145)..(145): n is a, c, g, or t
gccaactcaggtcatcaaggccaaggaccagtggcgaaagtgagtcttggggtaccttaggccttggctagtctgcgttcctctccctgcatgctgtgtatcctaactcaaaacaaccccccctcaaataaatcacatttagtgntaggtgccaacaaa

SEQ ID NO: 552349 - DNA, 639 bp, Homo sapiens
cttcaatgtaaataattgggattagaaaggaatgaaccgcctaagttgcaaaatactcagaatgctcttgtgtccaggggttatgtcggccttccctcaaagggtataataggcaagttggggataatcgggcattgacacacatacaaatttgatagttccgggtctgtaaacatcagactaatcacagttgcatgggatattagtatactcaggtacagtatctttcatcatagtagtactgttgataacaccagctgtctcccatgactcttatgggtaagagtcaggtagctagtattaatatcgtgtgtagctagctggtccaagtacaatgtgtcggagcatctccataggatgacgtcatgtggtacacagatagtacagggatgttgcgtatgtttcgtgagcgagtggttgtgtttatgcatggaatgtgtagttcgagtcttcatgtcagtggtagtcaaatgaccgttggcaagtctagtcttagcatagtactgttcccagtttatgaaagtaattaagaccatctgtgttagactccgatacatagtacgtctagggtcgcggatgcttaacaggcgtcagagcctcctccggcaatatgagcaatgtcggataccaccgagtagg

SEQ ID NO: 552350 - DNA, 843 bp, Homo sapiens
  misc_feature (489)..(489): n is a, c, g, or t
ggaggctcggaccggcccgcgaagttgctgaagtccttcgcgctctcctcgccttcccaacggaatcatgctcaagttcctgctgggattcacacgtggcaacgtgcttggaatgtatctgcgctcagaaatatgatataccaaacgtggttaaaaaaaatgtgaagaatattaaaaaggactgtggaatgccaagaagaaacccttagtgcatgagatggctccagcagtggcttcaggatatacgtgattctacgtgctctgtgagggcctcgtttatatctgaaccaaaagctttgggtttggtctccagcctcagatttctcttcttgtgctagaccctgtgtttttgggtttaaagaaggcaaaatatggggcccaattgtgagaataacgatatttccaatatactcacctcttccaataatctctttccaatgcatgggaggttctaagatgcaattatggtgctagatcagtaatcatgantttaaatgagtagtgtctcttacatcgtgcggattttaactacctttttttccacacggaaaaattggatcgagttggtaataggtggtccagaatacaaaataatcagtgacattcacaggtcgaagaattcataagtggggtcatctgtgcaaccattgtggagctaaaattattgtggggcaaggtattaacttggtcttagagcacagtttgggggatatccacactattgggacaggtggcagggcaggcctgtgttggtaatttaaccacaaaggtcacttgggtttcttgaacaaacagagtctggaaactcgccggactgggggtgaaaaacacaaaacaggtttg

SEQ ID NO: 552351 - DNA, 1164 bp, Homo sapiens
  misc_feature (1)..(1): n is a, c, g, or t
nttgcgcccctcgcctctcttgttttgcacggtcccattgtggtattacccgttggcccccttgttgggtggtggcaagggccacccatttgccgccatttttttagggggcgccacaccttttttggggagaccttctcggctgaggggagtcccaccccaggtttgtggggaccccaccataaagccccgcgggccctatgggttgaaaccctggcctcggcgcccccggtgtaccttttttttcccgggggttgtcttaataagggttattccggtggaggccctgggggtgtggcccgctaattttctgggcccaaccgctagggctttattttacgctctttttttagtttataagaggttttacacaccgcagtggcctctaggcgtatgttcccgccgtgttgcacccaggggagagggtttcccacgccccttgtcgtgtgatatgctctcccccctcgggttcccataaatagggggcaccaaaagcccaatcttttaggcgcatctcctcacgccatatgccagcgttctccctaaacacgctttttttgcgctcttaagctctcacacactcccccccacccggggggaaacaccacgcccacatgtatttatcaccctgtttcgcccccattttcccgcgaagtgttttaacttatagcgttatttacttgacccccccggggtttgggtgccacatgtgtctcgtggcccccacgccgcacccgcgcggtgccaccacacggttttttacccccctcaggtccctattttgtatataccccggcgcgtgtataagagagtgtgtgtttatagagtccacaccccctgctccccacatttaaagccgttataacatctcccctgggagagtgtgtgagagaaacacactcccccgtgtgacacaccacaatatgtgagcttaccgaaagatggcgttttaacacatatatatctggcaccaccacccatatagctttagacccccaactgggattagattacccccctgatgcgtttagcccttaacctcccaccagtttgaatccacaccgaaactgctccgcccaggacccttcgagcccccagctttaaactccaagggcctggcggtgcttctatatccctttagaggggcctgttcctgttattata

SEQ ID NO: 552352 - DNA, 148 bp, Homo sapiens
  misc_feature (10)..(10): n is a, c, g, or t
gaatatgttnttcatggttacttgttttaaaagattttaaaaatcattgcactttggtcagaaaaaataataaatatatcttataaatgtttgattcccttactgcttgctttttcaataaagtttgaagtccaagtgattttctttc

SEQ ID NO: 552353 - DNA, 223 bp, Homo sapiens
cgtatctgcgagaaacacctcagtgaacccagtctggtcctggcacttggttttggaaagtttcattataatttgtttgagatgcattctcattctgtcacccaggctgcagttacagtggcacaatctcagctcactgcatcatccaccatcccaggtgcaagtaggggtaccgagacgtcaacttcgataatcatagctcataagctattttcctgttggt

SEQ ID NO: 552354 - DNA, 877 bp, Homo sapiens
aggggaaaagtaaccaaaagagagaaagagaaaggaatgctggtttatctttgtagatgtaatcgaatggagaaatttgcagtattttagccactattaggaatttttttttttggtaaaattgaagactgaactcgtgttcaaatgctttcatgaaccgggttggagacggtaggaaagcaacaaaacggtgggaaccgggtgactaagggcctgggtgcaaggactggggaaaggtcatggataatagatgggggggttttcccccctttagaaatgtgggatattaagtgatataaacacttctttaaactccgaaaatcttcggagaaatcacaaaattcacggtatgctcgggaacgatcggagattccctaggtagatgctggaatagcctagacttcaccaagtgggggtgacaccaaaatcagagtcagttggacccagacatcagccacactcgggcgtctggacaaatggttcggcctggtgggacattaatttcaacgctctaacgtatatatcaccatcatccccatggtggcacttcaacacaataccaaattcagggtcctctcaaagtcaaacaattctaaccacgtgtaaccaacagttccgggcgtcactcccctggtattaacccatctgtgttcggcccgcatctggagggtcactcaggggtgccaacacactctggtaattcccctggaacaaagtgtgattatacttcgccacttaagtcacaagtaaccctaacatacgcgaccacaacaagcacaggacaaatcaaccagcacaaacactactctggtggcgcggacccaccgcccctcttgaaaaaaccccttcataaacatcgctgctggggggcgggccc

SEQ ID NO: 552355 - DNA, 464 bp, Homo sapiens
ggatccgttgtcgggtatacacgcaggctctgggacagtttgggagataggtctggaaactgggtatatgtgacggagatgtatggccaaaggcaatttcataaacaactataaagtcaacaaacccacaaattgcttttagagctaaagttaatattatgcagttcagtctctcttttttacacacaagaaaactaaggtccaaagaggtacttgcaaatagtagataataaatattagctgattgcaaataatctaatcaagtcagtctttagacagattcattctttatggtatttaatgtcagaacgaactagtcttggttttagtcagcaattcaagactaaatcatacttgtcagcatgataactaaacaggacccatcaagggaatctggctttgctgacaccttgatttcagaccagtgaacctgacttaggacatctgacctccagaactataag

SEQ ID NO: 552356 - DNA, 172 bp, Homo sapiens
gatatggataataggccgcgtactcgacctcacggatccgtgtcgagattcggaggaataaggctcggctcgacccggtcggtccgttggaaggatccattgctggtgtagatgttgcaatagcagtgtcgggtacgtaaacgagtattggaggaagtatcattatgggtag

SEQ ID NO: 552357 - DNA, 438 bp, Homo sapiens
tgtctacaggatcttcaacacgcaatctcacctccacctcgttacccggagccaccctgctaagctgcgcacagcgcccgctgcttaccttcctgaccgtgcctgcctgttgcttacccctcgtgacacaccctgtagggaggcgttgctctgcaagggaaggggtctttggggcgaggggaacttatcccaacccttggcttaccttttgtacatccaggaggatgctggtgattggaacccaggggtggcccacccttctctgtgcttactccatcccgttccctgcagaggcgatgcccaagttcactgggtttcttttgaaaaaattatggggccgaccccatgggtccttggtgaaagtatgaaagacacgttgacagagcctctggtctggatttgcccttctgccagacgtgggaaggaggtttaatttat

SEQ ID NO: 552358 - DNA, 214 bp, Homo sapiens
tctagtagctctctcccaaagaagccactaaacgcagtaacagaaatgacgggtacaatggtggtcacaaaggccattgtgtatgtatcctgttagcctcagacgcaaagaacagcgccaggctcatctcactaaccagtatatgcagagaatggcatgtgtacgagctgttccctagctctgttatctagccacttaccagaccagcacctcc

SEQ ID NO: 552359 - DNA, 225 bp, Homo sapiens
tactttttaaaaatctttggcccttttccctgttcttgttaaattatatacattttttggaattccaggaacaatttaaattcaattgtatgatgacttttttataagtaaaaaattttcctaattaaccaaataggtccatctggtttttgtaatgcctatctataccttcccaggccgaaggttctcgggttttgggttggcacagaggaacagagaagagtc

SEQ ID NO: 552360 - DNA, 125 bp, Homo sapiens
acctgcaaactttttctgtaaaggaccagatagtaagtattttatgctttgtgagccatacagttttcgttgcaactagtcaactctcaacttcaccgtggacagcatgtaaatggatgggagtg

SEQ ID NO: 552361 - DNA, 453 bp, Homo sapiens
  misc_feature (364)..(364): n is a, c, g, or t
  misc_feature (416)..(416): n is a, c, g, or t
  misc_feature (436)..(436): n is a, c, g, or t
gagctgcattatcagtgtttgtttttatcttgctaacataaatgtaacatgttcaagaactggattcatgttttatttactaaattactattcctcataatacttagcatagtatttagtgttaggtgcaaggtagttaatcaataaattctgaattaaattaactttgctaggaaacaggaggccaacagaagaataggcaagtgtatatattcaaagatgacctaaacaggggtgcaattttgactcaacaaattaagggtctatggaatgttaataaatacagtgtttgggtatatttgggccatatctttatataggtttggggtatatgtccgctaccccaaatctccatcattggaantattattcccctgggagggtaggggccggggtggggagggtgattgggtccnggggggtaggagttcccccnggatgggtttaggccac

SEQ ID NO: 552362 - DNA, 867 bp, Homo sapiens
tggtatatagaaattttattttcttaatgcggcacagtggacatacaatcaatattattccctacaatgtgcaatatataaattattcacattaaaaaattaacagaaagcctcatatgcaggaaatatttaaaaatgtgtatctaactttgattctggggctgactatacactactagctttatagatgtggggagaatacgacatttacacatttgaatgaagaacccgggtgggtccattccagatgcttattaccccggatgaaaaatatggtcttcatttgggcattaagggtccatgggctggggcatatggggggatcccaaaaaaatttacaggaagggcatatttttactgtggcgttttaaaaacgttctgcggcctttgaaatcgcctctagaggcgagggggggctttttttgctttaaaaagaagaaaaagcctcgaagcctggtttttttgaggaatgggctggccgccctttggggcggctatattcactggcgccagagccgaaggtcgtgccggagaccggaggggatatgcggagaaaatatacattgccccgcgtataaggttggaaaacagagggatgacgctttaaagaggtgccgagggaggccccgtagtggcaatacaatgctggagactcgggtgttggataatcgcagggggaatgaaaaggaagttcgcaaggggtaatcatgggttcatactgttcctcaagactaaggcggaggttgagtttttggtactgcgttggggccgggtatagatgcgtctagctgtggtgtgcggaggtcgcgagaaggcggtagattaagatgttcctcagtactttgcgggcacatatagaggcgccgg

SEQ ID NO: 552363 - DNA, 912 bp, Homo sapiens
tagtgaggcggaagtaatagtatccggagtttgtctgtccgcgcgctcctgaagtttttggttgtgtcgtgctaggtttggctctgtcacggttccgtgtgagagttgcttgtcgcttgtccgtggctgagcccactcgtttggccttcacggggatatggtggtccatgttccatatttgtccttattgctgtttgtaagattttgcaattgctgctgggcaaaactgttagcttgctgggagatatcctaggagtgagtctatcattcatagagtgcttgtacatttaacctgttgaagtcgctccagctgtttttcttgacgtggcgatagcgttgggtgcatggcctcacacctgtaatctcatctacgcaggaggctcagcttaggaggattggcttgagcccgttgaattcaagaccagcctcggccagattagtgtgaacgcccgttctgtgactcgtgtttgtggagtccgcatgtgaaagagtgaccaaggaagaagggaagtagccctgacagaaatgggtgtacacaatttgtagggttccccaccagtaacttatagtggggttcccatggtccgtccacatctgtcgactgacaattttgtgtattccgaagatagggcgcctgtgcatcatgtctttcatggccgcagtcaatgatgccatcacagttcacgtgcagccgtgacctcccaggcacaagtgagttctctcatctcagcgcctcctgggtatgctgataattacaggtgtacgccaccatgcctggctaatttttagattttttctgtagtggtgggattttacccatgttgcccaggctggtctcatactcctggcctcaagtgatgcccactcacctcctattctgaacagcccaaacatccgtttccaacaataaca

SEQ ID NO: 552364 - DNA, 298 bp, Homo sapiens
ctagggggagagcgacgttaaaaaaaatttgaacaggactgctttattgtgtaatttatgacacaactgttacatgaattgcggatggaggcttaaaatatatagcagctacaaaaaaaatcagataactcatgcttcatgtcactcctcccacaaatacttctagtctgttcaactgcagtcaattctgtattggtttgcctgtgaattagacttctcaagtctttacacagagtaaaagaaatggataaaaatcaaagtatttttctgtactttgtatcaatgtattctattctgt

SEQ ID NO: 552365 - DNA, 864 bp, Homo sapiens
gtgtgcagacatgtttcgccccgttcagatcgggggggcgtgtcccttcctcaaacacacagcgtgggggtgtcgtccccgcccccttggtggagagtaggcgcctgcccacgaggtgggttccaccaaaaaccaccaccctgggtccgacaagatgtccacaggagccatcttggacacacttgtgcgatcagcacctccagggggggacacgaacgccaccatcacgtgcttcgtgtggccgccgccaccaactacaagtgggacttttttctcagttcgacgtataaaagcgtcggtaacccccttcttgttgcccccccgagcatggcgcagtcattagcacacgcgtccactcggatgagccaccgccacctggggccactcatctgtgcgcatacgatcatttctgtgaaagatcctccaaacatctgttcctccagtcgttttaccaccaaacaatctcttcttctggatcgacgaaattgttttggcagccgcctgtctccctgttgcaagcggggtgttacctagtccccacctctcattctctcatgcagggtcatgagaaataaaccccccgcgaccctttgcggcttagcgtagcgcagccacgatcgcgtccaccgacgcaccacactgctgcaggacactagcctataaccccccactttggcgcggggcccacccccacgaacacagaacgaaggcgcggcagcacgcgaggcatacaacaaccaccaccacgccacgcttggcgccagagacggtaacgaccacgcacgcgcgcaggtcgtgtcccccgcgccgaccatccgcgggctcaaacaaacagaaaaaaacaaacacaaaaaacaaagacaa

SEQ ID NO: 552366 - DNA, 214 bp, Homo sapiens
  misc_feature (3)..(3): n is a, c, g, or t
  misc_feature (6)..(6): n is a, c, g, or t
  misc_feature (58)..(58): n is a, c, g, or t
  misc_feature (120)..(120): n is a, c, g, or t
ctnctnaagtccacggtgaattctcgtaaacacaataatacagaagatgaaaggtcgnacagcctacgataatctccccataaaatgtgacatgaatcaggaagttttaacctcacgtgntgcgaaatcatcggtgtaaatagggctatatgccgcgtcttttctggctaattttatgaaaagatatttattggcggaacaaaataaagaacaa

SEQ ID NO: 552367 - DNA, 159 bp, Homo sapiens
tcgcttccttgtattactcgctctaataggggtaattctaacacgctccatctgcctacgacaaacagacctataaatcgctcatcgcttactcttcaatcagccacatagccctcgtagttacagtcattttcatccaaaccccctgaagctgcaccg

SEQ ID NO: 552368 - DNA, 949 bp, Homo sapiens
gagacgctgcagcgcactggacccccaccaagacacatatgacccactcatcaccagtctctgaccatgaggcctagcccatgaggtgctgggctcctgtggcttctactccatgcgtgaagatctacatctgacctggccagcagggatggggaggacgcatgacccaggactacggagcctcagtggagactcaggccgtgcagggagatggaaccttccagaagtgggcggctgtgcgtggtgccttctgtgagatggagcacgagatacacctgcctatgtgcagcttgagggtctgccctaagcccctcaccctgagatgggagctgtcttcccagcaccagcatcgcccatcgtgggcgatctattgctggcctggttctccattggagctgtgatcactggagctgtggtcgctgccgtgatgtgtgaggaggaagatgctcagatacgaaaaggagggagttaccactcaggctgcaagcaagtgacagtgccgcagggttactgatgtgtcttgtcacagtttgttaaagtgtgaagacagcttgcactagtgtgggacttgatcaggcacagagattgtcgcagggccattctcactggtgtcgaacttgaaggaagcccgtgacttgggtttctaggaaaggtgcaccgtgcatgatgtgctgtcgtctgtgtatggcataaatgtgaggaggtggcggaagaagtaatctgacaatgcccacactgtttgccaacagcatgtgaccgtttagttgtagcagagactagagacgggcgttgtactaccttggtccaaatcagtacatatcgctgggttctggaaaataagggtggggggcttggacaggtagttcttccaatgcaactaggtggttcaattatataacatgggatgaaaaatgcaggctggtataatctagattcgataacccgaaat

SEQ ID NO: 552369 - DNA, 974 bp, Homo sapiens
acgggagaggagtgtgtgtgtgtgtgtgtgtgtgtgtgtgtatacttgtgtgtgctttctcttattttactttttggtggtggctggtggaaggggggagtgatgctagcagggctcagtcttgaactcgctgcgagagacgtctacagatcctactgtggcgccatggaatgtgccgcggatgatagaaatgaggaagaaagacacgcaagaagggagttaggctgacagacaaaactcattagatgtcccaaaacattgtctctgtgagagtctgctctttcgacaagaatgctccctcagaaaaagtgcaagtcgtctctatgtcggatgttcttccacaccaatcacctagacgagctatctctctagatcggtagacttgtgcttggcatgacgacccacgaccccgagaagatgtcctctggtaccaggtctacctgaacagctcttctcgatagacaatcttagtgctacgttcgcccttacaatgacaagacagcttgtaccaagtcacctcatcaaggcctcaagagggagacgacgtcatggatgagaagtggagacagcacacacaaataggtatgcagaacaatagtcgaaacaacgcactgtaagagacgcactataccatcaatgagtgagacccctcatgaaatgcttggtaggtctacttgatcaagaagcaagaaataagcaatacaaaacgggagaagacaaaacacacaggcttgatcgcaatgcgaaaacaaggcgccaggagcaaatctgacccaagtgaaccttccacaagagtggaagaggcagggacaagaaaacacaaacgtaaaaagaagatgccatagaggagtacatgacaaacaagcgaagtagggaggagcaacacaccttcacaacgagacagcccatacagaaggggcgagaaggacagataagaacaagtagacaccaagacacgagggagagagaagacc

SEQ ID NO: 552370 - DNA, 158 bp, Homo sapiens
gagaataatttagatatttctcaattggaaaaccccggcggcgagaaacgctcaaatgccaattttaatagtagtatcacttgataactggtagagctgtcttgttaataatataaaattgcttatgtgtattgagcactagctatgtggttgggata

SEQ ID NO: 552371 - DNA, 397 bp, Homo sapiens
tagacatagtactagcatccgacaatagtaccgcaaatagggagggctgtgcgactcaaaggctacccatcgattggagtacgtgtcctatcaagtagggtggcgcagagccagacgggcatatgtcatgaaggtttctccgaacgattaatggtttgctagcttgactagcctagggacactcaatccatcaaggtccaagtcacacttttttcaatgcacatatggggcacacaataactggtgtcttgtaaatgttctgtttttttcactaaaacttctctactttagtctttactttaaaaatatgtactatttcctttacagtcgtcacttagtacgtaaaattttcttaggtactgagctcagcatagactaatactaccttaatgttaaa

SEQ ID NO: 552372 - DNA, 467 bp, Homo sapiens
  misc_feature (348)..(348): n is a, c, g, or t
  misc_feature (369)..(369): n is a, c, g, or t
  misc_feature (411)..(411): n is a, c, g, or t
  misc_feature (455)..(455): n is a, c, g, or t
  misc_feature (463)..(463): n is a, c, g, or t
atagagggagaggagcatgccagcttcctttgcaggccctgtctcataattccagtactcccaattacatctcattggccagagcttagtaacatagccacacctcactgtgcatctcctaaattatcataaatctcattttttgaaaaattaactcacaatcttctcttctcctggccattattgcaagagattgggagagagctagtacaagagtgagattctttagtgtctttctgggtgattccacgccaagaggtcttcctctgtgtcctcacaacagtaataacccgtaacatcatgaatcagtcagggtttaccagaagaatgcagacttagtaggttacntgcattaagggatttattacnaggaattgggcttcctcaattgtgggactggctaaacaagcntgaaatccacagggcaaccagtcaggcaggtagaccatgagcangctggatncctg

SEQ ID NO: 552373 - DNA, 1386 bp, Homo sapiens
ggcatataggggaacagcagagcatggtgaatccgggctgcagctcgcagtcgcccccggtgacagcgtgctccctctcgctggtaagtcggtgcagcatgcatgcgggggcaatcattgcaggtacctgggtctctcttgtcgtctcatgtccaatggcacgaggcgtaatttggacacaagaccaggtgactctcaaagatgtctccatgactgcacagggtggcagacgtgtggcggacaagtcggtccatggtccctgtttacactcaaatagttggcattgatccgtttggcatgaaactgtactaccgtttatggtttactttgtgaatattacgtcggttgctgttgcaagtcgcgtttgccgcgaacagatctgaataaccgtgcagcatgatgaaatcttcgttccctgcaggggcgcaaggggcaacattgtgttatcaatctttagagttgtttgacacttgtctctaacgcttgaccggatagtctggccctggtgatctcccggtggaacgtagtccgggttgtccagcgttagcaaattctatagtaggggccatggtgtttaagtcttctcggtgaaaacctagttgcattaaagaaacccctgaacaaaggcttacttcacttcctaaacgttggggccccatttctttgacacgtttgcgaactttgttccgaaggaaagacaaaaagtccacaatcctttgatctggggccgaatgtaaccccacgaaaaaggtgttccatttgtcttaaacatggggggtccaggcaacggttaaaactggcaacggaaaattggccaggttgtcctttttcgagtacttcaagggaatttctggggtacaagttccaaaccaagggtttgtgaattctccccaaatgggttggttcttgtgccaggttaaaggaaccaacacacggttcaaaccctttttgtttgcgtaagagctttaagggctaagcccaaaggtttgcctccatgggcgtcccccaagttggcgcgaggtttgagacaaacacccattttcctttttagtaagggttccctttatggaaattttgtggcgcccctttatctcccccggtaagttttgtaacttaagcgggtgcgatatattttgaacacaacagttttggaacctctgcgagcacattaagtttggacagcgccagttttacaatggcgcgcacccttcccgcagtttggacaaccccgttggtggggcctttagaacagttgggggggacaggaacgcattgcgttaggcaagcttaaacacacttatttggcaacgcacaaacatagtgactttccccaccccacaaggttagagggcaacacagttcccctctgggggagcgaaaacggcg

SEQ ID NO: 552374 - DNA, 233 bp, Homo sapiens
ggtggttctggcccttcctcctcctctaggcactggctcatcatgttgcacttcatcagctcaatggcagcaatcaaagactctgagatactgaagtgggcattctcctggggaaagagagcacgaaaaaggggcgcctgaccaattgtactgttgcaaagtggcttccaagatgtgcactgctgttacttgaaacacccagtgcaaaggcacagccagaaccacaaatatcg

SEQ ID NO: 552375 - DNA, 246 bp, Homo sapiens
tttcctggtatctcgtgctagatcattatacagtgttgtgtagatttatctgtttcatagtgttatactgtaaatcccacgattgtagagttcgtacaataagtcctgaagctttgtgtatggctgcacctgcatgagctgctacaaatagaataaagaatttcatagcctgtatctatcatttagatgcatggaacaaaaatgggctatagcacacaatgggtttggagctgcactgggaacaat

SEQ ID NO: 552376 - DNA, 241 bp, Homo sapiens
gttaatagaaggtacagtactgggaattcagagaatgggaatatagtctggtgccaccaatcacactagagtacctcatttctcatgaaatattgggcagcatacccacaaggtcctgcatcagaagtgggcaataactagtctagtctaaacaagattctggctttacctaaccaagcataaaataaagccaacaaatcaaatcatttccaagcaatttagctgcaacccaaaacaaagc

SEQ ID NO: 552377 - DNA, 405 bp, Homo sapiens
  misc_feature (21)..(21): n is a, c, g, or t
gctaaagcctgtaatcccaanctttgggaggctgaggcaagaggatcacttgaagccaggagttggagaccagtctgggcaacatagggagaccccatctctacaaaaaataaaaatttagccaggcatcctggagcacgcctgtagtcccagctacttggtaggctgagatgggaggattgcttgagcccagacattggaggctgcagtgaagtatgctcatgctactgcactccagccagggagacggagcacgacctgtttaaaaaaaaagaaaaaaagaaaaaaaagattgcagttaaggtataatcttgaatctttatgaattaggtacatgtcatattaagtgtaaaggcaaactatttgagatcagggggagttataggggcatagttagccccaatt

SEQ ID NO: 552378 - DNA, 860 bp, Homo sapiens
ggtagtccagcctcacaacatgcgggacgcggcgacagtccggtcccgtgaccctggacgtagtctgaagactgccgtgatctatgggtcgctgacttagtgctgggatgatcgcgcaagaagcaagacactgcccgggagaagctaacctgcacgtgttctgtagtcacaatggctagatgaaaggttgcgtgcggcccatgaacatggatactatccatctagagagtcatggcggatgcatcgaatcttccattatgtacagaccgagatcctgggaacggcatccgcggggtgaggcttcccggcctgggggcatttacaaacaaatgcgctccggaccaatcaatctccagggagatccagacggccggtgcgcctttgctgctgcccggggaatgttgggccaaagccacgccgtgtgatccgcagggggcaaccaagtggagcgtcaaccaatggtacaccaagtcgcttaaagtaaaacctgtgccaacagcgagggggaacattcctcttgcgaaatttccctggatatgacccaaggaaaagccttcctttattcaaaaaggaacggcaacaaatttggggcttttgcggtttaccctacatttatttctacgttgcagacacaggaaagacggaggacttgcaaccattacccttaagattgggattttcccacacagactaaaaggtgggccttctgggatctcattccaagattcccaagaagcaagatccatttcaccgaggttaatttgtctgtccacatggggccaatctgccttctctctaataactcttacgggtccctcaaagatggtctacttaagccatctctttaggctctgagaagc

SEQ ID NO: 552379 - DNA, 235 bp, Homo sapiens
gtccttcactcatttttctagagaactcctataagaaagcagaacacggccaggcatgatggctcatgcctgtaatcccagcacttcaggaggctgaggcaggcagatcacctgaggtcaggagttcaagaccagcctggccaacatggcgaaaccctatctctattaaaaatacaaaaaattagctgggcatgatggcgcgtgcctgtaatcccagctacttggggccgctcgg

SEQ ID NO: 552380 - DNA, 752 bp, Homo sapiens
  misc_feature (430)..(430): n is a, c, g, or t
aagcacggaatgtgaagcggggtgggggccactgaacgtcggtaagactctgctgcagaaacggctgcaggaggtgagctcccggcgtgggaaaggcgtcctgcgagagccgtctacgcctcggcccacgttatgcgatggacgcctatgacccgacccatttctctgtatcctgtgtgcagatcttaagtatactttatggacaacaacttgaaaacgcatgcgacgctgaaactcttcaataaaaccgaacctaccctgttacatagccacgcaggagatgaacagcttaattaagcttacagacatcattgcttgtggccatcacaacattaccaccggacaaattagcgaccgggaaggcactggcttatcaggggtgctagcctggctccaagccacccacagagccatcaattgacatgccggnagacgcacagctggactgaccttatggagaagaagcataggcgcggatagcgttgctggcagtaccacttctcaccaagagtgcattatccaaagtaaccctacatcatggggaagtgtgataaacgcattaagggcgaactgccgcctttggacacagaccctacataaggtctctggaaaaagggggcccaaggcctaaaatggtagcctaacctggaccccattatagttagggccggaggctgttacctgggggaagagtgggaataagctaccaccggggaaagctgcttcagtagagaaactttcctctcagggga

SEQ ID NO: 552381 - DNA, 1228 bp, Homo sapiens
agcggggcggagccccggcggggcgttggtttcggttggccctgactgggattagtgttgacgatcgaaatgggagtccccaagttttacagatggatctcagagcggtatccctgtctcagcgaagtggtgaaagagcatcagattcctgaatttgacaacttgtacctggatatgaatggaattatacatcagtgctcccatcctaatgatgatgatgttcactttagaatttcagatgataaaatctttactgatatttttcactacctggaggtgttgtttcgcattattaaacccaggaaagtgttctttatggctgtagatggtgtggctcctcgagcaaaaatgaaccagcagcgtgggaggcgttttaggtcagcaaaggaggcagaagacaaaattaaaaaggcaatagagaagggagaaactcttcctacagaggccagatttgattccaactgtatcacaccaggaactgaatttatggccaggttacatgaacatctgaagtattttgtaaatatgaaaatttccacagacaagtcatggcaaggagttaccatctacttctcaggccatgagactcctggagaaggagagcataaaatcatggaatttatcagatccgagaaagcaaagccagatcatgatccaaacaccagacactgtctttatggtttagatgctgacttgattatgcttggattaacaagtcatgaggcacatttttctctcttaagagaagaagttcgatttggtggcaaaaaaacacaacgggtatgtgctccagaagaaactacatttcaccttctacacttgtctttaatgagagagtatattgactatgagttttcagtattaaaagaaaagatcacatttaaatatgatattgaaaggataatagatgattggatttgatggggtttcttgttggtaatgattttatccctcatctacctcatttacatattaatcatgatgcactgcctcttctttatggaacatatgttaccatcctgccagaacttgggggttatattaatgaaagtgggcacctcaacttacctcgatttgagaaataccttgtgaaactatcagattttgatcgggagcacttcagtgaagtttttgtggacctaaaatggtttgaaagcaaagttggtaacaagtacctcaatgaagcagcaggtgtcgcagcagaagaagccaggaactacaaaaaaaa

SEQ ID NO: 552382 - DNA, 922 bp, Homo sapiens
agcgggagtcatatgaagacacttagcttcagggaagcctgagaactttctaacctacctggtgtcagaaggtcagcaaaggaggcagaagacaaaattaaaaaggcaatagagaagggagaaactcttcctacagaggccagatttgattccaactgtatcacaccaggaactgaatttatggccaggttacatgaacatctgaagtattttgtaaatatgaaaatttccacagacaagtcatggcaaggagttaccatctacttctcaggccatgagactcctggagaaggagagcataaaatcatggaatttatcagatccgagaaagcaaagccagatcatgatccaaacaccagacactgtctttatggtttagatgctgacttgattatgcttggattaacaagtcatgaggcacatttttctctcttaagagaagaagttcgatttggtggcaaaaaaacacaacgggtatgtgctccagaagaaactacatttcaccttctacacttgtctttaatgagagagtatattgactatgagttttcagtattaaaagaaaagatcacatttaaatatgatattgaaaggataatagatgattggatttgatggggtttcttgttggtaatgattttatccctcatctacctcatttacatattaatcatgatgcactgcctcttctttatggaacatatgttaccatcctgccagaacttgggggttatattaatgaaagtgggcacctcaacttacctcgatttgagaaataccttgtgaaactatcagattttgatcgggagcacttcagtgaagtttttgtggacctaaaatggtttgaaagcaaagttggtaacaagtacctcaatgaagcagcaggtgtcgcagcagaagaagccaggaactacaaaaaaaa

SEQ ID NO: 552383 - DNA, 153 bp, Homo sapiens
tgttcacctcggtcagtctgtgcctggtgcttgtacttctgtgtctccctggtcccaactactcctggcccctacctgctccaccacacggcgtgtggacctgcaatactctggtggtggcctttttttgtattgtctatttcataatcttgc

SEQ ID NO: 552384 - DNA, 344 bp, Homo sapiens
agcggggcggagccccggcggggcgttggtttcggttggccctgactgggattagtgttgacgatcgaaatgggagtccccaagttttacagatggatctcagagcggtatccctgtctcagcgaagtggtgaaagagcatcagtggtgagcgaggggcaacgctcagaaagccgagacccggggctccgcgggccctctccaccttagaagcttgggggctttttcgagccaacctctttttccccctcgtcgtcttggaacgaatttaattgggcaatttaagggaaagggggggaaccggaaaaaggttttttaaggaacgccccccgggttttccccggg

SEQ ID NO: 552385 - DNA, 1678 bp, Homo sapiens
  misc_feature (1)..(1): n is a, c, g, or t
natcaactacgaagtggggatgagtacaccacgtcgtacgggttgcgagcatagttgctcgcgcggctcacacacgaaggggatggttcagagagtatgctgtggcgtgccgcagaccacagaaggatcgcccgagtgttgtaagaaagccgtctctgctaagggcggcgccgtcgcatctggcctcccccctcaaatggggagcacgtggtccccccaggggaacaaaggggcaatcaggttagtgttcgtcaaagaaggggggtaacttcccctccccccagcattggggacgaggtcccccttccacgcgctcccgcgggctccacgaaacagtctgaagagggtcgttcgtgagagaatagcccacaagacggagagaaggtgggggccaccaagtttgtggaagagacaccccgtcgtatgctttctcttcggggggagcgcgtagcagcaccagtgtgggggagaaaaatacacataggtggtgtgtgtactacccagcggggtgtttattgtaagcaaatgtcgcccgagatgagttttggtgcgtatgcacacgattaggtgtgtgtggtcttgtgggttgtctaacaaacagcgttattagtttgggttttagagcagccaccacggggaaccacgcgtagtcacatgtggttgtgcttttttttttgggggggggaaaaggggggcactatatagtgtcccctcttatattaaggaaatggttgtctccgcgcaaaagagcttggggcattttgtaaatatctggggggagggagaacaaacaacccccgctggtgccgcgcttgctgtctagattttttttggagagagaaacatttcccctcgttttggggggctctccccccgcggaaagagtaagagggtatatgttccccccggagacttgtggagacacacacacacgggggcccacccactctggggaccacaaaagcccctctgtgtggggtattaagagaaaaaccacaaaaatttgttgttttttaaatggtccctcgcttttgttccccccttgtccaattcgttttcacagccacatatagagactttatacctctcccttatggccccacgaacacatttctgtgttgagagagaccctgagcccctctatggtcactttggggttaaccacgcgggtgtttcacaggcacaattttggggacattttctcacgcgggagatgtcccccttgagagagatggcacacctcgtgtcacaaaagagagcacgctgggtgttcacatttgctatagagtttgtgggatattctgtcacagagtataatattctcggccacacttttcacatgttcacactgttcctcgagaaagttcacagggtgcgggctttgtggagaaaagttggtgtaaacacacacacaggctaaaagtggagaaagtgcacaccctccacactttataactttgtccccgtgttcacgaggcactcacgatgagagactttcacttgggtgtttattaagtgggctttttgagattttgggtgagtgccctctgaagaagggagtttgtaaaattgttggtatactggtaacgagttgtctgccccagtcctgcctggaataccctgattgtttatgggaagtatctttaatataaagctggagaacccatttggcgttggg

SEQ ID NO: 552386 - DNA, 549 bp, Homo sapiens
  misc_feature (517)..(517): n is a, c, g, or t
atgcccggctaattttttgtatttttagtagagacggggtatcaccgtgttagccaggatggtctcgatctcctgaccttgtgatccgcccgcttcggcctcccaaagtgctgggattacaggcatgagccaccgcgcccggcccaggtgcatcctcttaaacagctcctacctaggagacgaggttttgccatgttgccaggctggtctccaacttctgggatcaagcaatccttccgcttgagcctccaaagtgctgtgattgcaggcgtgagccaccgcgcctagtttaggttgagcagcgaaagggatagggcccagtgctttctctgcgaggttcagttggcctgtccctgtcctatcaccgtttgtcaccgtttggggagcgccacggaatgccctgtctccaatcgagaggtgcactcgtcgccctggcaacggagtccggaagaaccacagagacgcggctccagcgtacagagcggccgccctgggccagcaaggcaccgagcgctanagaggcacgtctagtcgattgtcacgtggcag

SEQ ID NO: 552387 - DNA, 985 bp, Homo sapiens
gactatgcgtgtcattcacgtagccctcggaaaaagctggccctcacaccctagcctgggcgacaagagcgaagctccgtctcaaaaaaaaaagaaaaagaaacaaaacaaaaaacttcccaaggacccaagggacccattttcctctctatctgcctaaaataatttcttaataactcctacaacattcccccctgtggagatgccacactaactggctgttagggagtttggggcgacgactccttctggctacttcttgttgcaaaagggcgtcgaatggggaagagcagctagggctcctcctggggtcaatctaagggtcctcagaagaatgatgtgtctatgtgtggttctgtttacagcaccattgggagttcggatggcttctagatgagaagaaacaattcggagtcatagtatggtgtatacagggtccaaatatcaatacaagacacataagcaagagagggcttaataaaggggttaaccaattccataacagaagactggaatttattacaagaggcattgtagccactcggggatcactaattggatatgatttctaaagtactggtagatcttcttttaactagaggcattaatccgaaagcagcatgtcctcattggacaactgcatcactaaaaacccaatacaacagtcccaagctggaacaacacaccagacaacacaacaacacaaacatgtgtcggacggacagagcgccccaaagaaaaagtacgaagcaacaaccgcagggggcacccgggcaccccaagacagggaaggccacaacacgggcgccacagaaaggacacacgcagagacaacaccgggctgacacaaaacaggcaaggacactcagccgacaacaacaaaccgcgggggcacaacgagacgctagataaaacaacacagcagagacgagagacaaatagcgggatcaacaagaagaagtcaagcaaaccgagataaatgcga

SEQ ID NO: 552388 - DNA, 571 bp, Homo sapiens
gaggacgaagcagtagaagactcagaaagtggggtttacatgcgattcatgaggtcacacaagggttatgacatcgttccaaccagttcaaagctggtgggctttgatactacattacaagttaaaaaggccttctttgctttggtagccaacggagtccgagcagcgccactgtgggagagtaaaaaacaaagttttgtaggaatgctaacaattacaaaattcaaaaaaaatactacatagaaactataaatcacctatgggacagatttatgaattagaggaacataaaattgaaacatggagggagctttatttacaagaaaacatttaagcctttagggaaaatatctccagatgcaagcctcttcgaagctgaaaactcccggaacaaaaaaaaaatccacagattgcccggtatggaccccaacagtggggaaggcactttatatacttaacccacaaaaagaatcctcaaggtcctcccaggttttatagactggaaatgccaaaaccctgccttcatgaaagcaaaaaccgggtagaaccttgggaatagggacctaaccca

SEQ ID NO: 552389 - DNA, 467 bp, Homo sapiens
  misc_feature (41)..(41): n is a, c, g, or t
  misc_feature (160)..(160): n is a, c, g, or t
  misc_feature (381)..(382): n is a, c, g, or t
caaggctaatatccattagttatagccggtatatttcaccntacactaaatatggggcattttaaaagaagattccccccttcccccccggaaatctgcatttactaaatttgtcttaagtccagttgtgtttaaaggtcatgctggtcgggtgtgggtngcacgcctataatcccagcactttgggaggccaaggtgggcagtcacctgaggtcaggagtttcagaccagcctggccaacatggtgaaaccccgtctctactaaaaatacaaaaattagcttggcatggtggcgggtacctgtaatcccagctgcttgggagtgtgaggcaggagaatcgcttgaacctgggagaccgagtttgcagtgagctgaaaacnngccattgcactccagcttaggcaacaagagtgaaactctgtctcaatcaatccatcaatcaatcaataaaatagaggtcatgctg

SEQ ID NO: 552390 - DNA, 273 bp, Homo sapiens
ccgagtctaaaaatagccgacgtttgtgacctagtgttatataatatttattactccttttcggagtttacctgaaactgattgacttggcagtcaattgtactaccttaatactaaaagagtaggatcctcatcactagacttgatacgtaaaggcatagtcaaactacatctacgaagtgtcagtatcaggctgcggcttcaaatgccgaagtggtgtttggctgtgacagtggaattttacgttgtcgtagtaaggcatacttgctagga

SEQ ID NO: 552391 - DNA, 1012 bp, Homo sapiens
gggccgaggtgtggacacgcagatgggcctgtctcagtggtctggtgtacatgagagaagggggcctgagtgcagagccagttggtggcagtgcatgagagaagaggaggagtgaggaggaggaggaggctgagtgctggagaggagtgctgtcccgaggaagaaggccccatgtagtgctgaacccccagccgagccttgtgctacgaggagatccggaacggcgagagtcggtcggaggcctctggctgtgtggatggagctgggaagcctggggctgagggaggctcaggagccctgacgggaatgggagaacaggagcactcccagcagaaagaggaggagttgaggagatggcagtggtcccctggaaaggcctcttccgaggtgggaaagagcggacgaagctggctgcacaggacggacggagcgtgctctccaatggaagtgggagagaccctccaacagctggtacgccaagataggaccaagctggccagagggaagcttgacgtgaatgacaatgcggccatgaaggagcagtgaagacgagcgcggatagacaatgcgcgggacatgtacccactgaaggtctaactatcgggcggccccggagacctaggagctaggaggggccctggggccgcaaatgaagacgaagtggctgagaggggccaatacattccccggtgaaggagcagggcaattgtaacagcgaggctgcccatccaggttccgagaggaaccaccgacggacagaaagaagcagagggagggcaggcccgagcacaccagaaggaccagaggaccaagaacagcagagctgtgggcagttgacgcacactcgagaaggggaccacaagtggaggacacggacggtccaagaaacggtggagcggtagcccaggagacgtagggccctgttcaaaggacatagaaggtcagccgatgaccaggacgaccgcagagagcccacacgccagaaggaaagaggcaacggaagacaacagac

SEQ ID NO: 552392 - DNA, 546 bp, Homo sapiens
  misc_feature (240)..(240): n is a, c, g, or t
  misc_feature (305)..(306): n is a, c, g, or t
  misc_feature (314)..(315): n is a, c, g, or t
  misc_feature (319)..(319): n is a, c, g, or t
  misc_feature (329)..(329): n is a, c, g, or t
  misc_feature (331)..(332): n is a, c, g, or t
  misc_feature (336)..(337): n is a, c, g, or t
  misc_feature (342)..(342): n is a, c, g, or t
  misc_feature (344)..(344): n is a, c, g, or t
  misc_feature (352)..(352): n is a, c, g, or t
  misc_feature (357)..(357): n is a, c, g, or t
  misc_feature (367)..(367): n is a, c, g, or t
  misc_feature (372)..(373): n is a, c, g, or t
  misc_feature (375)..(376): n is a, c, g, or t
  misc_feature (399)..(399): n is a, c, g, or t
  misc_feature (403)..(403): n is a, c, g, or t
  misc_feature (407)..(408): n is a, c, g, or t
  misc_feature (427)..(427): n is a, c, g, or t
  misc_feature (440)..(441): n is a, c, g, or t
  misc_feature (448)..(448): n is a, c, g, or t
  misc_feature (457)..(457): n is a, c, g, or t
  misc_feature (471)..(472): n is a, c, g, or t
  misc_feature (478)..(479): n is a, c, g, or t
  misc_feature (482)..(483): n is a, c, g, or t
  misc_feature (495)..(496): n is a, c, g, or t
  misc_feature (501)..(502): n is a, c, g, or t
  misc_feature (504)..(504): n is a, c, g, or t
  misc_feature (508)..(508): n is a, c, g, or t
  misc_feature (525)..(525): n is a, c, g, or t
  misc_feature (534)..(534): n is a, c, g, or t
atggaaatgaggaaagaataatattaactgatttcaaaagaggacttgaagatgtgaatcatctattttgctgaagaaatcttaactctttgaaattactttttattgctgtgtcatactcttaggtgccaaactgcggtaaattttttatcagtgaagtggaagcatgtgtttcgttttggaaatttttatcaagtatcttcagagaagattatttcctgctttatcttcagaaactgnaaagggtcaaagaaaagacagtagctggccggtcgtggtggctcatgcctgtaatcccaacactnngggaggcnnaggngggcagaccntnnggtnnggagntngagaccancctgnccaacatggngaaanncnntctctactaaaaatacaaaaatnagcngggnntggtggcacgtgcctgtantcccagctactcnngaggctnaggcagganaatcgcttgaaccnnggaggnngannttgcagtgagcnnagatnncnccantgcactccagctgggcnacaagcganactccatctcgg

SEQ ID NO: 552393 - DNA, 314 bp, Homo sapiens
ggctacgtgcccacctcttacctccgagtcacactcaactgaaccccaccagagggggacgaggggcaggctgtcagctgctgcttctgggccacagggggggcccccaggaccttgcactttattcctgcccacgtggcttttggctgagacctgtgtaacctgctgtccctcactcacctgtcacctgtcaccctacggggacccacttgtggcttcccacgtggttgtacatatttgtcatttaagatctttcttcccgccgcttggcttgagccaagtttgttttatattaaaaaagtatatataattat

SEQ ID NO: 552394 - DNA, 156 bp, Homo sapiens
  misc_feature (94)..(94): n is a, c, g, or t
ggatatcccgaccgaggatgtggaggtattttgatgttggactgcataatttcttaatcaggtatgtgtacattccagtgggacgggtcccagncatggcctgctggtggacacgtgttttccacgtgcgatgacatttgcatttcgtgagctact

SEQ ID NO: 552395 - DNA, 344 bp, Homo sapiens
ccggagattccggacattggccatctcggcgacggtggctttcagtctcgcatggtcgaccgtcaatccgagcgaagcggcctgcgcaaccgaacggctttggcttcatcacgacgttagcatcgatctcgaccagagctcccttagacacattagccatcgaccggaatagcgtgctggccggcggctccccgggaaaagattttgaggcaggcgtgtcgtgtacgtcgcgcatcgaggcaccatcaatcgccgacacgtagacccggaaaacgaacgatatctgtgaactgaccgctttcgtgctcgatgatcttcttgatgttcgcgatggcggtcggcgt

SEQ ID NO: 552396 - DNA, 102 bp, Homo sapiens
atcctgttgtgacgctgttaggatccagggcgtacaggactcaggaagcagataggaaaatgattatagggcgtgatcattaaaggtgataagctcttctat

SEQ ID NO: 552397 - DNA, 809 bp, Homo sapiens
tcgattcatgttggttatggtcggtcatcttgtgccttgcttctgttgtctgttcatttttccttagatgttgcattttatcctgtgtcttcatcggtgtgtgcctcaattgtctttatccctgtcctctgcctctggggtctcttctgcgtctccatctcctctttcatgattgttcgcttctccgtgtatgatttcttcctgtgtttggttgttctttttgtgcgtgtgacctccgtgtaccacgtgcctttgggttactgtgtcccccagcatgctaccagctcttcacagtgtcccttcctttccctaccttctcgtacgattttctatgaagatgttgattctcatcaaacatgtctatgtagtctattgcgctagtgtaactcttggagtacgcgtgtcttcctggggactatctattatggaactcgctgttctcataggtattgagcctgtgacgctgcttgtatcgtggctctctttagacagattgtatatctccatctggaaagccatctcaaccatgttgtgcacttgtccgtctgttactcatttgtcttatcaggcggctattggcagacgggtctaaatttagtggcttcagctgtaggtaagtagatataggcatagagctagattttgcttcatgtgatcttttccaagcttcaactctaacttaactacatttctctgtatgatgatgtctcttactttgctacaggttcctcgagcaccaaagatgattcataactctgtataggtgtcagctgcttatcttagcatcttagcattaccagccgggtaaa

SEQ ID NO: 552398 - DNA, 144 bp, Homo sapiens
attagatttggtattatacttgtaggtttgtttctgtgtgaaattgtattcgaatggggagggaggtgcatgggtaatcagtgcttttgaaggtgaatttccttgctgtgaaataggcttgggttactggtcaggacaaccatt

SEQ ID NO: 552399 - DNA, 150 bp, Homo sapiens
  misc_feature (109)..(110): n is a, c, g, or t
tcctaggatggaactaatcttctaaataagaatacgctctaagatgttttacagctaaaagctccatcaagactttttcacaacgtgttagtggaaccaaaaaaaccanntaactgcattccaggtgctgtaataaatgcttaccactgc

SEQ ID NO: 552400 - DNA, 184 bp, Homo sapiens
tcattgtgacagagacacacatggggaacgaagtcactgtgaagacgaggcgagattagagtaatgagctacaaggcaaaagacactagaggcaccagaatctttaagaggtaagtaagcacttctcctgttaagccttcagagggaatgtagtctttccaacaccttgtatttcgcggcgggg

SEQ ID NO: 552401 - DNA, 808 bp, Homo sapiens
  misc_feature (559)..(559): n is a, c, g, or t
gtgtgacgtggatgtgagacatggagtcaaaggagatcatttcggagatttaagatttaaatgccctgctggattttggacttggatggggcctgtagcctctttgttttgaccaatttctaccattcagaacagctgtatttacccaatgcctttacctccattgtagcttagaagtaactaacttgcttttggttttacaggcttataagcagaagggacttgccttgtctcagatgagacattggactgtggacctttgtgttaatgctgaaatgagctaagactttgggggactgttgggaaggcaagattggttttgaaatgtgaggacattagatttgggaatggccaggggcagaatgatatggtttgactatgtccccatccatatctcatcttgaattcccatcggttatgggagggacccagtgggaggtaattgaatcatgggtgcaggtcttttccatgctgttctcgagttagggaataagtcttacgagatctgatggttacaaaaaggggagcttccctgcacaagcattcctctctttgcctngcacatacataagatgtgactttgtcctccttgccctctggcatgattgtgaggcttcccagccatgtagaattgtaagtccagttaaaccttctttcttttgtaaatttgccagtctgtgggtatggtctttatcatcaggcatgaaaacagattatacagtgtgacctcctaagctaactaatttacaaatcctaagaatgctaaccagtaatacttggtgctaaaaatatgttaattacttatgag

SEQ ID NO: 552402 - DNA, 106 bp, Homo sapiens
ttgggcacgaaatctgattaccgtcttctctagctcggattagcaattatacatgctattcaaagtcatatgagaagtaagaccatttccttgggcaggtatctcg

SEQ ID NO: 552403 - DNA, 574 bp, Homo sapiens
  misc_feature (555)..(555): n is a, c, g, or t
  misc_feature (568)..(569): n is a, c, g, or t
ggggggttgtgtgtgtttttttttttttcttcgggggaaaaggggagaggggtgcctcccaaaatatatttttgttgggggcgggcttttctttttttccccccttttttttttaaacccccccgccggtttttatattcccccccccccccgggggagggggggggggggggccccccccccccccttttttttttttttttttttttttttaaaaaaacaaaaaacatgtttttttttttttttttacaacacaatttttttttttccccccctttggtggttttttttttttttttaaccaaaaaaaacaaggggggtgttttttcccgggggggggcccctttttttaatttgttttataaaaaaggggggggggtggacccccttgtggggcgcaaaaaaattttttttttaaaaaaattttttggggggttctttttttccctttttttttgaaaaaaaaaaatatagaggcgctgtttggaaaccccaaaaggggatctggcccgggaaaaaaacaaccccccaaaccaagaaggcccacccaagtcnggaacgcagccanngccca

SEQ ID NO: 552404 - DNA, 150 bp, Homo sapiens
caacttcccagaatacccccaaggaggccaaccaggccattcaggtggccagcactgttcctcctggcttccacagctacattgctgaggcaacggacttgggaaggcgactcttcctactacctcaactctgcccagccttcactcttc

SEQ ID NO: 552405 - DNA, 616 bp, Homo sapiens
  misc_feature (442)..(442): n is a, c, g, or t
  misc_feature (536)..(536): n is a, c, g, or t
  misc_feature (549)..(549): n is a, c, g, or t
  misc_feature (587)..(587): n is a, c, g, or t
ggcatgtgcctgtagtcccagctacttgggaggctgaggtgaaggatcactttgagcccgggaggagtttcagtctgcagctgcactgagctatgaagctgccactacactccagcctgggcaacagaacaagaccctgtctcaagaaaataaacaaacaaaaaaacccgaaagaatagaaaaggcactttgggaggccaaggcgggtggatcacctgaggtcaggagttcgacaccagcctggccaacatggtgaaaccccatctctactaaaaatacaaaaaattagccgggcatggtggtgggcgcctgtaaccccagctactcaggaggctgaagcagaagaatcacttgaaccagggaggcagaggttgcagtgagccgagattgcactgctgcactccagcctggacaagagtgaaattccatcttaaaaaaacanacaagagaatatatctctgtaagaagaacagtgcagggggtgggagtgggacactgatttctacctatttagatataatccgtgcttaatgcangacctaatgaggntagtgaggcctgagcccacaagatccctctccaggaantcgcaagttaggtcgccaccctttgtggg

SEQ ID NO: 552406 - DNA, 350 bp, Homo sapiens
aacaatcatacaacaaactgtcaccaaaaaaaaaaacaacacaccccaggaagtaggtacaagttactctacgaaaaccgcctcaaccagcctcaacgattgtaaacacaaataagattgatctgcattagctacttcggaaaactccgtcaggtgacacgtgttacctcacaaccaacccccaaacccacaaccccaagaagaacaaccaaacaccaacacacacaacaaacaaaaagccagagaaggtgtgcgtaaccccccttgtaaaaaattattttggaattacaaagccacgacaacgaaccttcgcgtaagcctcgcaaagcgctgtgccccacaaatacaag

SEQ ID NO: 552407 - DNA, 1012 bp, Homo sapiens
gccaggaagctcagagtatcgaatcaaatctatgaatacgacaagaaacagtcagtcatagaaatcctggcggcgaagccgtgaactaaggatcaccattactttaagtactggcaaaatctcagcattggactctgctgcaagatggtgatgcatgccaggatcgggaggcaacttggaagtgatggctctgcattgctaggaaaatggtgtgatgagtgaaaaccgatgtatcgatatattgtgactagtatttgctttgccatagtgcgccagggcaacttgataatccggagctaagatgctcaagcgcgtgcgtgcacatcatgaattacatggcttcgctctcactattagcaatcatgctaataactagtgttgggtccagcctttgaagaatgcaaatcggggtgggttatcattagcactaccctgagcttatggggcttgcaaggcgattatccgtgggaattgaatgttaagctactcagtattgcttcaatcaatgcagtgtctctagggcaaccactttggtaagccagttgggtggattgattccaatatctaatgtgaaccaaatatccgggcagggaaatagctgaaactcttgggcggccatttaggtacaatacccaatagagggcgccatactaaaacgctttccttgaattggaagggacctatcttgaagatactccaggagctaatttccaactataaatttaaaagagctagaaaggaattcctggttgtcaccatctgggtaagaacgcacttattgtattggccctctacaaaggctcttcatttatttgtccaaaattccctaccttctggcgaattccggcgcgacattcggctttggactggctggtccgtggcacaatcacaacatagcgttggggttggagaatacctgttggagtttcttacttaagcgttggcgtttagcctaaagtggcgggaccaataaccaacttggtccgcggtctcctggagttgggccccggaa

SEQ ID NO: 552408 - DNA, 149 bp, Homo sapiens
atgggctggtgccacatttagttgctgggcagtttcttgggggcacataagggttggcttgctctggggaaggaattcatgaactcctcaagggtctctccgagccagagctcaagaaaggcccaggcagaagccaaacagggagggat

SEQ ID NO: 552409 - DNA, 390 bp, Homo sapiens
  misc_feature (372)..(372): n is a, c, g, or t
ggaattctgatgcagactttccaaaattaatgaaaaatttgtacagtttaaacaacagctgaaagaactaaagaagcaatgtaagtcaacatgctttgctttggttcggctttttgaaattagggaactgacttgatgaacagccccagttaactgattttataaagtttgcttatctgcttggcttgatcctcattctaagttgcgttttattgttgttgcaattctgtattttgtctaatttttggttcaaatcagcctgctcatttctgaaagccaacagtttccacaaagtgctcagaaaatttcccagcagctagttatgtgtattgtcacattgctggggagggaaattgggaaaacaaaataaangtgaaaactattttattt

SEQ ID NO: 552410 - DNA, 362 bp, Homo sapiens
tgtcgtccttctgcgccgagcaccaactccatgtacaggcactatagcttccatgttgaaagacacagtgcttgctctctaggaacgtggatccagtggaactatatgggggcaagtgtgtgtgtagccatggagaggtaccagctatgtgggagcgtggaggaaagagggaggataactttaatcatgacacactgccaatattagaactcccttttggccaggcgcgatggctcacacctgtaatcccagcacgttgggaggctgaggagggcggaccacgaggtcaggagatggagaccatcctggctaacacggtgaaaccccgtctctactaaaaacacaaaaaaaactagccgggc

SEQ ID NO: 552411 - DNA, 180 bp, Homo sapiens
  misc_feature (89)..(89): n is a, c, g, or t
  misc_feature (97)..(97): n is a, c, g, or t
  misc_feature (104)..(106): n is a, c, g, or t
  misc_feature (111)..(111): n is a, c, g, or t
  misc_feature (113)..(113): n is a, c, g, or t
  misc_feature (120)..(120): n is a, c, g, or t
  misc_feature (124)..(124): n is a, c, g, or t
  misc_feature (129)..(129): n is a, c, g, or t
  misc_feature (131)..(133): n is a, c, g, or t
  misc_feature (135)..(136): n is a, c, g, or t
  misc_feature (140)..(140): n is a, c, g, or t
  misc_feature (145)..(145): n is a, c, g, or t
  misc_feature (148)..(149): n is a, c, g, or t
tcatctagagtactatattccaaccctatctcaaatgcaggaatgggctctatctggtatctagaggatgatcataggaaacaaaatgnggacagangcatctnnnatctncnaaaacgncganaaaangnnncnngcgnagcgnagnnacagaaaaagagccgcagcacaaaaaaagaa

SEQ ID NO: 552412 - DNA, 869 bp, Homo sapiens
ggaccttcagacgttgccctggcggatgccagagtacaggccctcgggtgtggaggtcttcggctgtcagtaagagcctgaggagagattctttctaatgatattgtgtaacacaccaacagtactgtgacctatggaaaggctgctagggtatgtcttcacacgacaaggcatatggctttggcgtggtcaagatagacctgataaaccaagtcttgtagtgcagtggacttttctacttctggtcatgcttacactgatacagggaagagcgtcaggcaacctatgaaaccaaatagtaacggtctgtaactatggagcttatccttgcacccagaatatgggacagagacaatactctagggacagaaatctcttgggagaataagttggctgaagggttgaaagtgactcttgataccatatttgtaccgaacacaggaaagaagagtgggaaattgaaggtctcctatagaccgggattgtttagtgttggcagtaatgttgatatagatttttctgggaccaacatctatggtggggtgtgtcggcttcgaagggtggttgctggtatcagatgagttttgacacagcaaatccaaatgtcacagaataatttcgcctgggttacaaggctgcggacttccaggtgcacacacatttgaacgatggcactgcattttggaggttctaatctaccagaaggtgacatgacaaagatttgaacatccataaacctttgtttgggacagctgggaggtaacaaaacccgttttgggcattggtggtaaaggtaacttggctggatttgtttgaatttttcttactggttaaaggtaattaattggcaggctgaattgggtttgtgt

SEQ ID NO: 552413 - DNA, 573 bp, Homo sapiens
  misc_feature (532)..(532): n is a, c, g, or t
gtaacacagtaccacaacctgggtagcttaaaacaactaatagttactgtcttacggttgtggaggctagaaatccaaaattaaggtgtcagcagggccatgctccctttgaaacctgtgggggaacatgcttcgttacctcttccagctttggtagtttgtcagcaatccttagtaagttcctggcttgcaggaatctctccctccaatctctgcctccgttttcacgcagccttctccccatgtgtctctgttcacatctccctcttatgaggacaatagtcacactggattagggcctaccctgagagactcatcttaacttgactacatcttcaaagaccctgtttctaaataagatcaccttcagaggtcttggggcataggacttccacatatcttttgggggaacacagttcaacccataacagtgagtgttggagaatggtgagcagaaaggcccaagagcatagtgtctttctatgatcggctcattttttttttttcagtgcaacctatattttagttattntgggaacttgaacttgtgcttaatcaaaagcaaccccaaca

SEQ ID NO: 552414 - DNA, 272 bp, Homo sapiens
gcctgtcgagcgactggctgcttttgagctgcttgcctcgggagggcagaagctgtccgaggacgagaacctgccttgaacgagtgcgggctgtgccctctgccctcctaccttctcgtggacatggctgtgctggaggacatcaaggccgcgtgggccgaggcatcggagccagcgctgtgtgcgggcacatccggggataccttggagacccttgaggagcgagagggcagcggcgtccatcccttcaaagcggactttgttggcggaac

SEQ ID NO: 552415 - DNA, 440 bp, Homo sapiens
ggaaaggacgctgtactgggtagttattggtcaaccaattcacttgtatattaccgtagacgaacaaggaaacgttactatgtgagtcatacggcatttgtacgagtaactggcactttagggatgcaaacgtgaaatacgacatgttacttcttgttgatgtgagagtggtgcaagaatgggattatgtatagtctcaggatataaactgggaacatatctaagagaaagtttggggaggtaggttggtaattttttcttttcttggcttaggtaaatgatggggtggcccagatgtagcagtgaacagttactgcaactatggacataatggcttctcagtgtgtgtaagagggagatgctcattggtaatgggatgtctttcttttaaaaagtcatacacaagtctgccaggtatgacacggtatgaagagtcatta

SEQ ID NO: 552416 - DNA, 246 bp, Homo sapiens
  misc_feature (14)..(14): n is a, c, g, or t
  misc_feature (86)..(87): n is a, c, g, or t
  misc_feature (225)..(225): n is a, c, g, or t
cacaatggcagcancgaggccaccctgccagcccagatgagcaccctgcatgtgtctccaccccccagcgctgacccagccagacnntcccgcggagcggacatgcagagtcgacctgggctccgaggtgtacaggatgctgcgggaccagccgagcccgtggcgcggacccaagcagtcaggctccttccgctacttgcagggcatgctagaggccggcgaggncggggattggcccgggctggc

SEQ ID NO: 552417 - DNA, 302 bp, Homo sapiens
cacgaggctcaccaacatctactgtctggtagcgatcggaggctcagacaacttctacagtgtgttcttgggcgagctctccgatatcatctccgtggtgcacgcgtctatcgccggctgccgcatcatccggtgcatgtgtgtggggaacaggcacgtgtctcctgggacccaacaataccaccggccaggagctgtaacacattcgacaaagtctcccagacacagtgcaaattaggcgggtggtggagcggctctcaaccttgggcaatgttaccacctgcactgactacgtgggcttg

SEQ ID NO: 552418 - DNA, 181 bp, Homo sapiens
gatgctactggcaaagcctccgatagctgggataaggtgctgcgacgcacccagctaatttgcagtagtagagataggggttcaccacttagcaggtggctcgaactcctgacttgttgatccaccctcctcggctcccacaagtgctaggatacagtgtgagaacccaacccgagccccc

SEQ ID NO: 552419 - DNA, 369 bp, Homo sapiens
  misc_feature (139)..(139): n is a, c, g, or t
  misc_feature (158)..(158): n is a, c, g, or t
tacccggggaaaccccccctttggggggggaaatcccccgagtccagtttggcactagtgacaaggactcagacttacgcctagtggtaggagacagcttgaaagcagagaaggagctaacatgcgatcgagattcgancgttgggcaaagggcgggncccacccaaagtttatccgccagatggaagttagctcagcgagactagggagctagcttcaccatgtgctaggcttggccccctttccctttgggccccttggggaaaagggcccccccaaaaccaaaaagtttccccgaaaaggcaaaaccccatggaattctgggcactgtgtcccggagcccagctcctcaggccagcgcctgtatcc

SEQ ID NO: 552420 - DNA, 288 bp, Homo sapiens
cccagccgggaagtacctttaattaaattttgggaaagttgaaaagtttttccagcttgaatttttgcaaaaaaaaaaaaaaaattttaccattctttccagtggttgggttctttaacaattgaactgtccagggggtgttttttcaaaaagttttgataaaaaggggaagggttagtaaatttagagatgacttcttttaagctgcatcctagcccaagggggggccggggcaatgttttgcaatccagtcatccaaaagctgttttttttcccccacccctgaaa

SEQ ID NO: 552421 - DNA, 1189 bp, Homo sapiens
  misc_feature (281)..(281): n is a, c, g, or t
  misc_feature (1027)..(1027): n is a, c, g, or t
gaatgcccaccatgaaggtgtggagaggagcctctttcccggggggacaaatatggggctctcacaatgaccaagaaaaggggcgctagtcacaaagagagttttctgtgcggggaagagccacttgctggggcgcccagccacaaagtatgcgcgccccccccaggggggagacaaacacggggcgtttcaaaaagactaccaggcgagggagatatccccggggaacccatcctcccgggccccataattattaggcccccccggcttaataccccccncgtttagttggggaatagtggccccaagagggggcttctacaaacagttgggcagagaacaaagattttgcttgtagatcttttattagagcataacagaaatttgggatttcgccccgctcttttctgggcgtaaaacatagagctcgtgtaaaaagaatgggccccccctaaaaaatttctttagaaaaggttttctgtgatagatccgcctcgcgcacacatggtgtagataatggggttctcctgggcacaagcccacacacagttgtcgtttgaggagagcgttttctcacagaaccatatccaccccctctttgtggtctcgcgcttttgtccgttttctgggaatatatgaagaccacagaccacagttgtcgcggtgtgcggtgttcacatcacacaaccacgcgtgtgacacacaagaaaagggcttctctctgtagagcctgtgacacaaggggtctccccacagatcttgtcccacgcaaataggcttcacagagagagggcttcaaatggactaattatatccccaaatatcctcggcccaccccaccttcttaatatccacggtgggtgtgaagaaaaccgcgctctctcacggaaacttgtcgtttgtgtttcacacagtggcccaatcttaagagtttataggtatggtataaaggactggttatatagataaacacactaggcacttcgttaaaccctcttcacgaaagagaaagagagaataagttttngtgggaccacctcttggtgttttcttttttggcgctgtggccacgcttttaagattattagattttttaaaaccacgatacattttttatgggacaccacttgtggccccaaaaattgttcaccagaattttgggaccccctttaaaaacatttaatgggga

SEQ ID NO: 552422 - DNA, 881 bp, Homo sapiens
ggctgaggcaggtggatcacctgaggtcaggagttcgagaccagcctggccaacatggtgaaacccccatctctactaaaaatacaaaaattagctgggcatggtggtgggcgcctgtaatccctcgctactctggaggctgaggcaggagaatcgcttgaactcaggagatggaggtttcagtgagccaagatcacaccactgcactccagcctggcaacagagcgagactccatctcaaaaaaaaaaaggtaagaaagaaagggactcccttagaatggggaaagaaaattcataaaatattgagctgatgcctgtatttagaaattaagcgtttctcgaaagcggtctatgtctggcggtaatttaagcctttattctcttcctttaggtggagaaacaaagtaccactttggaagggatttgcaaatttggccttaggggatccggtcagtagaaattaaccatttgtgctaaccaaatttctggtgaagaatgtttccagtggttactccatcatatctaagtattaacttcccccaatagttatgacagagtaccctgaattggccactattggtggcacataggataagtggtaatggtgaacaccactactttcacgggaaattcttacaggttttacctttaaaaagatcactatgacgtggcacctgtgccatttaccctcctaataaccgcttgtccatgtgggtttggcagaacgagattgggttatagttaggcttcaaaaggaaacatatttcaacgggggggtcaagtgggtgtaacagttaaccatagaattccgggaatagaggggacaacgggtggacctttatacttttatatgtggaccgccagatttggtatataaccca

SEQ ID NO: 552423 - DNA, 1078 bp, Homo sapiens
ccatgtccgtccgaattcctcttaaaggttttcggttacttgggataattcctgggcttgccccccaacaaatcccgccctgggtccctggagttccaccggattaccctctttattgaggaagactctccgggtacacccgtgcccggggaaagcctccccggaactaatgtagttcgagaaccccccatggtctcgggaatttggaaaatgtcccagcttatagaccctttggacctttccccttaaattcttggccccccttgaacccctccccctcggggatatggggaataggaacccacagattccgaccccccccgggcgccaaataggcgccatgcgtgtgggcccgctgaactcatgcaggctttccgcgcaagcccacacaaccataaggtggtttgggtggagagaccctcgaggaggataagctaaaaagattttccgcaagttggaccactcactatggaggaaacccccacacgtataatgggaatttgtcccccaccaccacacctgattataaggtctctctcgttaccacgcctctctgagccccaccccgcaaaattcttgtagatgcccctcacctgacactctggaaagaagtctacccctcggacacacctggaaccccattgctgcccacaggttttcttggggaaattgtctccactggtgtttgcccccggggaataaagctgcaccctctgttgtgggattgtttctgcaccctcatggataattctcttggattcacgagacccctgatatgttgagcccccagtggcctcggatgaggtttccccaaacctcgaaggctttgcatgtggccctgtttgagggctcttggaagaaaattccctgcctgacttaccacgtgctggatgccgtgttctggcacaagatggcccatgccaccaccagatggccccactggggccacacagcctgtatgctgagcccggaggcagacttgccgagcttgttttgtttcatcctgtccctaaaggggtcagcgctcttgctttgctcttttccatgaatagcacttatgtaaaacaagaaaaaaata

SEQ ID NO: 552424 - DNA, 169 bp, Homo sapiens
gttcggtaccatgatcgtcaccgctccggccaggtggaggaagaggacgtgctcctcagagcagccggagggaggggggaggtcggaggtcgtggaggtggtttgtgtatcttagcggtctgaagggaccaagtgtgtttgtgttgttgtgtatcttgtttttctgatc

SEQ ID NO: 552425 - DNA, 162 bp, Homo sapiens
tagactctggatctaatgcttgtcagtctcttcaaactgcattttctgccttttaagtatgctttgtaattttctgttgataggtagacatgatacactgggtaaaaggaattgcagtaaacagggctttcatcctgttttcaggtgttggggataacatca

SEQ ID NO: 552426 - DNA, 174 bp, Homo sapiens
ctggcgcgtactgctcgatgaagccctgcaccatctgcccggcatcgtcgggcgtgaacagggcataggctggccaggtggtgcggaaggtatcccagaagccgttgttgacgaacaccttgccatcgcgcacgccggtgaagctgcggcgggcactgccgtcggtgttgtcat

SEQ ID NO: 552427 - DNA, 116 bp, Homo sapiens
ggtactctatcgcgcctctccattaaacccattaacatgcaggctcctcatatgcttcacaatggtgctttacagattctccagcaccagcagcagagcattacgtgggggtaccg

SEQ ID NO: 552428 - DNA, 273 bp, Homo sapiens
ctccctggttcaaatgattctcctgtctcagtctcctcagaagctgtgattacaggcacacaccatcatgcccagctaatttttgtatttttagtagagatggggtttcaccattggccaggatggtcttgatcttttgaccttgtgatccacctgctccagcctcccaaaatgctgcaattacaggtgtgagccaccacacccagccttgttttcatcttttaaaacaatgctatgggaagacttccttgattctgcagatcttgtcgacgc

SEQ ID NO: 552429 - DNA, 477 bp, Homo sapiens
  misc_feature (417)..(417): n is a, c, g, or t
  misc_feature (437)..(437): n is a, c, g, or t
cgggatatttgctgggtctggtatttctgtttttaagtctttgaggaatcaccatgctgtcttccacaatggtcgaactaatttatattcccaccaacagtgtttaagtatttctttttctctacaacttctccagggtctgttatttttttactttttagtagtagccattctaactagtatgagatgtatttcactgtggttttgatttgcatttctctaatgattagtgatgttgagttttttttcatatgattgttggccacatgtatgtcttctttaggtgtctgctcatgcctctgcccactttttactggcgttcttttttcttataacttcaagttccttcttgatgctggatagtagaccttttcagatgcatagtttgccagtattttctcccattctggaggttgnctggttactctggtgacagnttcttttccttggggctatatttttgggaactctttactg

SEQ ID NO: 552430 - DNA, 103 bp, Homo sapiens
gttttttcttatagctgctgcttttgtgtcatcacttaagtcactgtaaggttacttcctacctttgtctatttctatttctattgggagactagacctgaga

SEQ ID NO: 552431 - DNA, 1455 bp, Homo sapiens
gtcctttccggcggtgacgacctacgcacacgagaacatgcctctcgcaccaggatctccttcatccctactaccagaagaggagaatgaggacacacaagaagaaacgcctggtgcagagccccaattcctacttcatggactgtgaaatgcccaggatgctataaaatcaccacggcacacaagacacaatgccacaaacggcagcataaagactgatgatcggcatgcatccacactgacactactgaccagccatacaagggaggcaaaacgcacggacacaacaagaacgcgatgtaccccttcagccgacggcacccgcaaggccacccaaaccagcaacaccccgcagcccacgcaaagacgccagccgcacaacccaagtctccaactcaacccagcaccaccacggcgcatccacacaacacaaaaacacaagacacaccacgaccacgaccacacacacgacacgcactgcagcacagaaccgtgcgccccccacactaccagaaccgcaccgcacaactcagaccacaccgcacacagaaagcacacccccgcggcacccacccgaaaccacacaccgacaaccacaagaagagaaacagaccgccgagaccaccacgcacgcgccaacaaaaaccagagcaacagcaaacacaaaaacaaggaggaagaaaacaacaaagcaaccaccaagacaccaacaacgcaagcgcgccacggagaagaacgaacccacacacagaagacgaaacacgaccgccacaaccacaaaacaagcacagacgaaggcaacgacacagccacaccaacaaccgacacacaacgaaaacaagaagagcacgcaccaccaggagagccatagacagcaacaagcaaacaacaacaacgcaaacgccgccgcaacccgaggaacgacagcaagaaagagaacagaaagaaaaacaaacaaaacacaaacagaacaccaacaaaaaacacacaacacacagccaaccacacacaaccaaaaacaacaagacggacaacgacaaagacacgaacagcacaaagacacaagacaacacaaccgaccaacgacagacacacgcacacgaccacaacagcgagcgacacagcgaacaagaataacacaagagcacaagaggacgcggaaaggacgcaggagcaaggaggccaccaacagtacgcaacacgcacatccacccagcactgccgcagacacaggggcacaacgcaagctcaacacaagagagacggcgacataaagcccaaggacagatagcaccgcgccacccagcacaatgaagaggaagaacgacaaccgaaaggaaaagcagagaggaacaggaacagacaccaacacggccgaaccagggaagaggcgaaggagcaacaaccgagagcaggaaaagcggaacagacaccacagaagcacaaaaggaagcc

SEQ ID NO: 552432 - DNA, 146 bp, Homo sapiens
tggacagcacagaggaggtggacagcacagaggaggtggacagcacagaggaggtggacagcacagaggaggtggacaggacagaggagggcactggcccccaacaggcatcaccccgctaaatcccctagaagtcccactcctcc

SEQ ID NO: 552433 - DNA, 132 bp, Homo sapiens
gtgctgttcgctctaggctgtcagcgtactactgacagcgtagtattactcagcgtctcactggcgatatcttacactgccacgcttatccaaagtagcgcgcacagttccccgcttgatctggcagctgtt

SEQ ID NO: 552434 - DNA, 1947 bp, Homo sapiens
  misc_feature (194)..(194): n is a, c, g, or t
  misc_feature (354)..(354): n is a, c, g, or t
  misc_feature (846)..(846): n is a, c, g, or t
  misc_feature (1031)..(1031): n is a, c, g, or t
gtgtccataggaatggagttccgagttgaggagcgtgagaggtacgactggggaggagaattaaagaactgctaggcattactgggaacgcacgacgcgggtcatgggacaggcgagttgcgtgtactgactcgatctaacctgtgtgcttatcgtagcgtaggtcgatggcgacagaggtcgatcaatggcgngcgatctcaacgagcaaattcacccaaagcagaggcaagatctctctcgcaccaagcaactgctggatagcatgtgactataccggaagacagtgtggacagagacctcatctgacgctccatagtccaggaacgatgcgacgacctaggaattgactanctatgagagacatcaaatgcttgttcgactcgctagatattcgtatcacacgcaggcaccagagttgttgcacactaaggggagagccgagggggacaggagatacaggcctttgggttcccccctacgataccctcaattggggacgactacgacagggttgtcctaaattgtggcaaggaacgcaatggcagacggggagaggtgtcccagaacaaattctaatttgggttgccgaaacgaacaataggcaatattatttgtgcaaactcacttctggaccccccaagcccaagggaaataaaattcgataatccatgggatccaatacaccaacttggggcaccgtagaacacacaaacacatttggggggcacaaccggggggaaaaatcctacaggcgcccccaaccgcaatatcaggggtgtgaaacagctcgaataggcggccggatacgggggagcaccgaccatcccgggatatgagaagacntgcattaccagaacccccctgtggctgcacacgcaccccagtgggtctccaaaaggtacaccacaccgtaacccgagttggtacgcgcgcaaaaggggccatatcttctggttcctactcggcaggacatatccgagtaggattacccatctatttcggattagtgtgtaggaaatcgaagaagnaggccattcgcatcggccggctattctcaccaccgtgcacattggggagtctccaccagtccccagctctccgaaaaggggatccgcgcagatgcggccattggcaaccacttgggtgtggccaccagatagattgttcgggtgggaccagtattcgaaggaagcacccccaccccttacaagccatgccgacggctccgtggcggaggtcacccccttcccctcgaacgcctatacccaaaagaccggagcccccccccaggcgacacagagctagacccggggcatgaggtcccaaagccccaggaggtggtcccacgaacagtagaacccatctccgaaagtaagaagatggccaaaagtgcagggacaggaacaggatttgcgggcccaaccaacttacgagtagagaggtacacacagtagggtcactcgggcgtccctaagatcaagcacacaacatatgttggcggcaggcaacggggggagacccccacggtgtctaaaaaacaacccgcttcggtgcgctacaaacaagtgcgtcacgccgcggggaacacactacgagtctcgatgcgcaagcgcaagcaagatgtgccaccacaaaccggccacaccaaggaatttgctccaactaggtcttccaagcatcgacacgcagagcccacaaggggacagccaacaaaggggatatacaacagcggaaaacaaaacccagccagacccccatagactacgatagcccatgatcacacgtaggaaaccaacatcggacaaaacgcgcaccacaaacagagatgacaacaactagaaccgtacacacacagaacaagcgggcgacgagacgagacacacccagcacagagcagagacacgacaactactcggaagaacaccaaacagaaggaagcgacaa

SEQ ID NO: 552435 - DNA, 332 bp, Homo sapiens
agctcggcccgtcttactgtaatacaggacgccatattggctcgcttggaagcctacttgatctgctctgttgctctaactacgcacagtacagcaccaagctcatctttgccatcagcccacgaaaactggcgccctattcactgtgtcggtaatgaacgttcaactgcgcacgcgtactgtcactggccgaacgttgatcactcaccgagctaggacaccagcgcactgatacactgcttcggcgtcgcaccctagcctgtttcacgcgagtggtgcagttccagctcggtacgattgattactttcaggatcaggaagtcagcgacttg

SEQ ID NO: 552436 - DNA, 231 bp, Homo sapiens
cgtgaggctatcctggtgattgtctactacactcccggtgctggagagagcagcaaaatgaacgatgcttttggtggtggtccttgactgcttcgccagtcatagaaacacaggctggtgtatgtgtctagcttacattccaaacaaatgtcatttcgcatcactgagcggacagatcttcttggcaaacagaattgttctacaaaggtattcgccctgcgattaacgttg

SEQ ID NO: 552437 - DNA, 130 bp, Homo sapiens
  misc_feature (41)..(41): n is a, c, g, or t
  misc_feature (49)..(49): n is a, c, g, or t
ttacatgatacaattcgagctcgtgtacctgaacattcgtngtcaactngacacggagtgcaagaagacattgaatctagaactgctaagactcgtgcccaactgacacggaggacacgaatgttcaggc

SEQ ID NO: 552438 - DNA, 98 bp, Homo sapiens
gattaagaaaatttccagccctttaatggcccattaactgagaatgtaagaaaattgatgctggacaaggcaaataaaagctgtttttttaccttgga

SEQ ID NO: 552439 - DNA, 418 bp, Homo sapiens
  misc_feature (289)..(289): n is a, c, g, or t
aaaggtatttaaaaaactgggggtctaaacaacaagaaattatgtaaaaatcccttgaaaaaaaaggttgtcttacatgggaagaatgagggcaaataatcaggaaaagggggtgaaacatgtaaagtgtatctcatttatcgggtacagttgtgtcaatcggaatagagtactttgggtcatgaatacagaaaagggaggtaagctttcgacagttgtggccctgttcatgggaaattatgtgcacacggtaaaatgccaggaaacaaggccaggtgtggcggctcanacctgtaatccgtgccctgggggaggccaaaggggggtcacagctagagcctaggagtttgcacataccttgggcaacataatgagaccctcactctaacaacaaaaacaaaaagtctgggcctagctc

SEQ ID NO: 552440 - DNA, 202 bp, Homo sapiens
tttttttttttaaaaaggttttaaaggatttaaaaaaaagggggggggggccccccccggatttttttccccttttttggaaaattgaaaacgccgaaaaaatttttttaagggggccaaaaaaaattttggaaaaaaaatttttcccccaaaagtttttttttgggttttggggcttttttaaaaacccatttggggggga

SEQ ID NO: 552441 - DNA, 898 bp, Homo sapiens
agcggagtcccacccgggagccggcagggagcggagctgcggagccgcctggtctcccgcgtccatcggtccattcctgcgtcgttctgtccttccgaacgacacttcaggagcagccgcgagggtggcatggcagcgagcacagacatggcatgggctggaggagagcttccgcaagttgccagtccatgggtgaccccaaagggccagtgggcgaagagatgaatggcaagagaaacgtgggccaagctgtgcaacggactgcaagggtggctgacggaaagtccgtgacagggaccgatgtggacatcgtactactaccaaagtcgacggggaagtctagctcgggtcatcaagctatgagagagtcagagaaggccctggacaggagctggcgaccacagaagattcaaggggaaagagcagcggacggaggccttcgatgccatctgccagctggtggcaggcgaaagagccagaccgaatgtgggcgtcactaaagcagaacccagggggtgctgtagagcggactgacggaccaccaggagatacacagggactgccacaagggagcgcttcgatgaggagcggcaaggggcaaaggcattggcgggaccggcaggacatcctggacgacagtggctacgtgacgccgcctacaagaatgacggcacctacgatgccaagggggaacaagttgaggctggggaaggaccgcctgccaagtgcggatgacactgacaagaggctcaaggctgggtactaaggggacgtggagcaagaaatcgtggtccctttgctgattgaactgcaaccaaaagttctgctagatccacagggatggccagagctttgaccaagtgcataagaccttctctctttcaggtcaatttgcact

SEQ ID NO: 552442 - DNA, 424 bp, Homo sapiens
  misc_feature (48)..(48): n is a, c, g, or t
  misc_feature (399)..(399): n is a, c, g, or t
  misc_feature (405)..(405): n is a, c, g, or t
aaaatagaagtctaagaataactattataggattgtatttggaagaantagaataaagcatgtgaaacaattagtacagtactatatctgtcacattgttgtttaataaattgtgcaagtactcaaaaatggtagctgttattatttgtaatatgaaactaaatatctgattggtagattaatgttaaacatgcatggtccaatatatttctttctttccttttttatatttttggtataaagtctattttcttgaaaattcctgctttttttttttagaaggacaaaagtactttgatttttactgctctgaaaatatttatcccgtaaaaagctttcacattaactttgagtccctggagctagggaggagaagcagcaggatttgctactaagtanagctcnttcatttctaccatcaaaa

SEQ ID NO: 552443 - DNA, 375 bp, Homo sapiens
  misc_feature (126)..(126): n is a, c, g, or t
  misc_feature (270)..(270): n is a, c, g, or t
  misc_feature (277)..(277): n is a, c, g, or t
  misc_feature (338)..(338): n is a, c, g, or t
  misc_feature (349)..(349): n is a, c, g, or t
gactgcccttgctccatcctgtctgaccagcagcccccatccccatccttagtcccctgtcaggcccccctagtcccccaggcctcttccctctctggccccagcccagctttccagtcgtcctgntccagtctccttcactgttcatccctgggggaggtatcaagacagtcgtgctgacccctgtaggaggtagccctgtgcttggtaactcagtgagggtgaggagactcccaggaacagcgtctctcccatgccaagggctccttnacccccnaccacctatgggtacatcagcgtcccaacagcctcagagttcacggacatgggcaggactngaggaggggtngggcccaaggggggagtcttgctgtg

SEQ ID NO: 552444 - DNA, 362 bp, Homo sapiens
aatcttcccggtgcttctgttttccttccctgtgcggtatagcagcgtctcagcgcgccggaacctttgaatgcttgtttatctgtctgtagtcggttgcagttggatccaggcgtgtcctccgggccgggaaggagagcgtgtatagttgtttttcggtctccatctctccaagtgctggctgcaactgcccctcacggtgtttacctcccttctcaccccaccgggagggagcagagcagggtgtccatgggggctgcaggggggttggtgggggacagtagcccagcccacacccacagctccctcctccatccaggctcagagccatgttcccaatgtgaggcccctcgggaatgaag

SEQ ID NO: 552445 - DNA, 806 bp, Homo sapiens
tttttttataattattttattttttttgcctttgccaaaataaggttttattttgaaagtcatttgatgaaagtcatttgaaagacactgaggagggaaggaggcctaagacccaacagatgtaggatccagatctggattcgtgccagccccaccaatggtctgtcaggccaagaaggtgctttctttggtaattcatgttttttaacttcctggagaagagatcttttcccacaagccatcttcattttttttgtagagtagggctttatttccagaaaacagtgtgtgagctggagatgggtgtttttttaaaaacatcaaggtagatctaatatgttcaacaaagtggggtggctcagccagaggcgaagtggaaagattctctagtatttgcttgtcatcttggtgcaaccagaaatccacatgtggaaatggtgtccaggagtacggtcctatacgaagttgttctgtctctgcatcataaatgctaatcattggtcctcctgctaaagctcacgcggcacgcagctgctcctctggacctcgatcttgaaaggaggctctgtaggccaggcacggtggcttatgcctgtaatctcagcattttgggaggctgaggtgggcagatcacttgaggtcaggagtttgagaccagcctggccaacatggtgaaacgctgtctctactaaaaatataaaaattagccaggtgtggcagtgggcgcctgtaatcccagctacttgggaggctgaggcaggagaatggcgtgaacccagggggcagagcttgcagcaagccgagat

SEQ ID NO: 552446 - DNA, 1466 bp, Homo sapiens
  misc_feature (39)..(39): n is a, c, g, or t
aagctgagggcacgtgtttgcggttcagccctttgatgnccgcagcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtatgaacatgctaatgatgataagagcagtttgaaatcagatcccgaaggggaaaacatccatgctggactcctgaagaagttaaatgaactggaatctgacctaacctttaaaataggccctgagtataagagcatgaagagctgcctttatgtcggcatggcgagcgacaacgtcgatgctgctgagctcgtggagaccattgcggccacagcccgggagatagaggagaactcgaggcttctggaaaacatgacagaagtggttcggaaaggcattcaggaagctcaagtggagctgcagaaggcaagtgaagaacggcttctggaagagggggtgttgcggcagatccctgtagtgggctccgtgctgaattggttttctccggtccaggctttacagaagggaagaacttttaacttgacagcaggctctctggagtccacagaacccatatatgtctacaaagcacaaggtgcaggagtcacgctgcctccaacgccctcgggcagtcgcaccaagcagaggcttccaggccagaagccttttaaaaggtccctgcgaggttcagatgctttgagtgagaccagctcagtcagtcacattgaagacttagaaaaggtggagcgcctatccagtgggccggagcagatcaccctcgaggccagcagcactgagggacacccaggggctcccagccctcagcacaccgaccagaccgaggccttccagaaaggggtcccacacccagaagatgaccactcacaaatggggaaaccagggtgcagagatttaagacttacccagcctgtaaactctccccttctagtatttgcttgtcatcttggtgcaaccagaaatccacatgtggaaatggtgtccaggagtacggtcctatacgaagttgttctgtctctgcatcataaatgctaatcattggtcctcctgctaaagctcacgcggcacgcagctgctcctctggacctcgatcttgaaaggaggctctgtaggccaggcacggtggcttatgcctgtaatctcagcattttgggaggctgaggtgggcagatcacttgaggtcaggagtttgagaccagcctggccaacatggtgaaacgctgtctctactaaaaatataaaaattagccaggtgtggcagtgggcgcctgtaatcccagctacttgggaggctgaggcaggagaatggcgtgaacccagggggcagagcttgcagcaagccgagat

SEQ ID NO: 552447 - DNA, 611 bp, Homo sapiens
  misc_feature (425)..(425): n is a, c, g, or t
tttttttataattattttattttttttgcctttgccaaaataaggttttattttgaaagtcatttgatgaaagtcatttgaaagacactgaggagggaaggaggcctaagacccaacagatgtaggatccagatctggattcgtgccagccccaccaatggtctgtcaggccaagaaggtgctttctttggtaattcatgttttttaacttcctggagaagagatcttttcccacaagccatcttcattttttttgtagagtagggctttatttccagaaaacagtgtgtgagctggagatgggtgtttttttaaaaacatcaaggtagatctaatatgttcaacaaagtggggtggctcagccagaggcgaagtggaaagattctgaaaacacaagatggtgggcattagagaagccaaccttnctgtcccctgctgtgataaagatgtcaaagtatctttgttcttggacacaaatatatataataaaatacgttaagaaatgaggtggcctgaattagtaagaaaaagttgattgcttactgctttacccacacacatttccatctaggacttgacatatccccatttgatatacaagttaaatgggg

SEQ ID NO: 552448 - DNA, 398 bp, Homo sapiens
gggcaggagggctgttggcctaagcagtcacacaattttgcaccgtctgagcttatctgagcaagacatacgtgtcatcctaacgcctcccagtcttcctcagtgtccgttccagagcctgggttgaatttttgatctctaatgtggcaagtttttgctcagggtgcagctgacagaacaggatctcattcacttcaccctcaattcgccggacatataggagggggaacactgccttgagcccagccagcactgagtcttttagccccaagtctcggcacacaaggttgagaataaaaacaccttcaggagtcaagatgcttttaaccttctgtagaaaagattgctccacaaatgctgggggcggacaactcattcccagtgttgggtcctcactg

SEQ ID NO: 552449 - DNA, 416 bp, Homo sapiens
tttttttataattattttattttttttgcctttgccaaaataaggttttattttgaaagtcatttgatgaaagtcatttgaaagacactgaggagggaaggaggcctaagacccaacagatgtaggatccagatctggattcgtgccagccccaccaatggtctgtcaggccaagaaggtgctttctttggtaattcatgttttttaacttcctggagaagagatcttttcccacaagccatcttcattttttttgtagagtagggctttatttccagaaaacagtgtgtgagctggagatgggtgtttttttaaaaacatcaaggtagatctaatatgttcaacaaagtggggtggctcagccagaggcgaagtggagtcgagcggccgcgaatttagtagtagtaggcggccgc

SEQ ID NO: 552450 - DNA, 551 bp, Homo sapiens
ggaacaatcacttatcccgttattgaatgctttctataaatttaatatataaaataaggtggctttccagttcagcgttctgtttctcaagaggattactgagttcttggtgtagccgcattcataaagtagggccaaaatatgtatatgtcttatgttatgttagaaaacaggtccttagtgtaattccagttactttgagcgtgaaaatcatggatttgagttttaatgttctaccgtattgcaagcaggagttctccatccgttgtgtacgtgtaagtaggtgtcagagtaagacttagaaaattaccaagtgccggggtccctcctccagagcctttgaacgtggaactaatggggtggggcttgagcatccacttttagaaatgttttccagtgattccaatgtgtagctctatttcccatcagatttctctgatttcttgtggcattcaattttttctattgtggtatcatgattatggtcaggtctcatgtcctgtcttaggctttatgtctcctggggtagggaccttgccttcttcagttct

SEQ ID NO: 552451 - DNA, 1354 bp, Homo sapiens
  misc_feature (229)..(229): n is a, c, g, or t
attgggtccccagttgttgcactcttctgtctcgtttccttacagcttagctttagctgctcgcagttgcaaggtgccgttgagtgtggcatatgtgccaattcggagctgcaaggaacggttctagcgggttccagcatgcaggaagcaggttcttactagtcacttatgccctacgaggaaggcgaaacacatgacttgacagaagaaggtatcgcaaccattccgnaaagcacactcgagtgcgagattcttctgtgttggccacgcctgtgtcaggattctataaggcatgtgacttctgggggaattcacccaatggacaaataccaatgatcaaaaacatgtgagcactggaagggattagcacaaccaattgttgacagcatgatcactggggctgatttagagtagtagtggggatgatacgtattggtgagacatagatatccacattaagcaaagtattaagatttcttctggagattgtatgccacatgacacggggcgtttaagatgagctcgaggacattggtcatgagtctggaaggttacgacacgtttgtaataaggttgggcgaatacgcttccaaacgtaacaggcgaggcaacggagagacttacaaccatggcttcaggaaacagaatttcacttccttggcagttgaacctggatatttcgacccgaatggagggttggcttctcgcgccccaaggttcggcctcatcaatgtttcattcacaaatttatcaggacactatacttttaggcataatttgcgcggttgtcccacccaagtgcacaaatgaaagtcggggattgtgggacgctgttctggggaagcttaattccaatggaacggcaaaagggttttgataatatggcaaagtgtaagaacacaccaataaaatagaagctatattaccaggggcatcgagggggtaactcgcacgaaaaggaaaactttggtatagaactgttttcatctaaagataaacggggcgggaaaaattaggaagagtaattcattgaagcaactataattgtacatggaaaagtaagttgtggcgtaacgagggtaatgttcccccttgggttggcgacaacgtcaattagacactattgtcatcaacagccacttggtgcgcaccccagcagcaccactggagagcaggaaacctcccacacatttggaagacgccctcattctcacgaaatttggtcgctgcaaagcgaacaactcaacactggggtagagagcgaacctcgttacatcgacgacaacatcacagacacaaccacgtcaatacacggcagacacaaaccacacaacagcgacgcgacttaagagac

SEQ ID NO: 552452 - DNA, 667 bp, Homo sapiens
  misc_feature (544)..(544): n is a, c, g, or t
  misc_feature (627)..(627): n is a, c, g, or t
  misc_feature (634)..(634): n is a, c, g, or t
ctgacttcaaattatgctacagggctatagtcaccaaaacagcatggtactggcataaaaaacagaaacatagactcatggaacagaagagagaacccacacacctatactgaactcattttcaacaaagttgccaaaaacatccattggagaaaaaagacagtcttttcaaaaaatgttactgggaaaactggatatccatatgcagaacaacaacactagatccctgtctctcatcaagtataaaaatcaaatcaaaatgaatgaaagacttaaatctaagacctcaaactatgaaactactacaagaaaacactggggaaaatcttgtggccactggtctgagtgaaaagtttcttgagcaagaccctacaagcacaggcaaccaaggcaaaataaatgggctcacatccagttgaaaaagcttctgcacatcaaaggatacaatcaatgaagtaaagagacaattcacagagtgggagaagatatttacaaactacccatctgacaagggattaataaccagaatatataaggaactcanacaactatataagaaaaaaatccaataacccaatcaaaaaatgggcaaaagatttgaatagacatttctcaaaaggaacacanatggcanacagacatacttgtgctccatcactgatcatcg

SEQ ID NO: 552453 - DNA, 151 bp, Homo sapiens
actgtctatacacaaaatataccaagttgtgaaccaaaattaagggattgaaggaggcttcagcctattatcaaaactgaagagccattattaaaaaattcccaaattattgattgagtgcccgtggaattactgaaaggcccggaggacc

SEQ ID NO: 552454 - DNA, 314 bp, Homo sapiens
  misc_feature (22)..(22): n is a, c, g, or t
  misc_feature (27)..(27): n is a, c, g, or t
  misc_feature (169)..(169): n is a, c, g, or t
  misc_feature (190)..(190): n is a, c, g, or t
  misc_feature (222)..(222): n is a, c, g, or t
  misc_feature (258)..(258): n is a, c, g, or t
  misc_feature (264)..(264): n is a, c, g, or t
  misc_feature (282)..(282): n is a, c, g, or t
  misc_feature (308)..(308): n is a, c, g, or t
ataaatgaaaaaattagtggtncacgnctgtcctctcagctactcaggaggctggggtgggacgatcccttgagcccaggaattcaaggctacagtgagctatgatcacaccactgcactccagcctgggcaacaaagcaagaccttttctcaattaaattaaaaaganaaaaaagagttagggagattnggccccacccagcccccgtgtgaccagggctngggtagacaggtcagtcgaaacaatggctgtgcttntgtggnggagtaagagggcacaangcccccatgtctagggagggcaggtncatcac

SEQ ID NO: 552455 - DNA, 279 bp, Homo sapiens
  misc_feature (21)..(21): n is a, c, g, or t
  misc_feature (210)..(210): n is a, c, g, or t
ccgctcgatcacccactattnctcctataactttaaaacgtgaacattcgataatctagccagtctttaccttctcaggtaacttcttcacctgggttgcaattcccttttaaataacatactcttgttccggaaggcagttagccagtcatcactctttctgtctaaataacatccaaagacaaatcccataggggcaaagacattganctcagaggtcccgcacatcctgaagtaattctaccattgatagctttacctgaagggctactataaaga

SEQ ID NO: 552456 - DNA, 291 bp, Homo sapiens
tcactaagatgtttgtgaagcaaagttctgtgtctactttacaagcgactccagtggagcttagagaatgaagttccttgttcaagagtgtagctaataagcagcgaaggccagggctcagacgacttgttcagtcttctttgcattcaaggtgctttctttctagcgtgctcatagcacaaattcgaatgccttctactctcttttcaggtactcctcacatggtacacaccactttgtgcctcacagattgaccgtcaaaacgcccgcgaatttagtagtagtaggcgg

SEQ ID NO: 552457 - DNA, 156 bp, Homo sapiens
gttcaggcattgtgatagtgatctcatggtatttctgcagtattacacagggctatgccaaggcggtgtattaccttggaaaagcgcaatgttgagggtaaatcaatgctaggttgtattaggctttaccaaatagcttgttctacgcagtttatc

SEQ ID NO: 552458 - DNA, 424 bp, Homo sapiens
actactatgttaggccattcttgctttgctatccagaaagacctgcgactgggtaatttataagtaagggcaattgtctcatagttctacaggctgtataggaagcatagtgctggcgtctgcttttggggaggctttaggaacctttcaacattgtggaaggtgaatggggaacaggcatctcacatagctggagcataaccaagagagtgtgaaggggagatgtcacactttacaacaaccagatctcacaagaaatcactcactatcacaaggacagcaccaggccatagggaacctgccttaataactaacgcacctcccaccaggccccacttccaacattggggattgcaatttaacatgagatgtggcacgggcatatattcaaaccatatctccttagtcccttccattcatctcg

SEQ ID NO: 552459 - DNA, 1172 bp, Homo sapiens
cccacgcgtcgcggacgcgtgggtcgaacgacgtcgttcgacccacgtcgtgccgatctcgagatcctctgatggggctagtgaatggcgagctgcagcgtttgtcatggccgggcttacaggggcattcttgggcgcacatgcagtggctagtcggtgccagttgggtacggatgtgtgcagaggtgagacgcacagagctgatgcgggatagggagacagaagggaacatgtacgcatttgtgagattctgggcacggcgccttccttacgactgtccagatagaaatgttcctcgccttgctccagtctggccagccactggccacgggtggctctctggacacctggaatgtggctagcttcgtggctgggggctggcttcaaacttatcctcgatagtctacacaaggacccccctcttcctacaaagccctataccatatgcaacacacggcgagccacacggcagccccagcagcgtggtacaaccagaccagacaacccaaaatgagcgcagccacccaccagacgctacacgcgccaacgccggcgcacatcaccccgcaacctcaactccatgcacagcaggcatcaccccacgtggcagaacggcaagcaacgaccccttacaccccatgtcaacagacaggcacctggtgaaccccacacaccagctcaaagaagcaccacagccgggggaccagcacagcccgcccgcagcagctacccacgcaaccgcaccgcacagggaccaacaacagaaacgggcacgggacacggcacagacctaaacgaaacccaacgaacatgacctgcctgaaccgaaacacaacaacaccagacaacaacacacaaaagacgaagaaaaaggcaccagaagcagcccaaagacaacaagcaaacaagaacgcaaacaagaacaacgaaaaaaaaagaaacacacaacacacaaaaccaaaacaaaaaggaggacagcaaagaggacgagcaagagacggagaccgagaagacagggacgccacgcgagaggcagacgacaccagaagaacagagccaacaaggggaaagcacacagagagggaccagggaagagagcgcacaccggaaacaggacgccggaacaaggcgacgcgaaaagagcaagagacatggagcacgtaccacaccag

SEQ ID NO: 552460 - DNA, 354 bp, Homo sapiens
cgcatcttggatcacacgactctgctcccggattcaagcgatcctcctgcctcagctcccaagtagctgggattacaggcgcccaccaccacacctggctaattttgtatttttagtagagactgggtttcaccacgttggccaggctggtctcaaactcctagcctcaagtggtcccccaacctcgggctcccaatgtgctaggattacaggcatgagccactgtgcctggccctatctttattatcttaatttcatacgcccaggtaagcatgcatacctgggcgtatgcccttttcctaacactcacaacaaaactaactattactaacatctcatacacccaggtaagca

SEQ ID NO: 552461 - DNA, 195 bp, Homo sapiens
gctactagtgacattgtgatgctgcacagccgtctgcataatgtttcagagagaggtacagatgtgttccgcaggtaatcaccccaggttaggttcagactacatgtggtgccttgtttcatggtgcatggaagttctacacttaattcaaatcctttgctatgtgggctattagggcctgctatccatgccata

SEQ ID NO: 552462 - DNA, 253 bp, Homo sapiens
cgccagagcgtggagggcgaatcaaaggctggccggggtgctggatgagctcactctgtctaagactgacctggaagatgcagatcgagagcctgaatgaagagtatgctaaattgagaaaacctggagagggttgagggatttgaccgttgtgtggcgttagggggattgtgacccagattgtgtccgtttgggattgggttagtggtaaagacggggtaaatgtcccagggtggggtggtcgtttaaaaaa

SEQ ID NO: 552463 - DNA, 1156 bp, Homo sapiens
tagaaaaaaaccagtttattaagtaatatcatataaataactggttacaaaaattggatttggcaaaaggcatatttactcttggtgagaaatcactttttaaattggcattcttttcaaatttataagtctaagaaaacaaaaccaaataaaagaagccatttcaaggagtgcgtatttggccattggactggcaacaaaaggcccggccacactgagctaaaaggtaatactctcgaccccattcttctaacacagaaaactttctcaggtaaacgggggggttatgagaatccccctaactagaaatggtggatggggaactggagcattggcgtggctttcatcaggtgtccttggtggccaaagacttggaacggatactggaggaaaacggacaagatgtggaggcattcccgccagtaaatcttcaaggggtgggcatccggtgttcaatttatacttgggaagtattttaaattaaaaacaatcaataccaaaaagctttaatttggggggtttaaaagtcacaaatcacagggggagaatgccaaatggcgtttagctgggaactactgaagacgcacatagcatttattataagggcctactcttaggcagttcactctcaaagcaatgaaaataatctcaaaccaaacattacaggtgggttgtgaagcgttcctacgtatcttccgagcagggtcagttttacattgtgctaccacagaattcccaagaatgcctggtaattcttatacattggatctttaataaccctaaactattagatcctagaaaacataaaggattagaagaggcggctcccgaacattttccgtaaataaggtagactcaagaaagaccagatctcttagggggaggggctcttccccagggggggtgcagtgcccccattggtgggattacccccctgggagggaaataggtgtggtggtgacgtggggttttgagacaacacaacacaacaggggggcgaaaaaacttagaggacgagacagacacacttataagagcacaatagtaaaataaaagcggcacagatgtgagaacaatatgaaacatgatagagaaacaaaatagttagtgttcacttctgtacgtcctggctattgaagtagtggcagcgaaatga

SEQ ID NO: 552464 - DNA, 436 bp, Homo sapiens
cgcacgcctgatggtttctattggcaaacacgcacttgctaacagcactcctgtaaagttaactgctacctctgagatttagctaggaactgcctctgatcctatcccgacggctgagatggaccgaggctgcggctctggtgtggtcacctacacgctgccctgtatcttgcgagctggcgatggaatgatcttcaaaatttgtacatctccatcttcaaaattacttcatgaataacagaattagcagttaatgatttgacccaggaaattactagtatatgatgtaatatatcagataccactaatagatggcagagggcgagaaagtagacatctagacagtgcttaattataggatcgattacaaggaaggttcaggccacatctcagctctgagcctggcctcctccatacaagttaaagcattacacag

SEQ ID NO: 552465 - DNA, 459 bp, Homo sapiens
gactgtgcccacctgggctcaggtgatttctcacttcagcctcctgagtagcaggctaatttttgtagagacagggtttcgtcatgtgtcccatgcttgtctcaaactcctgggtttaagctatccatctgccttggcctcccaaagtgctgggattacaaacgtgagccaccgtgtgcggcttgtatattttttttttttttttttttttaagtatttatggatcattctggggtgtatctcgcagagggggattgggcagggtcataggacaatagtggagggaaggtcagcagataaacaagtgaacaagggtctctggtttccctaggcagaggtccctgcggccttccgcagtgtttgtgtctctgggtacttgagattagggagtggtgatgactcttaactgccttacaagcttctgtttaacaaagcactttttgcaccgccctttatcca

SEQ ID NO: 552466 - DNA, 1016 bp, Homo sapiens
  misc_feature (21)..(21): n is a, c, g, or t
gcgcctaagtggttccgggtnggtggatgaccttgagccctcaggaacgagatggcggttctctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactgggggccttggacaagttgttactgactatgttcatggggatgccttgcagaaaagctgccaaggcagggcttttggcactttcagctttaaccttgtgctgggctttgctatttcaactatcacgatgtggggcatctgcaaagctgttgccatgctgtggaagctctgacctttttgacttcatacttttgaagaattgatgtatgcctctttggctctgctttgtcatgccattaagctcacaataaggaagaaataaccagataagtccattggtggacagcttcttctcttaatcacaagattattttcagaatttaatcttgagggaaaggttgagaggattatatctaagtggtgagactgagtcctatatactggtgagtaaatgggggttgcctcccaagttctttataagactcacaagtataagtaaaacatgatatatcaagtttgtgggctttcaatttatcaatctcttaaagagaatccactttaatcgataggatatgatcaaatttccatatttggctgggaataatggccaagggaaatattttaatcatgataaacttgggaaaattgaagtgttatttgaaattcctttaaaagagataactatggggctttagggataaatagaagtgtga

SEQ ID NO: 552467 - DNA, 125 bp, Homo sapiens
tataggcgctaaggtgacagagactgtgtctcaaaaaaaaaaaaggcttttcttaataatattactggctggcccaaagacttgactccctacactaagcagcagcattgggagggggtgtcccc
